United States Patent 9,328,346 (POLYCOMB-ASSOCIATED NON-CODING RNAS) - sequence listing, part 95

SEQ ID NO: 17768 - RNA, 261499 nt, Homo sapiens
ugggagagagaagggaaaguaacaacagaaaagguaaaaggacuuugagaguucuuuaaauuguuucuguuagcaucucugagugucuggggaacgucgguuuggcggccacgcacugccccccaccugccccccacuaccccaagguaaguccucgucuuuaucacauuauuccuaacgcguucggauuuuuccuccuuuuccagcccgcacguucacagacgggaggugggggagggaggaggggggagaggcggggcgggaagguagccgggucccugcaccgcgccgcucucauuugcggcgcuccgacucgggcgaaguucucgcgcagccggcucgccgcggccggggccggucccggcgggcggcggcggcgggugcucggagccgggcggggcggcggcggcggcgcggggacgcgcgcugucucuuuaagggagcucggucugggguggcgcuuuccuccgcgaaggcuccuuugauauuaauaguguuggugucuugaaacugacguaaugcgcggagacugagguccugacaagcgauaacauuucugauaaagacccgaucuuacugcaaucucuagcguccucuuuuuuggugcugcugguuucuccagaccucgcguccucucgauugcucucucgccuuccuauuucuuuuuuuuuuuuuuaaacaaaaaacaacacccccuccccucucccacccggcaccgggcacauccuugcucuauuuccuuucucuuucucucucucucucucucucucucuuuuuuaauaagggugggggagggaaaggggggggaggcaggaaagaccuuuuucucucccccccgcaauaauccaagaucaacucugcaaacaacagaagacgguucauggcuuuggccgccgcgccaccaucuuucgggcugccgaggguguucuugacgauuaaucaacagguaaggaggggaggcccgagcgggccgcggggccgggggcugcggggggcgcggggggcgcgggcgccccucggccgggcccggggcgccgcgacgcgagugcagcgcccgcucgugugcgcgcaaaaugugggcgaucgcgagcggggagcccugggaauuaaaagugacuuucuuugaaaaaaaaaaaaaaaaaaaaaaaagcagagggagagugugcagaaagccaagcgcaggcuucucggguuucacaugcauuuucuuucuuccuuuuugagcgugugauuucuuucuuucuuucuucucuucugcucccuuuuucccccuuccucuccuccuuuuggugggucugaggcaucugagcuuuggaaaccagcgacuucaaacugcaguagccccuggagucagcagggucaaguucagccgccggggaggaggaaaaacaaauccccauuugccaaaaaaagaaguuucaggccggugcccccucccccucgcagccccacucccccucgcugucucuuucuggcugauuuuaauucucuccuaccgggcgcagcggaggagcuggaggugguuggacccgaggggccgccgccgccgccgccacugcaaguuuucugggggcucgugacaagcggggcgcagacuaggcaccagcaugcagaguaguaaguugggcgaacucgggagggucgggagggucucagagacgggccuccguauggucuccaaagugggaaaacagcacaggacugccuuuggcuuugaagaguuugcaaaugcaggcuucaaacuuuuuucccuuaaaggcccagcugggcucuggagaaggcgggugucgcaucccuuggugcacccgccucagagcggcucaggacagcuuggccgagcggucugugcccuguccguaccauguggcagggccuugcagcccgggcgcuuccguaggggcugaggaaggggcagacuuccucugcgaugcgguugaugcgccaugugucgcgcgggucaggggacacuggccggugauuaaaugccugacagcggugggacauccaagcggacagacgcuuugccuucugucugguuccuguuugggaucuagagaaacgcaucuuugaaaggccaaggcaaacaucgcugucccuccaaauaacuccaggauuauaggaccccaggaauaauuugagggugaggcggcggugggagcuguuugaaguguaaagcuguuuuuguggcugggaaagcuuuuucguuaguaccugucugagauggugguguuucccccuuuccccagggaagucagcaacuguuuuauggccccaggacucuaaagcaauuuaaguuagagggugagaaggacugguggguuucagagggaaucuuggacuuauuaaauuuuaggaccggcuuuacuucccucuaucuuuuuaggccucauauuugaugcuuugaaaguuuuuugaguaagccauugaucuuaaugaugaaucuaaauuaugauagaauauucauucuuaugccauuuuggaaaaucacggcuagaguuuaagcgagguaagugaagugagaagcucagcggaggaguuaaaucugagacaaguuaggccuauucauugaacuuuuguagauucauugaacuuuuguaaacacaccaggugaacaggaaaggaaagggucugggagagauaauaaguacaaaagaaaaauacagauagggccugagacaaaauuacaaagaaaugauaacucugggccugguuguuggcuaaaacuugauuguucaaagcaaaaauaaaauaggaaccuuccaacaauucuucaaaguccuccagcucugaagcuaaaaccuauggaucuugcuggcaucauguuacuuuccugcugguuuuagaaaaaguugaucauuuagaaaaggcugccagaguuaaaaaugcaagggacagcagaggaaagucaugcgggcagccaguucuugacguggacaaaaugagaaugaaaguuucugaacucacuguugugaaguuuuacaugccgcucauuugcuuagaaggcucucucagauauuccaccaguuaacguauaaaagcaaacaggaucuaaaaucgugugggcuuuuuuuuuuuucuuuccccaaguaugccaggguugugaauaaauacaggguuuguaugggaagaugaagcguuuccuguaaguucugaugcugacaggacagucuggaaaugauaccaacauuuugaggauuuuuuuuuuuuaccuuuaagugaaaguuuauuaaugauaugcuuaaucuuaacaagucaaacauauucuuagaguuucucucuccuuggauuucauaacuuccuuuuaaagcuacaccuuuggauaaaaacaucucuagauucaguucaauauacagggcuaguaacaugcuaaaguuugacgauuauuucuggauguuaauaaugugaaaauaaaacuccugaggggcaaauagagccuuaauaccaacauuauaacuugauuucucugaaugugaggccuucugaagcuucauuaguacucuguuggcgaaguauuauuuaccacuggcgagcugauguuuauggcuuccugauauguauguuauauguuaggauauauauguguagacugcuuuuccauacauaauaccuaagucuaacacuuuucaaauaagugguggaaaguagcaaguuacuaacacaaaguuugucacuccuuugaauucuagaugcuguaagggucugugcuacuauuuagguuuuguccuuugucucuuaaagguaacguuaaagguaaggagaaaaaugucauaauagcugugaagucugagcugaauuuagaacuuagcauuucgaugacuaauauuuuaaaugauuuuauaaaauuuucugcauacguguuugaaaaccaguuuaggaucggaaucagugugcuaauccgaaauaaguuacacauacuacuaccauauuuucaguauuauuuaagucaccuaccacuccugaguuuauucugauuuacaucauauagaucucuuccuauaaggaaauauucauucauaaggaagaccuuuaaaacagggaaaugcaugcaucuguagaaaagcagcuuuuacgauucuaguauuucagugacgguucuauuaucacuacuauuauuagauguauauguguauguguguacagacauacaacccacaauaugugauuaaugauguguacauuuuuauuaagaaagcaaccaaagacuguagauuuuuauaaacgcuugucuuaccuucuuuguuguaaauaaacauuacugaaaguuuccagaggacuugcagcaaauuguuuuugaacuagaacuuuauuccaaauuugaaauuggaauaaaugcugauaacugaccuuuaaacauuuuucauaacaugaauauuuuagaauaauuauauuuuaacuucaguucuucuuuugauagcaacaauaauguaacaacacuaugcuauuacguguacaacaacacagacuuuaagaaaguuaugggcaggugucuauaauugauuuaaaggaaagauuauuuuuguaauaagugaugaacuuaaaaugacuggcuuacauuaaaacauauucuuauuaagauuucucugguguguaaaaugaagccauucauucaacaggcugacaacuuuccacuugguauuugccuuuccuuaauuuaguuuccgcaggacagcuagugugguagucugcaucuguuuuuagcaggcauagaaaacuauaaacucagacaguucugucccaaauauugcagcucacaaguuacaaucaauuugauaaaaacccgcaaguuuuaugggcucguauuuuguuguucauccuugcuaggucaagcuuucagguaauagguuucuuuuucucccucuuuugcugaugauaacugcuaauaccauugauaacuaauucugagucuuguuuacucauuuaucauccuuauuuaccauuuguugaaguuuugggaaauuaaugacagcauacguagacuugcguuuacuuugauggcuuaucugugaaaaugacauuuaucuuuuguuauuauacagaaauaaguaaauucuuuguuaccauaauaguuaugauuuauggaauuuuugagucccccuuagauauagcauaaagauggucuucuagccuuugccaaguagacauuuaaucuaauuguuuaagagugcuugucauguauagaaaagacuaacauacuuugcaauuauuuacauuaaaaauuauguagagguuuguuuuaguguaauuuuaaaaauaauuugucucccaaaagcuguaaccaguggauuaaaguaaauaagcuaaaauaccaaaucuuguuuuauaccauuguucuauagcaaacagugcugcagaggauguaacuacuuuuuaaaauuuauccuccgauguaaguagggccaaagucauuuguuuguauaaaauauucuauuaauuauauaugaccuuuauaaauaauaucuucgauuuuauuauuaugaucacuuuuugagcuaucacagugcucaguuguucuccuauuccugagaacugaauuuggccuuuaguuugguuuucugauggacacaauaauguagaacuugacuuugguuagaaagagaucuuugagcuucaggaaucucugaaggugcaguaggaucuacaggugaaaaccauuugaauuguuaagcauuaguuaggugaagaaacucuacuggucccugcagcauauagcagcuauuaucguagcggucuacuuuuugcuaucccaguuuuuuuuuuuuuuuuuuuuuuccuuuuccaagagcacaaauccaaauagcaaaaaugaaggugaaauuaucuauguacuucaaauuuggagcaucauuugaaaucauuuucugauucuaagcuauaacugaaauacaaauauaacauuaagacaccccaaagaagacauuaaggauacacuugucguucuuaaguguguuucacuaaaaauaauaacaaaaaacuuuuaauuuuuaaaauguuucuagcuuuuaaaaaccugcaguaaauacuuuacaaguggcuagacaccuucccuggugguuuaguuuauacaagcaggaaacuuucucuccuacucuuucucucucucuuucuuguuuucuuuaaaccaacugacguaaugccaaacuuugcuuuaaaagaacagacagaaguaauugguagcuuuuaacuuuuaauaauguucuggauugguuuuaguggccaaaaugccauuuaaaaaaaaaaaaaaguucaaguaagaacgggcuuguggccugaggaagaaaggcucuguugaugcaguuauuuuuauucuuguuuuucaaucuguuauuaaaaaucuuuccugcugagcacugcuggauuucuccaauugcucuuugugauggcuggugcauuucagguuaccguaacuuaaacaguuuuuggguuuuggggaaaguggguauuugcguugcauuauuucuuucuuauuuggaaaaaaaauccauuuguuuuuguuucaauggagauuaauuaauuaagguuaucaauggccacaggucaaagaauauguuuauauaacgaaugcgacaccuguuagcaagagccuaaaauguggaaguuuaaaugugacauuaaucauuuuuaugugcagaggaaggaaaauagaugaaacuuuacgaaaaugcauuuuuagauugaaaacauuaauuuuaagggucagugcguuucuacaggcagcucuuuuuuucuuacaauuuuagaugauaauuuuuuaacccuauuuaucaaacaguauuuauaguuuccuuuuuuuuuuuuuuuuauaaauagucauuucuuucucucugacuuugcacaggcaaacagaacuuucuccaguuaagagacaucuuggugauguugauugacaucagggcaacuucagaagcuggcaaguaggaaaaucuuuuuagggggcaaaaagauuugugcuaguguucucuuccuugggaaaagacacuccacccagaaauuauuggguuuaguggaaggcccuccgccccauucgguggcucagaacuaaguacuguuucgacuuuucuuuugugaauuguuccugagguuuaaaucuuacgguuacuugucguggacuuugcuuuuaacccaaauucuuccugauagauuuuuuuuuuccuucuuuaccuagagcacauuuaaggaauaauauauauagugaaaauuaagugucacacaaggaagaguacagucuuuaaggcauuuaugacuauaaaaagcauuccgcaaauuuggggcauugaaguguucucugcuuauaaauuugacaguuuugauuuacuugauauguuucucaguuuuucuugcgagaguuacagacucuaguucaaaucguaggcauuccuuuuuugcuuauggcuucuuuaguuaaagauuuguuuggaaaaacuuuaggaacuuaauguauauguuguucacaucagcauagugcaaguuucuuggaguaagucuagauucauuuuauuuauuacaaaguuuucaaacauacauuucauguuauggcugcaucuguuaauaaauuuuuauuuaaugaauuuuguuuguugcuucaaaaaugaggaaaagcaauaaaguuuagcaagaaggaaauaaggcaaagggagguguuuagaguugcagucccuuaauaucgcagauuguuuacugguaagugguggggagggguuggugggagguuuuguggaagaugauaccaaaaaaaaaaaaaaaaauccaucaauugcgcauaugcuccccuccccuuaagguuuacuuaaacaauauguuucgauuuugccgcaaaccauucugcacuacuucugcuccaagaauccaccacuaucuugguuccugagagauuaaggaugauguuuucuguuguauaaugaacagcaguauuauuugaacaaagguaacacuuuuugauuuguguaauuuuuuaguagcuugucauaggauaccuauaauaugagaggaguucuagcaauguaauugccugcaaauguuugaaguacucacgauagcuuugcuauguuugaauuauugccaauauaugugcaugcuauuauagguguguuuuauauguggaauguauguagaccgauaauacuuagacacaucuugaugguggaauuuagaaugcuaacuauuaacucugugcuugaaaugugaaucuuuuaaggaguuaacaugaccuacauuaugaagucuaaaaguuugaaaugaguauggaguuuaaacauaaugaaucaauuguuaucauaauacuuauaucugcucugaauuuacuaaggaauuuuuuuaaaugaaaaaaauuauaaaucaaaaugccaccuuucaguguauuguaagaaaugcuucugagaucauuuuuuaagucucauuucuguuaagaggagcaguuaagggacaggacuguuugugaguauaucacuuuaugggcuaccacuuuauaguuuacaauucuaucaucucaaaacguuauguagaaauaauauggaacauguaaagacucuguacuaugacccaaugcauuuuucccuagggugauggauucugugcgucacccaaaugugaugcuauuugccaggcuuguaauacugguuuugaggguugaucuauguccuauuucaucaagcaacacaauacaacaacuuugguaucuaggguaauugacacagucaaaauagucucuggaaaacauuccauauacuuuuaaguuaagucagaaguuaauguacauauuaaauuuauuuaacaugaauaaacaaaugauuuauuguuagcuauuugucuaauauacuagauaguguuagaaggaaauauacaaguauuuacaguuuauguuccauuucuuuuuuucuuuuuugaggggagcaugguucucuuguuugcguucauaauagcuuuaucuguuaauuacuuuguauucaugauagugaguaguauaguaucauaaaucauaguaaacauguuuauauuaucugcuauauaugucccaagcuuggaaaaagcauuaauauuacuaguuguuaaauugaguauuauaguaaccaggaaugaauccaguaccguauaagacaauagauaagacaucaacugcuauuuaaacacuaaaaauaccuuagcuguagaaaaagaaagaucaaaaggauuucagagcuguuuuuacuuguagaauuuggacagaauguauaaagcuuacaaaucaauaaacauuaauaauauaacaugugcuuccugauuagauucuacaauacaaugugaauugcuauuucaauuucucuacauaucauauggaagaucagauauguuuauaaauaguguaaaaauauauggcagaaauuaguuuguggaaucuaauuucucuauuacaugauacacuucauguacaaagggaucaagcauuacuaaucuaguguuagcuuuugcucucugagcuaugcagaaguggaauauaugaauuuguggcuucauauuaaauaagugcguacauguacaugcaggauagcuauagucucacuugcuuagaauguuuuuacauuacaggcacuacauggaauuuuagcauauugcauauuuuuugaaaugacuuuagucuuuguaaugcccauuuuaauuacuuaaugcaucccaacaccuauuugaggguuaauuuaauuguaauuuugguucugaaaugagagcaugauagacaaaacaaauuaaaaaccaaauucuacuugugccuacuuugugaugucauuaucugcacaucaucuuuagcuuugcaagauguggaaauaaaauacaucagcccauuuucucucaauacucuuaaguagcucugaacauauaaaaguuccuaaaagaaaguuuuguauuuguuuuugccuugcuuuuugaugccaaguuaagacaggucauauauauauuaauuuuaaucaacgcccauauuacuaaauuuuucaauacauauucaucucuuuguuguaugauucauaauucuuuaucgauuauuuuuugauauaccuuugagaucuuuuaaaaugauauguuuuaccuguguuuggcugcugaauuuuuauauuaguaauuauauuuaaauuauaaauuaaaaaauacggaauauguuaagcugucuuuaaauuaauauuggaaguauaccuuuuuagaagauuauugcaaaauuugcuccucaguucugcaaacuuagggaaguuuuagaaaauaauuuacaaguagucaguaaguaguuacacauucaaggauugaaaaauaugaaauacuauuuucuguagcuuauaaaccaacacuaagagauguuucuccuuuguauuuauaaugcauuugaauuacauucuuuggauguaugaugugguaaauuacuguaagaaacucacugucaucuaaaccucaauuauaauaaacuauuuuacucuaucccaucacuguuuauucuauuuuuaaagucccguuuuuaagaaaacuugugcuuuugaaggaaugcccucauuauuuauaacauauuuugcuuuuucuuuuuacuuugauaagcuuuaagaaagcugccaguaagaugauuuuaggucauugguaaaaauaauaauguacacauuuuauguguaaauauguguacacaaucuugcaccuucacugugucuaacauucagcuuuuuaguguuauacauauuuuuauucaacauuacacauauuuguguacauuuaguguuacacauauuuguauuuaguguuacauguauuuguguacauuuauguacaucauguacuuuuuacucccagaauaauucaguauaucacuguuagcacauaauuauggacauacauauucuucucacuuccugaacgauucaguguguccuuggcaauacuaacacuuuaaaaaugagaguaauaaugauuagagcuggagaacuggggguagauaguaguauuagcagguuucccuccuuuuaauuuuucccauuuucaguuccuucuuuaaaagagagauguauauauaucugaacagaagggggacuaggauacuguauaauccaugauaacauaaggaacgguugcugcauauggcuuuauuuauauaucucugacauagaaaacuuugaccccuuugccuguuguacuugggaauuuuagauaaaccccacuggggucacacucaucaguuccggcuuugcgugacucaaggcauucucuagcuucuggugcgcuacugugcuguuuuccuucaggaguggaagguccuguaaguucauuuggcauuuggaagcacaacuagauuucuuccuuuuugaaaauccucugacuggguuacagaagaguaagcagagaucaugggcagcaugaugucguugauuuuaggaugcuaaagaaaauuaugcugagaccaagcaugcuuccucuggcuuauucugcccugcuuuaucaucauuuuuuucuuuuuuucaacuuccuaccccucuucccccuacacuguuuggggucuaauauuuuaguuucuggaggaguaaggauuugccuucucaguggaaaaauguguaagcugcaggauuuuuaccuaccuuucuuuauaacuuuuccauucuggggacagugucuaagaagaggaaaaagcuuacauacuuuauuuuauuuuauuuuauuguuugcuauugaguaggaguuugcuauuccauuucuauguggaaaugcguugcauggaauuaaauaaaguuguauaauuuugaaacaauuauaagcaccaacugugacauaguucuggcuuuuaaaaaaagucaauuuuaguuaugcaguacuuccaccaaacucucuauuccaaguuuauaaaugugaauuugaccauucgaccauggaugaugcuugaaagucauguuuucuggauuuagggcagaagaauacuugaaagauucucaccaucaguauguuuuagauucccaagagguacaaugccaagugucauguuaucaacucuuugaggucuacaguaaggaguuuacuuguuucugguagcuuauaaauucaauaacaucagucacaggcuucuuaacguauuuaugaguugagcuaguguaguucaauaaaugauuguacuuccaucaagucgagggaguaacgcaaacuagaauaguagccaucuauuaaggauaguucugagguuuggaauuuguaacugauuuuuaggagcuacgacaugaauaucauaucagguagaaauacucagagugaucaccuuuuaugaaaguuaguucuaucuuucaugucuaggaaaauauaacagugaauguuugcuuuuuguauguuuugucuccaagcagaggaaacugacaguuuuauguuuuaagugccgaaaguuguuuuuggcuaggcaguuccagaguuaaucacugggauguuaacuugaauuuuugucuuuaaaauguuuuagauuuuuaaaacgaaauaugcuuccauuauuuccaaacugacaccuuguguucuggauuaguuuuuagagaaauguuuuccaaauucucuuggauuacuugaaguccauugauuuugaaauauuuaguuuaguuuuuuucuuuuaaagcuuaucagaaaguagaggaaguacuuuaucuuuucgggguuuucuuauuccagaaaccuuguuauugccuguaaaaugcaaaugaauuuugcacuuauuuuguuuuauuuucucuuguguuuucagaaauguuuugaugcaucagaaauugagagaucagugauuucaguucuccugucacaccuuuuuaugauaaaauauuuuggucauuucuaaggaguaguuagagggaaauccuuucauaaaucauuuucacuucaaaaaaacagugauguuggaaaaucauauaguauucuuugugauuaguugaaaauuaugaaugguguaaaauaauaugacauuuaauuguuucucauuuagacaugaugcauuuuauaucucaaaauuugaugggaggaaaaagaaaaaaaagaacucacaacuuuuaccagguuugaaacuagcuuaagauaguucuguggaauucuccaaaagugauaagaaaauuuaaaauacugcccagacacaggguuaaaaauuaaaucuguauguagaguggagacuuuaaucugacauauuuuaauguaaagacauuuuagaauaaagaaagcuuucucugguuuugucggcuguuuuuguuuuucgacugcuuugcaugagacgaucggcauucuuaaauuauaauuauguguaaaaacaaauaagcugcuacuguaaaaaguaacagcucugcacauauaucuugaauacuacuagaaaacauuuucauuagaggaauaaaugcauuaggcccuaaauaaauuuaagauaccaaauugcaaacuuaguaucucuaauacauuacccaugcuagucccugcaaaguggaauugauucugagagagcucauuauuuccguugcuaguagaguguauuuaacaauauuuuggugucuccaccgguagaaauguggacauuucaaccagcuauccccuuguuugguuccugugaugucaggcaaacauuuugccaaaauguuugguccgauguaaucacaucgguguuguguaauuaagauaaugugcugauuuugaaucuuguuaacguguuauuuugaaaguguaauuuuaaaaauuugcccauuuggaauacaauagaagaggcaggaugauguuuuuagauuuaauucaaagccucuauguacagauaaauuaugaaaaguucaguagcucuuuucaucuuuuccuaauaugggagaagguggggguuuauuuucauaaacaccauuguaaaaauaauugaugaaauguuuuuugacaaaagaucauguacauauauauuaacuuucugagcuaacagaauguacauuuuauuucauuagguuacauuaauaaaaccauguacaaaaacauacaaauggaagaauagaugaaaucaccucccuggaaucagauguaggguaaaugguguagucucugagaugacucucuuaguucugugauuucaccauaagagcuggcccccaucuauucugcuuuggacacauugugccaaaguguacaauguucagcuucccacaaaaggagaaaauacggguuuaggcuuaagauucuucuaacauucuguuauggagaaauagaccuuggccaaggaaacacuucuuuucucaaugauggaacuuucuucagcuggucagucuaaaaucugccauucaaguuugguuuuacuucuuuguuuuucuuuacuucagguauaucaaagugaacauugggucauguuuuauucugagugacagaacggacuugagcuacuauccauucuagcaugaucuuauuuuacaaacaagaaaacugaagauaaaagugacuuccccccacuugguuaaaggacugaacuagaacuuggguccguucaccauccucauucauaugugaaacacuaggugauuuugauguuugcugaggaaauuugcccacuguuuaagauucauuagucuuuauuuuuccuuuugcacauggauaugagaauagaauuaaaaugucauuuauuaggaugcagugagaaauugaugaucauaaugaaucaguugauauauucacauuauuucuuuaucaguacuuuagauaugggcaucaaauguuuagaagcuaucacagaaaguuaaagaauuacugugaaaaaucuaggcuuaaugcuuuuuucagacaccuuagcaauaguaauguuggauucauuuagauaaaaucuaauugguacugaaaaacugcuuaugaaaauggucacuaauaagaagcuaguuuguauuacuuuucccuuuagcuuaaagcagcuuuaacauuuaucuauauagagaguaguauuuuuaaaaauaguccauuugaauuaaggauauuuuuaucuuccaugaaauggauguuucuuuauucauaacagucauaguucccuuggcagguugaaaaacuguagauggcaucugugagauuaggcuugaaaugugcaauuaguuauuaaaaucuggcuggaaaaaccauaagugguguuuuacauaaacuccucagcauuuauaaaaaacuaaugaaagaaaaauaaaagaaccucauuuauuuuaaauacuuuccuuaugaauccugucuuuugaaugauaaauuucaacuucaaauguagugaaaauaauuuaaaauauacauuuaaugccucuauuuuucuuuuaaauuucucaacuuuccauuucuagccaugacuucacaguacaauauggaugccauuuauguuuauugauuauaguuaagcuaauuuuaaucauacuuuguuggaguggaaauacaggaauauuucucugucuucuuagacuucugagguauuuuacuuaaaucccuuguuucuuaucuuucaaaccuaauaguuauauuguauaguccaaagggugaaugcccacauaagugaaauucacacauuacaaccccaaugcuauugucauuuucaccucuggauuuuaaagaauugugguaaauaccaugcagaaagauguugaaccuaagacagcccccaagcucuuucagagcauagcuccagaagugucuuugaaaugcuggaggagguggaggaggaggugugucaggcccuggaaaccgcugggcugguccagggucuguauuugaaccccguucaguucaucuugagucgcagggugaagaagacauuguacuuccauuugcauggauuuuccgcucugucuuuuagccagaaggcagccuugucuuuuuuguuuuguuuuguuuucuuuuuugguuguuuuguuucuuuaauguuucuuucaggugaaaagccuuuuauaaauaucuuguaaauaguuauuccuuuaaaugaaacaguuugcugguggaaaauaaucuuacucauuccgucagauauaaucaauuaaaucagaaaacuauagaaugaucuuugacauuaaaaagcaauuuuaagauggguuaaggaacuauuuugacuaguaugcugaucaucccacguaaaaucucuuucuugguguggugagcauacuauaugaagaaaggcugaaaacuuccauuauuauuacauaaucaucuguuuuuuuccuccuuguccuguggcuacuaucucuauauagcaaaauuuauuuuucacccagacugugaauuauaacuuaccauucauuguauaccuuauagaaccauaggaaacccuaucagugcuuaugagccuuaguuuuucuuaaugauuuuguuaauguuauuuauuuuuuacauaauucucccccuguauguaaaauaucucguuuucuucuuugacuuugagagauuggaaccuuuccauguacucuuggcauugcagaucaaaauaaggcaaaauagcucuuauucugggcuuuguuuaucagaaaacaccguuuuuuguugguuuuuauaacaggugauauccagauaagguuuaaauaagaugaguugcuguauuuuaauguuuauuuccaccucuuaagggauuugcccuccugauaaaucaguauacacuuaacuguauuuuaauuccccugaaucacaacuaugcuaauguagucaccuauuuuggaaaacuccuuuucagacauucuuuaaacuauuuuauacuugaccucaugaggcauauuugugaacacagacuaucguggauauuuuauagaagcuaauuaaauagcauuaucuucuggcuauuuggauuauaauccaguuguagauugauuacggaccauucuuggaaucuaggaaaaguccaaaugcaauucuguagcuuauacauggcuaaugaagcugagagauagauuagguuuuaagcaagggauggauuuuagguaacaacaaauauugaauauggcuccuuugaaaguuuagaacaagacaagguaaaacaaaacaaauggcuacuuuuuauuuauuuccagauggauuucaacuugcaggugacauggcauaaagucaaaacguugcuuguugagauuuauuaauuagaauguuuuuaagucagauacggaguuuguucuguuucagauaaaagagaaaccuacucagacauaaaaauaaccucagaguggagaaaauauugaauccccaaaucuggguuucauuucaugugaaucuccauuucucaacuaagcgauaucugccaaggcgccucuguuuguugacauugcuguauugaagucgccaguagccucauggaagccaagccccaguggucuuuccaucugacugcaucucucacgugaauuggaugcugucagccauucucuuggguaucucuucuggcuuggcuucuaggcacugcaucucugccacacuuguucuagucuaucauugaauguucucuuaaucuaugcacuuuucuuggaggguuuuaugcuuuuagguuuuuauccaaaugaaauaacuucugagccuucaccucuagaccuaacuugguucugaguucccauaucaguggccuucagccuccguaaguacuugcuuuuaaacuugucuaucauccuuaauuuggcauucaggacccuucaguuugcccccaauuuaccaguuccaaauguacuacaucaugugucuauccuuacuauagugcuuucuaguccuagaacauucucacaccgacuuuuguucauauucuucccuccuuaugaaaugccuucuacgcaaccuuaacuacagggauucuaucuguuccucggcauguucacuucuguauucuucuuccugaaacgcucuaccuccgcucauuuagguuaaaacauccccgccuugugcuccuguuuauguguggcuuuagcauagcucauaccagaagcuaccgggcaucaugaaccugaggagagugagagcauacguaauucauuuuuguucccuuuacaaaugacuuggaugcaguaguucucaaaaguguugcauuaaauaggaacauaggggaagaacacuuuggcuggcaacauagacuuucagguacugagaaaauugugaaauugguuugucagguuucagaggaaaauaaagauuaucugguauugcauaaguucuagauguuucuugauguuugcccuaauauaucguuccuaagguaggauaccacugguugcaacggaguauguuguauuuugcagugugcuugcaaauccugccuuuuaucgauuaaugucauuuagcgaagugggacagugucagugaaacuaaggcaaaggggaagccugaauucauuugaaaaguauaaaaaaaggagaacacaggcagccuuguacuuuacugauauuauaugugagacacuaugaacuaaucagagaugcaagaugauacaugguguguccuuaauugaggauaacaguguuaggcucuaaggucaugagucagaaaugugccuuuuuaacguccauguuuugaauguucucaggcccaaagguuguguugugauguuugaggacaauggcuuaugucuuggcuucaggaugaaaguuacuuguaagugggcccaaugcuugcaugcugagggggcaagggugauuuagagucaggagaucuaacaugaauauugaugaguaggguuaggagcugagcacaaccauagguaauguugcuuugagaugcccagguuuauggcagcaagaggauauuggauuccucuuugcucaaauauuuuuaauauucacguuucccucagugauagccaaucaagugauaacugaauaauagcugcugagacguuuuucauguuggaacaacaaugccucugagauuucuuugaauguuugauuuuuacuaaucacuuuuaauuucaucuuaaaagccugggaacaauuuugaaguuuaagaacuuuuuuuuuuaacuuaaaagaauuauuuuaucugacaauugggaagucccuuugauuuaacauuuaacucuguuaagcaccuaaauauuacuuuaaacagcucuggaaaauuaagcccugcuauuauuguacauucccaaucucuauggacaugggaccaugaaggagaaaucaaggagaucuauuuaaugaauuucuuugcuucuaggacaguucauuacuuguaggacuugcacuuaucuaugccuucuuuaaaaacaaaacauuccaaagcuuccuagaaaccuuagcuaauugcauuauaccaacaugcuuuucugaugucaccuuaugucuguaagcaacuuuacaaauccuuugaaagagauaguuggauuuuuaaaaguaauaucugcuuggauuuugcaaauuaagccacaguagaaacaguuucacuguagaguacaugcuaguuaauaaguagggguuuuuaaaauccucuguacuuuuccacaacugaaagggugcauacuuuugguugaaagugaguaggcgaaauuuagaccugcuguucugguagcccuaguggccauuucauaaucccugauaugauuguccagcucuccuguuugcuaaaugcagaaauagaggaaggaaauggauguuuuggcuccauuaaaauguuccuuaucagacuguauguaggaguggaugcuguugaagaugccucuauugccagcuguacagcaugugugcugggcuaguuuccuggcugcuaaagcugcguggugcccuuuaaugaugggaaggaggacauuaaauguguugggcuuaguguuuucacuugugaacaucagggagcagagggcaugcaaacuuugcccaaaggcuggacacgguuugcauagaaaugagcugcguguaguaauaacugacuugguagaugcgcagcuaagcacugauuacuaaguaaaagugagugcaaccucaggccauaggugagcuagguugaccagggaaaggcugcguuccaagagguuugucuuccauuggggccgccuuaaaaugcugauccugauucacacugguugagcagugugcuguauguugucuucacuugagauagaaacugcugucauuuuuauuuuauagaauggagagaacugggucucaggaaaguauaauaaauugccuaggcuacaacagguagcaaguagcagagucaggauuucaguccaggcagccuggcccuaagagcugaggcucccucuacuuuguuucuuaucuggugggugaacaagauuugaguugcuguaucuuccaagguaguauuauaaugguauuucaaagacuagcugacuuuuuaauguuaacaguguuccaauuugcuuucuccuuaggcccuaauucauugucagagauaaggccaucaccuuuauauaugagacauuuaaacaaauguuuuuaguaauaauucaggaaacauacaaccgguauucuuucuguagcgauaucugcagucucuuguuauaaaaagaacucuauuaguuuaaguaacugucucuucuuggccccauuacaguaaaaagucugugaucagcacccucuuggaaggggaaguuguugaaugacagggaugugguacuguccugauaauccuauggcuuuguauuucuuaguuuauuuauacuccuggguaacuaccccugcuccacauggaguauugacagcuuugaaucugagguagcuuaugugugcuacaaagacaaaaaagaaaaaaaaaaagaaagcgugguuuggguuagacuuaaaaaaguacuuucaucaguuauuauccagcgugucuguuagauuuuuaaguaauuuauauuuuaugaaagagcuuuaaagacgcagugugcuuuaguggauaguguagcgagagaaauaaaauaauaauaauaagggacauuuucuuuaaaaaaauuuuuccuuuuguuuuuaagaagaaaaaagaaucagaacugcagaucaggaacagaaauagcauuccauuuucuuuucacggauucuggagcagcuacggugagagugaguuggcucagucugggaaggaggcugcugucugcggcccugccuaggcggcagcggcgacacaacaggagcugcgugugugucgcuggcguucgcucucgcaggagccccgggccugcggccgccaccacgcgugcucggcgcccgggcugugggcguguuaucgcaggaaguccugcggaagcaguugugugcgcccguucccuccgguuaccucucucauccucggcugcugcgcggugccugcagccucccucuccuccucccucuccagcgcugccugcccugccagcugcguggaggccgccuccugcccgcuucuucccacucccucugcccugucgcgucgcauccccuggccagccugcccuucuccccacuucccaaauuggcuuccucucuccauaaacucucuuuccucuugucuucucuuuugcuuccucuuugcugccaccccuccuugauuugacgcucugauuuccucuugccagaucccaaauuggguucaucagcagcuacucauccuuaaaucuuauucaccugugaucauugggcaaacuguaagaggcaugagauuaaugcaaaaaagggaguuccuuacuaugggaggaaaucucuggcuaucaaaaagucaugcuuuuuuuuuugucacauauuaaaauuaagcacuaauguaaauacaaaaaaauuuaaaaugauggcauagguuauuaaugaguccaggaauaaggcaaagaaggacaaucugaaaaaauaaucucaaaugaauauaacaaaauugcccauuuuuuauggagauaacuaaaauugugauaaaguacuagauuuuauuaaugaaaauauuauuagucuuuaaguuagucauguacuuugucauauagcguuuucaaggagcugcuuaaaguguuucugauauuuugaaguauauuuacuuacacaaacauucuugaguagauggaagugugugucucaugcauucucaaucagaaacuauaaauaaagucacuuaaucaaaauuuaccuuauguaauaguuucaaaagcacaugaagccuuuuggagugacuaaggcuauauauguauauaaggcuacuguauuuuuagcauucugggaacugaggccuuuauguuuuucuuaaauuaugaacuuuaagacaguagcuauacguggaucccuaucaaguuuuugccuucuuuacaucaucaagcuuauuuuuaaauuaauucuuguuacggacaugcuuuuuauacccucuguauuaauuuccuuuucuagaaguccauauuaguaaggccauaucaugaaaauuaguauuuuuaguagggcuguucugaaauuuuuccacaagagauauuuugcaaugacugagcuauauugauucauauaauuuguauccaacugcuucauuuugccuugagauuuccaguguaccuaauauuagguaaagaaaauaguugauauaugacuggaugugagguggccauuuuaacuuguaggugacaggauuuaucucuugauuucuucguuaauuuuaaaauaaauaaacaaaaaacaacauaaggaaguuuagauccuucuuuuuaauuuguaacacuucaacuucuaguauugcuuucuguaggggagaauuuuucaguugauaacaugaguugauuucauaaguuauaguauuuaaaacuagagauguuuugucacaaaaaaguugucccuuuaauauaugauuuagcacggcaacucuuuuuaaaguaauauguuuaagagaaaaccaugaccuuaugauaaaaauaauacuaaaccaauuauuaauaacuacaguuugccgucaaacgucuuagcuaaauaauuaccuuauuagaacaaagguauugaaagcacagcaccagaaacacuggcuuuaauauucaaguaauaaagacuuuagguccaccauauauuuuucucauggcuggaggagcaaguccuagaguauggggggcauacuuauuacuucaguugucauaaauguggaucacaguauuuucuaaacuuuuuguuuuauuuugcauuuuucuauaauuugagcacuuugaccucuuuucaaguuuauuuguucuccagauauguacaauacaaguuaaaagaaaguucagucaucacagugccuuuugggacaugugauugucuggaauagacuucuguccagcuaugguuagaagucccauagguuguagcuauguuuuccuuuuugugaaguggcucuguuggaauaaaaccagucuuaaaguaauucuauaauuucucuagaaugcagucuucucacccauaggcugugaguaguaguaccugggcacagguuuuggggggaagaaucaguuuagauaaaacauguaaaacagguuuggugaaugucaaacgauugaauauuuauuucuauaaauaaugauaaugauuguucuguuucuaaucuuuguaauuucugugugucauuaacuaugggagugcuuagacuauucaaaauaguauuucuaaggccuuauuuuauuuuuaauuuuaacaauuauauuuaggauauuuacggacaggaacaaacugagcauucuagccgucagcuauuguagaaagaguggcauuauauuaucccaaaaggcuagcucagugucauccuuugguagaauacaugccuuaaauucaaaagcucuguuauguuugaauuucaguucuauaagcuuugguauucaauagugccgaguucaaggucuaaauuggaaaaacuugcaagaaguauuuuugcauuguuuuuucacauuguacaucuuugccuuguucuuugggccuuuaaugacaugugccaucauuuuuuaaaaauauuuguauuaguaccuaauuuuaauacaugauuuaaaaaauaugacuuuuugauacccagggauuuccucuuguaguaacuuuuuugcauuaauuucaugaaauuuuuuccucuuccucaaaaugagcacacaauuccucuucaaaguuaaugacugucuuauuuuucaguagguuguuuuaauuuugaauaccucagaaccuuucuugagggguaguauuuuagagauaauguuuugugguucucacuggauauuuuagaaguuuuauuuugauuauguggaauauauccuacaugaucauaagcacuucguuaauaaaaaugguuuguuauuacugagaucacccaguuuuucggcaggagaauaauaaauagaaguugugugauuccauagccacuguaggguguacucuagagcagagugauucuggguuauaaccacauauccuaaauuucaagcuaauaguguguaugugugugcguguguauauauauguaauuaccucguuuuauugcacuuuccauuuauuacacuccacagauguuaccuuuuuuauaaauaaagauuuguggcaacccugugucaagcaaaucuaucagcaccauuuuuuucaaaaauauguguuuaccuuaugucucuuugucacauuuggaaaauuccugcuauauuucagaccuuuucauuguuauuauauuauaucugaguugguggucugugaucuuugaugucacuauuguuauuguuuuggggagccaugaaugguacccacguaagauggcaaacuuaauugauaaauguguuuguuuugagugcuccacugucuggcuguucccuugucucucuggugcucguugguccucccuauucccugagacauaaugauuuugaaauucaaccuauuaauaacccuacaaugaccucuaaguguuaaagugaaaagaaggguuucaugucucucacuuuaaauugaaagcuagaaaugauuaugcuuagugaggaaggcaugcugaaaaagagagaagccaaaaacuaggccucuugugccacauggccagguugugaaugcaaaggaaaagugcuugaaggaaauuaaaagugccacucuguugaacacacacaugauaagaaagcaaaaacagccuuauugcugauauggagaaaguuuuagugguuggguagaagaucaagccagccacgacauucccucagggcacagccuaauccagagcaaggcccucuguuugauucggugaaagcugagagagagauaaagaaguugcagaagaaacguuugaagcuagcagagguugguucauggguuuuaaagagauaugucacauccauaacauaaaaguacaaggugaagcagcaagugaugaugaagaagcugcagcacauuauccagaagaucuaguuaagaucagugaugaaaguggcuacacuaaacaacagauuuucaguggagacaaaggagcacauucaaaggacaggcugacuaguuaggggcuaaugcagcuggugacuugaaguagaauccauugcucauuuagcauuccaaagauucugggacccuuaauaauuaugcuaaaucuacucuguggagcugugcucuauaaaaggaacagcaaagccugaaggauagcacauuuguuuacaguaugguuuacugaauaguugaagugcacuguugagaccuacuacuuggaaaaagauuccuuuaaaaguauuacugcucacugacaaugcacgcagucaccccagaagcucugauggagauguacaaagagaugaauguuauguucaugccugcuaacacaacauccuuucagcaguccuuggaucaaggagaaauuucaaaauucaagucauuauuuaagacauacauuucauaaagcuauaccugccauagugauuccucugguggaucuggacaaagugaguugaaaaccuucuggaaaggauacaucauuugagauaccauuaagaacauucaugauucaugggaggaugucaaaacaucaacauuagcagaaguuuggaagaaguugauuccagcucucauggaugacuuggaaggcuucaagacuuuaguggaggaaguaagugcagaugugguagaaauagcaagagaacuagaauuagaaguggagccugaagauaugacugaauugcugcaaucuccugauaaaacuggaauggaugagguguugcuuuuucuuaaagauaagcaaagaaagugguuucuugagauggaagcuauuccugguggaaaugcugugaacauugucaaaaugacaaaagauuuagaauauuccaucaacuuaguugauaaagcagcauuaaaguuggagaugauugacuccaauuuugaaagaaguucuagcguggguaaaaugcuaucaaguggcauugcaugcuacaaacaaaucauucaugaaagaagagucaguugaugugggaagcuucauuguugccuuauuuuaagaaauugccauagacacccccagcuucagcaaagaccuccacugagcagcuaucaacaaugaggcaagaccagcaaaaagauuaccaauugcucaagacucaggugacuguuaguauuuuuuaguaauaaagaauguuuuuaacuaaguguauuuuuuaaacauaauacuauugcccacuuaauagaccauuguguaauguaaauguagcuuuuauaugcacugggaaaccaaaauauucuugugacuugcuuuauugcaauauucacuuuauuuuaguagucucaaacugaaucuguaguaucuccgagguguaguaucuccgagguguuauauauauauaacguuaaauauauauauuuauauauauauauauuuuuuuucacgaaguaagcaugcuuuuauuaucagauaaaaacauuaaccaaauaugucuuuuuggggaauaauaaaaaugauuaaacuuacuaauguuuuugcugggguuagauuaucaaagcauuuuuuuaaacacugacacagucauucauauuuucuaggagaaauuaccaugcaccuuuggagucauuuuuugauagaaaaggugucccuaauugagaguaccaauuuuaaauuuuuguuggcaggugcugcuauugaauuguauuuggauuauaaaauucacaaguuucauaauuggaggcuuauggaguguauugaugagaugauuagaauuacucuuuugguuauguaaguuuuuaaauaauggaagaaguucuagaaaucuuacaaaaauuuccaaaauaagacuuucagaggcugugaaugauacugauuuucugucaucuuugucauuuaaacacaguucuguauuauuuuuuugcucagcaauaaaggagucaguagguccaucuguguguuucuguuggauucauaucggauauaugacuauuauguauguagugucuugaauguguauguguguauauauauauauacacacagguuucuuuucuuuuuuuuuucuuuuuuugagauagggucuugcuguguugcccaggcugguguccuguggugcgaucauagcucucuguagccuugaacucuugggcgcaagggcucuuccagccucagccuccuaaauagcugggacuacaggcacaagccaucaugccuuugcuaauuuucuaauuuuuuguaaagacggagucuugcuguauuuuccaggcugguccugaacuccuggccucaaggaauucuucccaucucagucucccaaagugcugggauuacacauauauuuuagacuuuggaaauuaggaaaacugaaaauggaguuuuguuuuguuuuguuuuguuuuguuuucgagacggagacucauucugucacucaggcuggagugcaauggugcaaucuuggcucauugcaaccuccgccucccagguucaagugauucuccugccuuagccucccgaguagcugagacuacaggcaugcgccaccaugcucagcuaauuuuuuguacuuuaguagagaugggguuucaccauguuggccagggugaucucgaacuccugaccucaggugauccaccugcccuggccucccaaaugaaaauggaguuuucauuuccauauaucacaguuguuuuucaauauaggucuucagugacuggaagccauugcuauaggcugguaauuugauaacccauuuuugaaauguauuuauugagcucauuguaauucaguaugccucuggugaaaggcgugggaugguauagguugaaagaauaaucugugguuguucccuacagagacgcugcugccccuuuuugggcagucaucuuuaaccuggcacccacuaguguauuugcuaaaauggaauauuccaaaauuuaaaugaugucacauuugaaagcaaugccaagaaacaaugcggcaguuucuaaauuuugugaagcuaaaaucccugguuacaagaaagaguacaugucacagaugaguaguuaguaaugacuucaguuuagcaggaaaagagcaauucccauaugcugauucuagucucauaacaaagaauguuauagaaagauugcacaguauuuaacaagcugugaguuaaugugacagugucgguguaucuaguuccagaaggauaaucacuuuaccauauuucuucaaaaauauuuuaaguuauauuccaaaacagaaaaccagauacauaugaauccagacuguucccugcaacaccuccccacccccaaguuagguaguaaaaucagguuuaagcaauugaauugcuuccgaccugcuggcugccaaauaccugaauaaauguagaaguuccauugucagacucugaaccucagaggcuuaccuguuauauaagggagaguggguauaaaugagaguguuacaucuugaacuguaauuauccaaaacuuaguuuucagcgcuucaguuuaccucuaaccaagagccucuccuaauuugaacauagacuacgcccuucaacacuuacggauacguuaggaguugagaaaauuagguaaaguuguauugcuuucaguccuuuggaacacauacuggauacaggcauugguacuguagguguguuaguuaccagcaauucauuuccaggguuuuucccaaagaccugcuguuuuaugcguguucauauuaguacuaugauuugcuuauuccugugaacacgaacaacacugacagauaacaguuuugaacaguagaccugugucuuuuaaaagcuuaaaacuccaugcacaucauuuugucguugcaaagacuucuaaaggcaggcauggggaggcauuguggaguagggagaggauauuauguccuucagugauuuaaggaaaugcauguuuuccaucaugaaagaaaagauaaucauuaucaaauucagaggagauuguuuuaucauucccauaaugaaccugugucucuuuuaccaauuaacauauagauggauauuaggagaaaccagguucagguagaaagagguacauaaaauuaauaauccaucacgaggaauuucugcaaagugccuuuuauagagaauuuuuuuucuuggaaauuuuugaaauuaucaaguauaaaguugaugcuuaaauuauguuuuaaucuuucuuaagacuuucucuggaugcagauuauggaauuaagguguuuugauacugugaaaguauguguugcuaauacuguaacauacuguacauuuacuauacugucaauaauauauguaacuacuacugaguauugacuacuuuaagaaguuaaggucucucaguuugucacaagagacauuagucuuauaucaaggguuuaccucaugaagugacauaggcaggcgacugacauuccacuaccaguauuagacuuuuuauuuauuuauuuaauuuuugagauagggucucacucuguuccccaagcuggagugcaguggcacgaucucagcucacugcgaccucugccucccaagcucaagcaauccuccugccucagccucuggaguaccuggaacuacaggcaugugccaccacgccugguuaauuuuuuuuuuuuuuguagagauuggguuucaccaugucacccaggcugguuuccaacuccuggacucaagugguccaccgacuuggccuuccaaagugcugggauuacaggcgugaaccaccacgccuggccauuauuugauuuauacuguauuuuuaguguacaagcuguuuaagagaaacauugaucuuaaagcauaagagucaaugauuuugaaaaaugaaaacaagggaaaucuggucaaauuugcuuuuauccuuccacccaaaauuguuuggcugccugcauuuuguaaucauauagugauugacuguuggacaucguggcucacaccuguaaucccagcacucuggaaggccaagguggcaggauggcuugagccuuggaguucgagaccagccugugcaacacagggagaccucaucucuacaaaaauauauaaaauucaauuaacccagaaugguaguacaugccuguugucccagauacuugggaggcugaagcaggagaauugcuugagucuggaaggucaaggcugcaaugagccaugaucaugccacugcacucuagcugggacaacagagcaagacccuguuucagaaauaaauaaauaaauaaaaucauauagugauugaauugaucugugcagaaaguaccucuuucucccaauggaugcuggcaucuucauucaguauauauagaguggccacuuugugugcuaccuguuagcaguuuauagucuaaugggggaaggauaggaggaauauaagaaauuauagcacauugcauuuacaaucuauuucaguauacauuaucuuauucauuuaauuuguacucucuuuucuguuuauucccuuuaaaaaaaacuuuguaaaauaggccaauuauacauauuacugugggaauuaagaaaguaaagaugugaguaagcucaaaaaaaaggguaaaaaccccgccaaaaccacuguugguuuugguuaaugugcuugcauaauccuuugaaucugugucuuuccugaguguauguguaaaacucuguguguaaguguguauauuucugucuguauccuguccaacuuuggcaaagggguaguuuugcccagauuugcuuuuggagcuaaaaggagaucucugcccacaccuuuucugugaggucuguuaccucacacuugagaacaaugucaauuuuuggggccuuaaaggcaguguuggcuucugcccaaagguaccuucaugaccuuaacacaaauucacaaaucaaccuauuuuauucauugcacucaugucuucgggcucuccacugcagagucuuaaaggaauuguuuuggaauggacacaaagauuacuaaccucuguggaaaaguacccugacuuuacagcguuccuacuucaaaaacaaacucugucuggauggcaagucauugggagacuugagugauuaccggggaguuuugguguaaaauggaauuuuagauuaaccuuuagcaccuaaaucugaggucugucaagucuccguuuuuauagaucugacuugaauuaaagagguguguuguguugaagccuuccuggcccuuauuuuaacuacugauuuacaugggguguauaguggggaucaucacugaguuuugaccaaguucugggaaagcucccugugggacugggaaaaucuggcucauuuuggaaaaccuaaauuuauguuuuuaaauaauuuggaaaaccugguaaaaugcuacagguauaagaacuuaagaauuauaauggaucaggauaaacggggcuagaauaaaacacuaaguacagucaggcagucaauggaaacaaacagaugggugucaagagcuaaguuagugaguugaucagcucuauuuuugucuuuucaauaaguuucaugaagcuuguucagcaaacaugaguaacuucaauaaguucaugcagcaaauauuuauuaagcagcaccuacucauuuaugggauacuguacuaaggugugauaauaucaauaugaaugacaacaaaagaacacuguccaggcaagaauacaaauaauguaacagauaaauaaaauauugauagucauaacuccaauauagcuauauaaagaugaucauagcacauaaauucuggaaaaauccaguaucauuaaugucuccauuaauguauaccagucaccccaucuuuuuaucugaaccugugcgauauuucugggguuuuaaaaauuccacuuccuuuuacgaucagaguugaagauuuguuuugaaacccaucacuuuucuucauuuucuaccuuucccuucuuccgucuacaugucacaccacaucuaguuuaguuuuccuaaucucuucuuuuuagaaacuucaaguggcuuccugcuuucuccaagugguccagccucaucaacugggauucaagauucugucuuauuaaccuuggcaaccacgucuuccaugugagccauuugguuuaaaccuagcuucuucucuguuucuugacauauguuaauauuguuagcaaccguuuguuucucuuacuccuguuugcuggaauccccuuuucuguccccuguagcugugcaauucuuacuucucucucaggauaaucuucacucucaucucuguuaacuguuuccucugccauugaccacguugguuauuuuauuaugaacgaaagaaauaauagaaauauuaauaaaagauagcaaacauuuaguacuuacugauuacuuuuuuguguguguuuuuuuuuugcuuuuuuuguuuuguuuuguuuuuuagauagagucucacucuguugcccaggcuggagugugguggugcugucucggcucacuguaacccccaccucccagguucaagcgauucuccugccucaggcucccaaguagcugagauuacaggcacccgccaccacacccagcuaauuuuuguauuuuugguagagaggguuucaccauguuggccaggcuggucuugaacuccuggccucaggcuauccuccugccucaggcucccaaaguguugggguuaaaggcgugagccaccacgcccagccaaguacuuaacugauuacuuucaagggaauuuacuguuuacacugcucauuuuggugcuaaaucaugucuccuccuguauuauuacugaaauguuuaaugugagccuuguuucuuuaacaaagguagauuauugcuucuuagagagcaauaauuuucucuucgaauuuaaauauaugcccaauaaauacauaauauaugaauaaauuaauugauuggauauuuuagaaguuugaaaugcccuugcccauaagaagaauguauguaugacauuugggguugcauugguacuuuauuuuccagccugauggacaagagugauuuuaaaaccaucaaugccucugcaucuguggcgcaguaaacaggaacccuauuggaaauuaaaugugucaucuugugcuucauagccagacuauuaagcuuuuaggaagagaucaauuuaaaauaaauuauauguauguacauauacauuaauauguaauauauagaauauaaugauuauauuuacaggguuauauuuaauuccugaugauaaaaaaaggacgauuggcauuaucuuaucagaaaaugaaaaaaugcaucaaaaucagacaauauuuuaaagaaaaaauuuaugucauuucaguaaugcuuuuuuacuugacauaauuauguaggaaaacuauccauaauccaguaguaaacauuauguaugaaaacuugaugugaacuuuugucaauacauaugauacauuauuaucuaauguuuucaggaaaacaaauuuucuacaacauuuauguguuaaucuuuuauuuccuggaauugaaaaauuuaaccaaacaccacagaaauugcuaauaccacugaacuugucucaguucccuuaagaagccacauucucucuucaucugggccuuucccaggucuccugccauuucuucuguuggaaucacucaauccucucuuuucaccuggccaguuuuugcuauccuuguuuguguucuuccuuuuuacccccagaaccccuuguuguuauaccaaacugggauuagucacugcucuuccuuguuuauuuauuucuuuucucuagguagacuauaagcucacucaggguaaguuucuucucugccuuguucacaguuguauccucagcaccuuacucaacacuuuacucaaugccugacacauaguuggcccucagaaacuauguugaaugaauaaauguuacgugaguuuugacuuaggagcaucaguuaucauaucacuuggucaguuugcaauauuugcccaaaaauaggauuuagugcaaaaugagugcugaugccagcagauaucuuugaccuugguuucuggggaaaaaaaaauucucauaucagcuuguuuggauaauugcuugcagaguuuccaugaaagggaagugguagaugcacaaauggauaaaguguaggacuuuuugacaggacuaacugcauucuaacuuauugcaucaaagacuauagcagucaucucucaagcaguauucuggucaucagaaaauauucuugaacagugcuaucuuuuaacugguuagcacucuccaaaguauuucaugugguuuuuucacuguucauacccuggacuacauggauuaccugccaggguucaucuauuauuuuagcuuaccuggacuacauuggugagacuucaugaaggagaauuccacuuuuauuucaguaaaccagggcaggauauuuugggaccuacaacaaccugucuuuucuuucuucuuuuuaucuuuuuuuuuuuuuuaaccuaagaagaugguaaacacuuaguaggcugcaauuuucuuucuuaaugacugucauaaugucucacauuuaauauaacuuguucuauuuugauguuaaaacagggcauucuuaauguuacaacaggauuaaaaguacuguuugguacucucaugauauguuaacucuuuuacgaagucauuuaaauaacaguauuguauuuucugaauagcacccugguuugcaggcucaauaaacaaguuaucuuuagcagguaugaagauggugauaauaccaccagauaccaguacuguuuaggugaaaucuguaguaauuugcuuuugaaauaaucagguaaaacuguuacuaugaaaugcuguuuugcaaaaaguucaaaagacuaauggaugugauuaacuuuaaguuauccuauagagugcuacuuuuucuuggguauuauguugcuucuuuaacaaacauccuuuucuuuccauguguaggcuuauuuccuguagagagcaguaaaacauguaaagcauuauucaugcuuugacuucuagaacauguaaagcauucauagauuggggaucagucaacuaauucuuacuuugcuuaaacccaaaguucucaagcuuguuuaggugacuguagucuuggacuuugugauucugucugagaaacuccguggaauaguguuaaauuaucauaucauacaaagauggggcaaauuaugugcaauaaaaugugauuguaucauaucuguguguaccuacaaaacaaagacuaaaugccacaugaaauaguuuuaaggaauaagauuuucaaguuuucuuagcacauuugugggcugccuuuuuuuuuguuguuguuguuuguuuugguuaguugcuaguacacauuagaagccauuugauacuagaagccaaagucuuaagaaaauauuaaccaggcauaaaguugaaaacugauggcauuguaccuauuaacuuauguuuuuuaugcaaaauaagaaaccacucaucauuauucuguuugugagaugggauaccucggucuacugauauuacauagauuuacagcaaccaccuuagaugaagguagaaucuagcacacacuucauguaaacacagcauuuauucagccuuauaaaaauauucagaauuuuagauacaugaauccucugaaaaaaccacaguauuguuuuauuugcucaucuguucccuccggucuucuuggguaagcagguuaccuuaacccccuuucaguuccaguuuccucauuugugaaauaggacuacuaaauaacuaucaggcuuuuggugaaaaccaacuggggaaauuacgugagccaguaagcaaauggcuggucauaauaaguacucaagaaauauuaguucucuuccaccuuuauguagcuugucuuugucauauaaucaagguagugcauccucauggaacauuuaauaucuacagaugugugucugugcuuguccuuccaccaccaccaccaccagcagaaucacauacagaguucuuauccucucuucuguuugccugucucugauuaucuucaccccugugagggugucuguugcuuucuucucuuguuuuugcccuucaucucucuuuucaaaccccucacccuuugaaaucccuuuuguucagaacgcuuucuuuucaauuucucuucucuuccuucuuuuaccaccuguuugccugcuggggcacauccuggcccuuucucccguacaauucagccugaggcgucaaugacccauuccacuccauuggauugcuugauuugcucaucaaaauaucgcagcucaaagguuucucuucauuauauuacuccaugcucucugcagagcaacugcuguuucacugaaaaaucgcacacacacucuuaaacuuuagcugaaaagugcacagaucuuaagucuguagcucaaugaauuauuacaaaacaaauacaccuguguaacuaucacucaugucaggaaauacaauauugccaguacucuagaagcccuuugugcuccuccuggucucuuucuucguccuccaggaaucagucacucuccugacugcuaaacacuuuagauaguucuacuuguuuuugaacuuuacacguguccauauacauugaaagcaugcauucguuugugucugccaugacacacucagcaucauguuuguaaaauucauucauguuguauguaguuuguucauuuguauuguaccauaguauucuguuguaugaacagguauuguauuuuauaaucauaugccacaacuuuaaaaaaucuauucuacugcugauacagauuuagcuuguuuccaguuugagaaauucaggaaguaauacugugagaauuggugugugugugugugcacguguguuuguguguguacgcgcauuuuaaaauuaaacuucugguuuuguguccuucugaauguuuuaaguuucuuggcgucuaauccagauguuugaggcuuuucuguauucuuuuuauguuccaggcuauucucuuaaaagauaaacuauuuauuuuuuauguauuaugcuacuuguauaguauauuuugaguuuuggaauguuggagaauacagaaugaaaaauuuguaaauaaaacauauguauauauaagugcauauauuuaugguaaacauuauauauuuaauaaaccuauuacauaccauaugauguucauguauaaaacauacauaaucauccaaauauacaaacaugcaaauucauuuuacugauuaugguacucuuauuauagaauuaucacuauauagagaaugugccacuuuuuaaugaacuuuccucuguguaaucagucuacagauauuuuugauguguaaaguuacacagacauuuauggaaucuaaaucaaaccaacauggcugugauuuaccauuuuaaaaaauaaauucaguaguucuuaugucucacgacuuguacauuucuugaucugugcccauggaccuagagcuaugauaucugauucuuuuuucagccgaaauaaggagaaaauuaaugccuugauuccuuggaugucgugauuugguuuguuauuauguuguugagacaacuuuagcauuuuucuagcuguuaguuuccugagccuauuuaauaucaagagauucagacuuuccuugaagacaaaagcaauauauagaaauuucuaagugugucaacauccauccauccauccauccauccauccauccauccauccauccaugcaucuaauaagaacgagugccuucugugucauaggccugucacugugaggaagggcauguuaguaucacuuggcuuuuuaaaaacuugcaugucccuugugccaauaugcuauuauacuugauuccucugcaauagucaccaucauagucugcuagugcugaugauggaaaugagccucagauguguugcaccuggaaaaaacuugagaucacugaugagauguagcuauuuauauauauugaauuauuuuauaucaauauuuugauuaguaucacauauaugaauggauagcuguuaauauuuugaauuaacaacaaugauaauauaaaucauaauauauuuucugguuugaagaguuucacagucuagagggguagccuaaaacauaaacacauaauucugugugaaguggcagguaccuugagagaagauaugcacaaggugccacaugacaguggagaagacuaaguuuugcuugugaaaauuguagagggcuuuguagaagugaauccauuuuagaggcauguaguuugguaauguuggugauguguuaggcauuaugaggcagauucgaaaguuaggauaaucugguacucugugagaauauugggaagauuguauauucauucacuugacguaacuauagaggcagacaaauauguuugauagcagccuuuguaacauggcgucuuguagauuguguucucuuguaaguuucuuaaaauguuaucacuuuuugcauugguuaacuguuguuaaagugauuaugagaaaugcauugggaaaccaaguggucuuuagauuccuucagacccaacuuguucaugugcuaggucugcaccuagacaagcgauuuaacuucuccaugucuuagcugcauuaucuguaaagugugaaugauaauaguacuuaaaggauuguucauccaaauuaaaaucaaaugagauaaugcacucuuggcacaguuccuggcucauauaauaagaacaugaaauauuuuuuauuagcuagaaauucagguuagaauauguaucaacacugaagaucauaggccuuaaaaaaaccuaccucugacuuuugguuucuuucaacauucaauuaaauucugaaagaacuauuuguaaaacaccugaaccuggaauuauauauguguauuucccuuacucuguuaugauagggguccacaacaagauugauggagaaacuaauaauuggggugcagauggugaaaaucuuuucuaaagguguguguguguguauggcuccguguauguuuagauagauucuuaaguuuauacugaauuugaaagugaagauugacgagauugccuauacaaaauacuuaacaagugagcuaauuucugcccgaauucuguagucuuacuccuguaugucacaucacuauucuuccucucauaugugaauguguaaaauagaggcugugugggauggguccagaaggaacuuguggucauccucucaggcuugaaucucaccacucuaucuggcuuuguguuuacaauuaauuuaaguuuaauuaccuguuucaguuuuacuuugacaucuaccuaaccuauuuuuugcuuuauuucuuucuuucugaucuuuuguuuuaaucuuuggggguaaaauaaugcaauaaugauaaaacaaaauucaaaagccuguaaagcuaugggaucugcuugggauuuucaagggugagauagggucuauaauagacauguguuuacugauugugaccccaggcauugguuuucuguccuucauuguuaggauagguggaucuggggacacagacugaguggaguggagaagaaaggauuuauuaauaaucagggaggagcaugugggauagaucugagguaucugcaagcauuugagaacuacugauuguaacuauaugaacugaagauggcucagugcaauccugggucuuuccacauuccauauuuaauuaaaggccuuugccauaucuugguuccuggcucaauuuuagucagauaaaauuuaaguuauuauaaaauaauaacaaauuuggcauauaagguuuuaaacugaucacgguagcuggacagcauuagcaacaauaguugaaaaaauagagcuucuuuaugcagugauaucuguauaaucuauuuagcucaaagauaacauugaguuuauauccacguauguuuaugaauguguaauuuggacaccugggauuuuauuguauguagauguuuuauccguucccuuuuuaaaauccaauguucuaucuguaaugcucugccacuacacauucuuucaaaaaaauucugauucuaaaucuuuaaugaugauaugccucaaucuucuuuuaacauagauagcucuucuggaaaaaaaacaaaaaaacaaaaacaaauccuucaaaacagcccucuucauaacaaaacaucuuagucuuuuugccaaguuagugaaggaauacugguuuuuuuuguuuuuuguuuuuuguuuuuuuccuuaacuacgcgugcuuuaaaaucucaguuaaauuucuuccuugagcauuacuuucuuagaguggccuuucccacuguguucaucagaacauuaguuuuguuggcuaaauggcacuaugugacauaaagccaaaugagauugggaaauuucagucuagauuggacacacgucacccucuccaaucccuaggacuucuuagagcuguaaacgcuaauguacauuguggaucucugggagggauauguauuauacaguuuccauuaaacuuaaucugaccaaggaaucuccuuucauuuucuuuuuuugaagcuaauauuaugggaagagucuagagacaagucuuggguuucuugucaucuaugcuuaaacaguuaccguauuaaaaucccaggcagagcuuagcuaaacuugcagugagcauggcagaauguucugaaauaccauaauauuuuuucagaaaagguucuuauaguugaagcuuucuaagccuguuacuuauccaacuccaaauuaugaacggauuauauguuuacuuuuuuugcccauauauaaagcuuuucauauccuagaagucaggaaaaaguuauuuaauuuuauuaugagaaguugcuuucaaguauauauauauuuuaagaucaguuuucuuuggaacauuucuccauacuuaacaaaagagagaaaaugacuccuguguguguguguguguaauuuguuuuugucagagggaaaaaugaugcuaauuagguuaaaauaaggaguuggcacuaaauagggugguagcuaaaccaaauuuuguauuuuguaccaaauuucuaaaucccuuuuguugcgugaauggauuagcugguucauuguaauguuuguguuaucuguuggauaugucuaugguuguccuuaguccauugguucucagaugggugcaggccauuuaaacugcucccugugguagaguaggagugagccuagugcuuugugaguuguuuccuaguuucaugaggaagaacuauugcauaugaaggcacaaaguuacuucccuucauuuuuagagauacacacacaugcacaugcacacauacagaguauauuacagguauaaguucucaguaugucuucauaacaucugguuuuaaucuuauauuaaauuuggcacuuuuaauacuacuaauaguaauaaaacuuacugaauauacuuggcuuacuggugcugugaagacagcgagcauucuaauugcacuauguuaucuuuaugguaagcaucuauuagauucacuauacuguauaugugugucaguuuaccaaauggauuugcagugauugacacagauuuauuaagggagaacaaagaaagcuguuaguuauauugguggauugaguuaauaauugagauuuucuuuucuauugauuaacagguaggaaaacagaaaaaagcaacauuaguacauaaaaauauuaaacuaccuuuacuauucaaugauaguuuucaccaaaugcuggcaacauagucaaagacauuccuacaaagcacagcacucguuauuuuuguuaugagugaaaaucuaauuuacauauaauaaaaugucaauucacaucauaaccaucaagauaaauagaaacauuuauacucuucgaugagcuacucuuuuugaauuuaagugcugugcuuggcucuuugcccagagaccaguugaaauagccuaaguuuaacagagaaguagggaugaaguugaaacugacuugugugcaaauguaaagucagauuggccuaugugaaucaacaguugucauugcagauauuuuaauuguguguguguguguuuugagaggaaaacaaaaggaaaaacuacuuuucugcagggaaacaaaugguaacauuucucaauuugcacagugaaauuaugaucuuauuccaaucagggauuuuaauacauuugccucucacugguuaugaaaggaaaaauaaucaauuccccuugccuuuugaggcuccaugagguauucuugcucuauuuuaguuucccuaguuagugaaauaggugcauucuuuuuauauauauacauguguccuacagugucauugugacuauagccuaaagucuuugaaaaaagaaaguuuuguaauuuucuuauaaaaguacagugguuaaugcauuuuuucuuuaacauguauuuggauauaugaagauucauuuaggcaaauaggacauuuauuacuuacuuaccacacuaucuccuuuuaccuagacaagugcauuugaaaugagauauuuaaaaucuagagaacauagcaagaugaaauaaaagccuaauaaaauguguuugggcuagcaucaaaaccuuugaaauaggauaucuaaauaaugugcauuuuaucucagagggcuuuugguuaguucuaguguccagaugacuauuaaugggcuuuugugcucugaagcauauguuaauagaaaugaucauuuuggauuaguuugaugugaauuaauaagagauuuauuugguggaaguuguuugaagguguugacauuuaaaacucaacaagauuuaagauguucaaaaauagcuuuaaaaauuugggaacagucaauucagagagagcaaauuaaauagaaauggauaggaaagaacaggaucugacauugaguuuacgaaguuugaagcaguuuauaaaaaaagcgaucuaccauugaaguauugccuuggaaucugaagaaauagaaaacaucuaaacuccuucagugauucuugaguuugugaauuggauaaacaauguucucuugcauuuuauaguucacuuaagcaaucugauuuugaucuguauauauggaguagacaggauucaaguguuuuuuuuuuuucccuaaaccaaugagcaaacacauauguucuuucaaaacugaacuguauacauuguucauauggaagcuaucuaguuugcucuaggcccaagauuugaccuuccuuuuauuuugcuaucacuugcuuaauucuuuaaauucuuuguggggacuuuugaucaaaagaaacauuuuuucuuucuuuuaaaaguuuuuuuaaaaauaaaagcuacaugaaauguguaauuaauaacucaguacucuuaugcugauguguauacaagcaagcauggaagaaaacauacuuuuuaaggcgaagaccaucgaugacuuuucuuuuuguguuaagcuuugauuucaaacaguugaaaaguuuuauaagcuggaaaaacaaaaagaaaaugucaucuggcauuacauauuaugaaaauaagaacuguuacuuauaauuaaaaauuaugcgcaacaagauuugaaacugagguccaauuacaggaucuugcccuccugauuuuuuagagucuuguucagaaugugaugugugugugucuguacauauauaugcacacacauauuuguuuaugaaauuauauuuagaaagauacucagaagugucaguuuuccuugaggaguuccuuauagucauuuucuuugcuuuuuaagcauaucuuucuuucuuaaauuaaugacaaauaauaaaauuaaagucaucuugcuuaguguguuuggcacauaacugagguuggauauauuuacugaaugaaugaauauugggggaagugagaaauugaggcaaagauaggcuucggugguauuuaaaccacccuuggcgccggugguuugcuguucuauagucuuucagugcaauugggcaaacuuuuuaaagguaaaauugaagugcuauuaaccggaacuauuguagagucacagaggugggggaauuuuagaaauaauuuauucaaauucccuuauuguacagguaaagauggaggcucagagaagcaaaaggacuugcccuugaucacacgagcaggugauuuaaaucagguguagaaacuggauaugcaauuuccauacgauuuuuacucauguuuugauucuuuacuuugcuuagggucaagauacuacaaagaauauagaauuuauagaauuuacaccucuuaccuucaaagaguuucucaucuaauggaaauaaauuuuaguucaccuguguugagcugaugcgugaucuaagcucuguuuuuaaauuacugugauaguugauuuauuuaguugaauaauuuauuugauuaucuauugcaagguuaguuggaguaaauaugucauuaaauguaugcauguauauauuuauauauaauauaugaaauauaacuaaaacacuagugguuaauuuacaguaucuagauaaugauagaaaacucaaaucccuuuugcugugaaggugcccucuugagaacaucagucagucuuuuacaggagaagauuuuuuuuucuuauguauuuaagcacuuuaaauagugagauaaaauaguuagaauuauuuuuaagcucuaaugcugauuauuucuacugcauaaaucugucuaaauuauacgguaacagaaauagugcacuccuauuuuuauaaaaguaaacacauuuucuaagaaagcaaagcauuuagauuuguuuuauuuagaaggaaauacgguuaauuaagaguagaaauuuaugauuuuuacagauggaaugucuuauaucucagcaaugaaaauuaauacaaauagaauauuuugggaaagcuacauauauuuuuaaccugccuaaauaucuuggcguauaauaugcauucucauuauaugggcuguucagguggagaauaauguaauguaggccugcucacuauuacauagccccagaggucaauuuuuaaucucacaauuaaauagaggacuuaaaauagcaauuuugagcuuugcuguucuccuuuaaauucuuuaccuccucuuucucaacuucacuuuuagcccaucaucuaaaauggcaauucauaguagacuuacucuaacgggcauuuugaacuuuuccagggguaagguagacugcaugaaggauauugcuauguaguaggaugauaaaguuuaaaauagaguugccaaaacuaaugacuguguucauuguugugauuacguauuuuaauugcuuuaagauuuucccuauaaaagcauuugcugguguuuacaaauuaagaucuuuuauccccaccccaauguaguuaaguauuauggucauuaggguugaagggguuuuagagguuaaauaauuucaccaacaucacagucuguuaugaaaaugacuuauguccuguaaccuuuuauaucauguuccuccuucucuuguugcuuuauuaaaacccuggggagggagaggaucuugcuccagauuugcucaugcuuuuauaucuuucaggcagccuaugaugccagcauauuaauauauuuuaggugugauacaugaaaauauguuuacaucauuuaggaaggaaaauuuuucuuuugcuuuguuuugcagauguacagaucagcucucaaaaugucuucugugucuucugagcgucuucuaagacaauugcauuagccuccugcuaguugacuaauagaauuaauaauuguaaaaagcacucuaaagccacaugccuuaugaagucaaugcuggguaugauuuuacaaguaugugaucuauuuuuucaagugaaaauguuaacuggaaaaguucuuggcacacaguaaaacaucgugcaaucuguuauuugucuuagagauaauaacuugaggguggcuauagucuuaugguaucuaacuuacgacucgcuaggggaguuucuuccacuuagaaguaugacaaaugugcuuauauuuacauaaucugucacucugaaaaauuacgaugauauaauuccaguaaaauuauuucuucuauagcuacuucaaaguauagucaacuaaauuaagcacauuuuuuuaaaaaacagcaacuaaagaacaugcccccgcccccacaacacaaaauaaaacccaaaugaccuuucagagauuucuuugaaguuuuagcaguuuaacagucuuugcaauguauauuauuaagggcucuauucagcauaaggagucaugagucauaaguguucuaaguaucuguucuuggguagaagaaggaacugaaauuuuagaaagaugauaauuuaauuaagucauauuuucucccagccacuaaagaugcugguugaguagucuuuaaacuaugacccauuauaucucuucaauguaacaauaaaucaacuagagcuaaagcuucuuuuuguuuugaaaaauaaguuaauuuuuaaaauacuaauguauuuagaucuauucacuuuuaaguauuuuaucuugguucccuugcuauuuaaaauguugccauuuuccuaaucgcucacccuggcguuaacauaugggcauaaaccauuuucucaucauuuugauggaaggcuaaccuuaaugaauuagauuauuucuuccucauuucuuugugaguccugucuuuugauauaggauuuuuaucuuuuuuguguguguaaccuuauucauuucauuuaggugauucaguguuaaguucuagucaucuuaagaagaaacuguuaaaauagaaaugauauaguuauucaguaagggaagauuauauuguaauaguuagugaagacauuauguguaauggaaaaaauuaacaaucaggaaauucuggagggaaagguaagagaaguuguaucaaaccuucacaauuuuauguguaggaauguuugauuacaaccuaaaauauccuuuucuguagaccaaguuaaaaccaugcauauuuugcucaaccuuauauuuuaaaugauaacuaauuuuuucaguuugcucauuuagucuuucuuucccuguuuucccuuuauugacuacuaguaaaauugcccuucgguuuucugcauauuuucacacauucccagggcuucuuuagucacuucugacaaaagaauacaggacuccuaaaagguugacauaacacauaagacauugaaaugcaaacauuaaaaaaaaauaguuuaccaguguuuccuuuuuuaacagugguuaucaaguuuuguuaauuuuagggccuaauagaaugacaccaagaugggaagcucauauuccccuucuuuccuccagaagucagucagguuuacauugccucaacgccaacacuuucacuugaaacuucacucuuccauccuauauauguaauuuuguuccaagagggagcuuuuauagguauuuggcgaauaacauuauugauguguaagaagaacaguguacuuucuuucuuuuuguuuuuguuuuugcuuuuguuuuuuuuuuugagauggaguuucacucuugucgcccaggcuggagugcaauggcaugaucuuggcucacugcaaccuccgcuuccuggguucaagcaguucuccugccucagccucccuaguagcugggauuacaggcaugcaccaccacacccagcuaauuuuuguauuuuuuuuguagagauggaauuucgccauguuggucagcuggucuugaacuccugaccucaggugauccacccgccguggccucccaaagugcugggauuacaggcgugagccccugugcuuggcccaguguacuuucuuaaguaccauuaugcuauuuuucacauuauucacuguggcacauuuuuacuuuauaaaugauuccuuauacucuagugcacuauccuuguucagugauucauauaaaaauuuugcaugaccagcuuuucagaagcaaagguacacuugucuauccaaagccagugugguacuucaguacuugugagaaauuauagaugaaaaugacuaaaccucauguuauuaauuuagauuuucucagcauguuuuggauaauugcgguauaacuaacuguuaguccuuauggcgaagucaacuaacaaagaagucuuguuuaaucagaaugucacagguggaauuuuccaagagacauuuggggugaugacuuacacagcacucgacagcuuuuuaagcugagugauuaagaaacagcagccacggaacccaguccucgaccagccuuuguuaaugcauucuuuaauugacacuacacaaauuguuucuuaguuuauuuuauauucuuaaaguucugacucauucuacuccagcagaagaauuuguuccaguauucuucuuuugaccccagucacugaugucacuaacuuaacuugagagacaugguugagcuaauguguaaaggugaaccauagcaaacugcuaauauuuugcuguuuugaacuacacaaggacaaugucauaugguucagcuuaaucuucuuucuuagucaguuuccagugugcucccagugguggaacagguacuguuuucaccaggcugcauauggacacccagagcuuauuagguuccccagcaugcuggacagaguccuaggaaaaccugaucugaccacugugaugcauagcaggucuuucuucugacuuucaggcaagccccaaauguggcucaaagaaauuuguugguaggucagagcuggaacguuugucauccuccgcuuccugaaagugaugaggcaguuuucacucuguuuauaacauagcuguuucugucuuuuugacuaugaagauauuuuguuugaaacuauauuuacaucccgguuacauaggguaacaauaucgaauuccaauuuauguuauuuauguauacauauauguaccauauaaauaaaugugauguauucuauaaccauaaacacauauauguauuuuauaaacauaacauguguacauguuauauauaauauagaccauauauaaauauauaagcaugcauauauauuguuagcuacaaucaaaggaagaaauugggcaaaaauauauuuucaggaaagaauaaguaauagggaggguaaaccuaguaauaaaaauaaauccuucauuauuccuaaaaccaccuuaaaauaauaaaugagccagucuugguuacaaaaguaauucuaaauguaaauuguuuguuuuagucucaacuuuuugcuguuuuuagaauggguuuuuuuuuuuuuccuagaggaagcauuugauuaugcaccuuaaaaaacucacauaaguaaaauauuccagauucaacuguaucucuguaacuuucagauaacacuguaucugccuuuucccuuuaucuuugcagauaugguccggaaaaagaaccccccucugagaaacguugcaagugaaggcgagggccagauccuggagccuauagguacagaaagcaagguaucuggaaagaacaaagaauuuucugcagaucagaugucagaaaauacggaucagagugaugcugcagaacuaaaucauaaggaggaacauagcuugcauguucaagauccaucuucuagcaguaagaaggacuugaaaagcgcaguucugagugagaaggcuggcuucaauuaugaaagccccaguaagggaggaaacuuucccuccuuuccgcaugaugaggugacagacagaaauauguuggcuuucucaucuccagcugcugggggagucugugagcccuugaagucuccgcaaagagcagaggcagaugacccucaagauauggccugcacccccucaggggacucacuggagacaaaggaagaucagaagaugucaccaaaggcuacagaggaaacagggcaagcacagaguggucaagccaauugucaagguuugagcccaguuucaguggccucaaaaaacccacaagugccuucagauggggguguaagacugaauaaauccaaaacugacuuacuggugaaugacaacccagacccggcaccucugucuccagagcuucaggacuuuaaaugcaauaucuguggauaugguuacuacggcaacgaccccacagaucugauuaagcacuuccgaaaguaucacuuaggacugcauaaccgcaccaggcaagaugcugagcuggacagcaaaaucuuggcccuucauaacauggugcaguucagccauuccaaagacuuccagaaggucaaccguucuguguuuucuggugugcugcaggacaucaauucuucaaggccuguuuuacuaaaugggaccuaugaugugcagguuuguacuuuguauugucucuuuguacagaaaaaguuauuagaaaugaaaugugaauucuuauauucauguuaaaaccaaggucccaguaccagacagguagccugcuagaucuagcagaagagauggacacacuccauagcuacuucauacaaguauauucagaguugucuaaagacaacuuuuagccucuuauuguggaaaacaauccuagcauuuuuuuaaauuugggaaagucuuuucauggaauuagcuaagcuucacaauucugggcauaugucaugguaauuugauguuuucacagucuuccaaaaauguuacuaaucuuuaugguugcacaugauaauaauucaugccuuguuccaguuuuagauuauaaggcuuuugcuauaaucuuucuuucagugaggauauuuccuguaucuuggauuaggauuugauuuuauauucauccugacgguucauauugaugguugcagagauaguccugaaaaggcaaaauaauugcaaaugaaaacugggauauaacauuuuauguugauuagaaagaaguaaauguuauuuuaaguauuagggacagcagaaugaccuugguaggggccaauaaagcauuccuuucugcauuuaaggaaaauggcaauaauuuaugaaagcauuuaguaauaauuuagauuuuuacuuuuauuaaaaacagccuaccuuuuuguucuaucuuucugucuuuaguuuauggcauaugugaaauggaaaaaagaaacuguuaccauuuugaauagaacgaaacauggaacugagucuaaauaaauguauacauuuaauuuuaguaauuuuagcauagucaaaauucauggucagcuugagaaaguguauuaguuuuuguuacaguuuguagauuuuuauuguauuauaaggccagggggauuucaaaacauauuagcuuuacuaguaacuuuuuuuaggaaugauuagaaguacccagagaacuaaugaaauaaaucccuuaaaauaucagucauuuuuauccacuugauagcuacagcucauuugucucagaccucucuauugaccuaauaccaauuaagaaaagcaggcaaagagguuguaaauaacagguagugaacauauuuugcaauacuuguaagaagaaucagaagagaaauuuccugguccuuuaaaugucagaauggcaaucuuaucacuuuaagggagauauaaagaacucuuaaaacaccaguuucaucuugguaaaguucucuaaaaauuccaucuuaguuugugauuuuccacagauagaauuauuucuguggagcagcaaauuaacccaacauaguuauuaugcaugaaagcuacaugcuuugaacugcugucuauuaaagaucauuucacugucuuaugucagauacacucugcugucaaacuaugauugggaagcaaauacuuguuuuagauaaaaggguuggaagugaauaaugucaguaugugaaacaguguuuuauaauuagcaaguaauaugaaguuaauaccuggauuuccggcaggcguuucagucuguucacucuagggacaacuucugagggaagcugaucuaggcugucagggaaaacucuaaaaacgaaaauuacuaaggccuauaguuuggaagaauucagauuuuuaaacacacuuccauuucccccaaacaguuauuuguuagguucuuaguuauuuauaguaaaguuuauguuuggguagaaggagcuggacacuuuuccugggcagugauuuuagaaguaaaacagaugugugagcuaucugaguuugaacuaauagaacuagaaauaaaacagcugauccuagacuaugcugucugcuaaauccuugcagcacacaccgaggaagacaaaaagugguaggaaagagcaugcaggaacauaaucuuguuaagauaauuuuuuuccaagauaaauaauacuguuaaaaauagaaaaaaguaaucuguggcaacagcgcgugauuauuucaaacaaacaauuggauuuugaaacgcaucuaaaggguuaacuucaauuugugaggauaacacugaauauacuuguagaucgaaugcuaaucuugaaugcuuugcacauaugccagauacugcugcagaaaaaugucugaagauaaguaacuuauuacuaucuucaugcugaaauaaauauugaacaguuuuucuaucugcauaaaaugaauaaaaacgcaucugaaauuuccuuuuauaccaacaaguuuauguuacugaaaugcuauuugagagauucuuuccuuggugguuaaacuucguggaggcuaaaagcugugggagauaaaaugcugacuauagaauuucuuuaauguaguuuugucagaaauauauaguaaguuaauggccuguguguauucugauaaaaagauguugguaaauaugaguauuacagacaaucguucaauuuuaggaauuauauauaaguccauaauuuaagcuaauugaaguaauagaugaagaauucauuaauccuuuucaauuaaacuugcuuuuuaaaaaacauucagaacaguuggugguuaaugauagauuuaugacauuuuaggccaaaaaaaaaaaaaaaguaacagaagccaaaagcaaaacacugaaagaacucuauggcuuugaucuauauuuugguuugacauggaugguuuuaaauaauuugaauggacuugagagcaaauaugagauauacaguugggaaaagaaguacauaauuuaaacaaauucgaagauuucccgguuuaagugcaaguuauuucaaauauacuuggaggaauaauugaaauuuagacaugcuugugcugauaauauccacuuuuguauaaauuagaucacaaaugacuaagucaaagaauuacaacuuuguaaaaauacugccaaauaacaauguuucuuugugcugcauagaagauagagccccagccggauaauggaggucacuguaaauagccaucagaaagccaagacuguccuuucugaguguggcauuuaucagauucuccccccaacaccuugagguagcaugcccaguccuaaaagcagaagacauguaaauucuuuaccaagaaaacaagagaagcuauaauggcuagcuuagagcuaauugauuugaccaggauguuaguuuuccaauuuuucauuuauccagcauguucuaucaguugucaugcuuaaauuuguaaaaaucauagaugcagcaugauugguuagcuuuucauguaauauuuacuaucuguauucggccauagaggcucacauggagaccaauaauacaagagaucgaguucuuaaaaaaguaauuacagcuucuuucuuuuuauuuuuuucuuuuucuuuuuggagauggagaucucacucugucacccaggcuggagugcaguggcauggucucagcucacugcaaccuccgccucccagguucaaguuauucuccugccucagccucccgaguagcugagauaacaggugugcaccaccacgcccagcuaauuuuuuuguauuuuuaguagagacgggguuucaccauauuggccaggcuggucucgaacuccugaccacccgccucggccucccaaagugcugggauuacaggcgugagccaccgcgcccugcuagcuucuuucuuuuuaaucugcuuuauuaugcuuauauuuaaaccauuacugaauggaggccugcauuaacaacgcggccuuugcuguuucauuaggguguaaugcgcugugcauuggguguuugcaucaucuuuauuggggagcuuuuagcccucagaucagguuauaaaaguaggagucuugucaaguugugcuucccacgggaaaguguuuaugcuaucccaaguucagaugcuuaugauauauauguugccuuuucauauuagugaauucuuuuuauuacugcauuauucaggacuuuaagaagguagcuacugguuuccagcuauuaaauuuauuuuggcccuuaaugaaauucuaaggcuaauagaagaaucacaugauuaacuuaccaaguacugucuuauguuugagcuaggaguguuacauuucuguguuguaaauauuuuuaucagaguugcacaauaugucauguuagaagcaggaagaacagauuuuagagagaggaagucauccuuuggauuuguauuuucaacagauuuaauuguaugaguuuauagaucuuuaacauguaucaguacaaucguuugagcaggggauuacaguuugguuugaaaaaaaaaucagagaccauuaaucuuacugugguuuauuuugacuugucuugaauuuuacuucuaaacauuuauuuuuugccuuggcauuuucuuugaucuggaguaggagggaaguuguagaucuuagcagguucuguuucuuuguuuuucugaguugaggacaauugcaguuuagaaaaacuggugaaugagacuuuuaucaauucagacugucuauagaauacagaauguuuggcauaugaacccacacuucuuuuucaggacugugucuccuuaacaaguaauaaagugugcaaaauaagacauaugcucaccucaaggccauaaagcaaggcaaaguucugguauuuaccagguuauuuucaucaguggagauggcagagcuaaauaauguagccacccuaguagaauaguucaacuaucauuacuaaucccuuuaccugcaugacaguuaaaucuuuuuuggccuuguucaugacaguugguaucaucuuugauuuuugguuuauuuguuaucauuuaaaggaacauguauaauuuuguugaauaucaguauuuuucucuaugcagaauguuuaggagaauaaauugugguuaucaguggauucaaucaaauuuagcauuauucaacuccuaagaaaaucuuuuaccucuccuauggccugcucugcuaaccaucucaagucaggagguuacucaguguuuuuuuauuucuuggaucauuguaauuacagcauacgugcagcuguuagaaacacagauauacaaguagugugccaauacggggaaaguuuggagagagaaaguuguucuguuucauuuucugauuuccuuuguagagucugauucugacagucauuagaccauagaugucuugaauucuucaucaggcgauccacauuugaggcaaauguuauacguuuucagaauaucauacaaacccuuguuuaauuuuaauugaaagucaaauguaaaauuuauuuuucugucuuacauuuaaguugauucauacuucuuucaucuuuuaguuuacauaaucaaaauuuguacagaucccuuauuuuuuuccaauuuuggauucacaucuaauaauagcuaaaauuuacuaaggguucuuauguguguauguggagcucaguuuuuuacauguauuaaugaacucaucuucauaauagcccuagaaguaaacacuaaccuuauguccauuuaaaaaaauaaggaaacagcauauauuaaaguauccugcccaagaucacagaguugcauaaguagagagaaugggauguaaaccaugauagacaggccacggaagccugucuucacaaccacacugauauauggccuggccaaacaugagucugaguuuacugccaauagcaaagcaauagaggguaggccaauugcauguaagggaggagauagaagacauaaaucagagcucuuugaugcagucucucugaaugagguugauuuuggggacuugggugauuucuuugagauuaucugcuaucugcuccguguaguguaaugcuaccuuauuugaacuuacuaagcuucuauucgaaaucaguaaaaagaaaauuaaauuugcugacucaucuuuuuaaaauuacagugauuccuuuucccugguacuuuugcugcaggaauuaguucugguagagcgaauaaggugcaaauuuugauguaaucaauuaaggauguaauguuugauccccaaauuaagggacauuucauccagguguuugacuuuuuuuguacuccccucauuuagaggacuuuguuuuaggaauuuauuauuuaaaugauggucugaaaguugucuuaugcucuucuaguuaccaggcacaauuuagguuguuuuuuuuccaugcagauuacauguuaaggagauacacuccauucccauuuauguccuccaaggcuguguaauuaagguuuuauccuccgccuacauucagugcaggaauggguguggaagcagagaacaaaucagaaugccuuuagaguguccaauuugagugugcuggauucuccagcugugcuuggagcugugugauuucauugaauucagaaagcaauagacgggugggacauagugaggaguuugggaauucacagagucuccuggccuagcauuucuccuuucauguuuaguugaacuguugauauaagauuaaagaaugccugcauccuuucauguguccaggaacauaucugggaaucuuauaauaaaugaugguuuguuccaagaccuguuuuuccagcugaugggaagcuccaccuuggaauucauuggcacuucaaagucaacauauguaaaagugaaguuccccacaacaacuuucuuuuugccuccuuucuucuuuacuccuguuuucagcuaagucaggcuggaaaucuuggaguuaccuuggauuucuguuugauaucacgccccaaacacuugagcagugugucccauuguucccuucuuuauucuuuuacugucacuucuuucaaguaaauccuuauugauuucuuuucuguuguucuagcuuuaucuucccuucuugucucuuccuuucccuucucuucucaccuccuauucuuuccuccuccuccucaucuuccucuccuuuccuuugauuucuuuuuugugcucuuucuugucuucuucuguuuuuauuuccuuccucauuccuucuucuuccuccucucuuuggccucuuuuucuguucuuuucuucuguccuccuucuuuuaucuuccuuucuccuucucuuuuuuucauccuccuuccuuucucuuuuuuucucccacccucucaccuuccuuucuuucuucuuuccuuuaauuuuuaaaaauucuguuuauugaucaguuguccuacauuuuauagcaaguaugggacuacuucuguugaaaagcauaucaucuaauuauacuugcuuauguaaauaucagcucuccaauaagacauuaacuuuccagauuaaaucucacuauucuuccagaaaggauaauaguaagaacaaggcuagcacauuuauauuacuuauuacauuuauauuacuuauuacauagcaagcaccguuauguaccauauuccauuuaacgauuugauaaugccucggcccuccucaguauuuccugagagcagcuugcauugucuuacucucgcuguugauuuuacugguuuuguuuccuucaccugaaaugcccuuucaugaucacugccuuugaggcuaaccuucacauaucagcucaucuguccacagcucaguuguuacuucugggagccuuugcugacuccucagucuggguuaggggcucuuccucuguguugucauggaaccuguuacaugucucagcagaagcauguuuuccauuguuguugucuuuuuaguugugagcuuuuugugcuaaaccauagacauguuacgauuuuugacuaugucauucuuuuuguauuuccagugcuuggcacauaguagauguguuaaaacagcaaccuucccuggaggaaggauguucuauauuuucggagauuagauuuucucuuuucccauuaagaugcucuuuagaauacaugugcaauucugacauaucuccauuaugaaccagcagcaccugcagguuggaugcuguagaggagugcuauggggaauucacuuagcuuuguaacccacuugaacugcauuuugucuuguuuauuucuccuauaaaauauugucuuccaauuuauuaagauggacuuuuuuuuuuuuuuuuugauauggagucuugcucuguugcccaggcuggagugcaguggcauggucucggcucacugcaaccuccgccccccaggcucaagcgauucucccaccucagccucccgaguagcugggauuacaggcaccugccaccacaucuggcuaauuuuuguauuuuuauuagacacaggguuucaccauguuggccaggcuggucucgaacuccugaucucaggugauccgcccgccuuggccucccaaagugcugggauuacaggugugagccacuguccccggccuauuaagauggacuuuaagauuuauugguacucugucaucugaaauaccagauaauauagaaaaauuaauucagaauuauacugaguaaaaugagaaaaccaguuuaggguaaacuguuuauugcuauuaugcaaaaagccaauaauaaaaaucugcauaaugaggaauaugcaguauuuucuucuucaaugugcccaguguaggaguuugaguuuugguuuccccuguacccuccccugccguugguuggcucuuguauuauaaauccaaauaagggaguuguuacagugucacugauaggaauaaaccucagaaauaagcuauggauggcaugagagucagaugaugccauauaauuugaguuguuauugagauucugaaacauuuauucuccaucaaaaguauaucacugaagcacacucuauauucuagaauguuuuuuugaagcacuauacaugcagaaaaauucccgauguauauaagcagauuaauucuggcuguaguuauuuuccgcuaagaucggcccuuacagacuuuuuucaaguuauucgaaauaucaguauuugaacagugauuuuuuuuuaacaacuuagcuuuuuauuuuuaagcuuuuaccucuuugacuaucagcccauaaccucaaguucucuuaaauuaguacccuuauaauugucucuguugcuaucaauuauaguacuugaaaaugaaccacaacugagaagagguuuguguuuaguucaaacaacucuuucuuugcugcguugaaaauaaguacauguguugaagugucauuuuaagagcucugaggcuuuaagaaauauuuuccuuugacauauuauuuuagauauuauucuuguuagcuuuugcuccauauuauugggaggaaagaaagaaacugagauuaaugaccuugaaagaaaccaacccuuuuauauucuucacuucuacgguaaaacauuuuuguguguguguaaaaagacauauguaaauaaauuauaaaugaaagccauggaaaacacuucauggaaggaauaguuuuuaaaacuagggcuaaaaucaaguauaaaaagccaugcuaguccuuagucagugaaaaagacuuuaaaauacucuuuuuugugccuuaauuguuuuagguguuuuuauauaacuuuaauucacaaucaaaggacuccauagucagucauuugcuuguggacaaaagaugcauuuuguaguuucuugaagaaggccauguaugccaggucaagucaguggugagggugccaugaaguacuguggccagcgaaucucagguaacucaggggccuuggugagacauuuucaucugcuuacaucucccuucguucauucauucagucaaaaugcauugaacuccugcuuucuucuagaugugaauaagacuauucuuguagcucaagaaggaauauaaacagaaguauuaucuuaguaacagcagauugaaccuuugcauuuacagcuaagaauauugauagugacaagugugugaguuugucacugaaugaauuuaccacuucccuucuauguaaucucuuuaucccauuugcaggaaaaauuuacuugaaugauucauuuuauuaaauaauaauccuaccuaugcacauguuacuguugagugugcuaucuaauaugguauucccuaacaaaauguggcuauuuaaauuuuaggcugggcaugguggugcaugccguaaucccagcauuuugugaggccaaggcaaguggcuagcuugagcccaggaguucaagaccagucugggcaacauggcaaaacccuguuuccacaaaaaauacaaaaauuagcugggugugguggcaugugucuguugucucagcuacucuggaggcuaaggugggaagauucacuugagcccaggaggcagaggugacagugagcggagaucgugacauugcacuccagccugggugacagacugagacccugccucuaaaaaagaaauuuuuaaaauaaauacauuucaguuaauuacaaauaaauuagugaaaugcugagaaaaauauaugaaaguaaauuuaaaaaacaguucuucauuuuuacuaagccuacuuguggcuaguggcuaccauauuggccaaggaaggcuauggaacauuuuuaucaucucaggaaguacuauuggacagcacaaauccauaguucucacuugauccucacgauaauccuauaaaaugacaaguuguacaguauuguauccauagaggccaggagacuaagguuccaagagguuaaauaauguaucuuuucauagaacuugagcuagagaacuuccucuagaagcaaauaaauacaggcagauguaaauacaaauaaauaaaggguuuuaucuacaauuuuuaaaucuuacaauguaaguaucuugaaggcagagauguugucuaccucuucaauauuauaugccuaauaucuauugcagagucugacacaagccgaacacuuaguuacuacuaauuagagggauaaauacguguaguuuuuggcccaaacagaaauuacaguuuaauauaauuguaaaaauuuggaugucuuuaccaaaggaacugcuggguuuaaaggguuauaauuaaaguucugguuaguaaaagaaggaaguuugaaagcucugcucucuauucugcuugcacucucuuuuuaguauagucacagcuaagaagcaguaaauuuuccuacuccgugauggauucagccauuugaaaaguuugcaauauucuaugaacguguaggcacuguuuccagacaauaaguuucaauaaaccauugcugaaaacacuuauuuugcauaauuguucucacuguguauuuguuuuuacccuagaaaagaauagauuuaaaauagcauaaauggggcaugcaaauaaaaugaguauggucaauagacaccaguagugucuccuaaaauaauaaauuauguuuuauuguagaauggcauuuaaauguuguaugucaucuauauuucgcuaugacuugaguguacaucuaccaguauagaaaguauaaaaauugccacaaauagagcuuuuagguguucuuuuugaaauaaaaaaggaauagaacacugucauuauguuuuccaaaacugcguuuuaaaauaugugauucuaauauuauauuagcuuuuaauaauauauaauacuaauauuauuuaccgauauuaaccaaaaacgcaaauaugugaccuauagaagugucauuauuguucuugccauuaaaugagauccgugaguuuucauuuuuuagcuuggcuuuugaaagagcagucaauaguaugaagguauucauucuucagcauaauuaaaauauauagcccuuaaaagcuucuuaaauaaugaaguuggcacauuuucccuggguuuaacaaaaaaaaaaaaacacaucuagacacguacaccaacuucaaagaccuaacucguuuuuuauagcuuaguuaauccuaaaccaaaaugcuuuacugauaauuuuucacaaaguugccuucuuucguagucccuucuccugauaguauugauucguagccuggguuuucugacuucuuagguuguuuuuaaauaacaacaaccuuuuuaguauguugggaugcuuaguaauaauuuaaauccacuucagaaucauauguuuagggauuucuuaaguauauguaugcucuuuguucaacccuuucaguguggucauggcacaugaggcuuaaagauugcaaaaucaaagaaauagugaugaugccuggugguuucuugggaaucuugggucaacaagcagaaguucaaagcauuuuauaauagggaagcuuggcaaggcagaugcaaugugaaagcuuaaacaagaaaauuuuuaucucuagauuuugcauacuuucuuucuuugccuguguuaaagaaggggauacaucugaauuuaucccuuuugaaucaaguuuaaguuccggaacaaagaaccugauugauggcuauccauuuaaauauauauauguauuuuuuuuuuuuuuuuuuuuuggcaaaugaaccuucucuuuaccuccagugaauugggaaauauauguagagauuuuuacaauauuaugaauuauauuucaguauuaugaauuauauuucagugcaaguuuuaguugcuuuagucacuuaaaugcuagauuagaguguucugugcuguauccuugaguguauggcuuugaaaccucucacaccauugaaugauugucagguugcugccuggaagggugccccauucuuagcuuucuggcugguugaugcucugucauugacagacugaaaucuaugugauugggguucugguuauagacauugccuaaugugaaauauuacauccuuugauuaaaggcuguggaaaacuucuguaagauccuaucuuaauguacaguaaauguugaguuguuuauauauuaaugcacauuucuuagaacuauaauacuggacauaaauuuggagguugccccaguugaagaagcuauuggccagagagauuaaguaauuugaucaaggucacaucucuuuuuaauagcaaaaagaauacuucaaucuuaguccuguacaauagagguacaaacauaucucucaguguacuacagcaauauuauuugcauuucaaauagagccuuuacgugauuuugagaugccugagacuuuucucaugcagugauuuggauaugaacagcgaucacacgugucauuuuugaacagcuguugaagaaggcagaagaugauuaugccacuugcuuaauauauuacaucugguugcugggaaaauuuaaaaauucccuggugguuggaagagaaauuguuuucccuuuuuggaguauuucauucaaaaaacucuauuuuaacucugaauuuuggcugcucagugguggcuuaauuguacugccuauugaggugcacacugagaauggaggaaggauuuuaugcaaagugcccuuugaaggcuuucauaguccugauuccauguaauuucauaauuugggaaagaaagcagaguuguagugauuuuuuaugguggaauuauuuuauuuuaccauucagacaucaugaccuacucaugugagaaguugggagcccuuugcaaugaaacagaaccuuaaucaaauaaggcauggaagauuuuucuuuuuuuuuguuuguucuagauggggaaacauucaaaauucuuuauuuacacgguucuucuuugcuaguauuuccugcauacucaauucaucuuuuuguuuguuucacugugcuuuaauuauaagccauuuuggguggucauuggagcaccuuuauuuuaccuaaaacagagaccucaucuuugccugcagccucauugcuguaggaacugaacagaauauuuccuuggagaacaucugcauugaguaauuuuugagcaagugccucuaguuuugacaguaacgcuucaccuuuugaaaagaaaucccaugugauuuggaugcuucuguaggaaugugauuugaaggaggcaauaguaaaauguacuguguugaaaauuguuuucuuaguuuaaaaaauguauuauuaagucuuucaaauuauagugcauuuauuacuuaccuucaccuguuacuuuggccuacaguguauaacauaaugagccucucaaagaguagcuguugagaaaugaagagugaauuuauuuggcucugauuauucaagugauuucauaauaagcaggaguacuauuguauuuuuugauguggaauacuuggcaguacccucccccuccccugcagagggcccauugaauuaaugacaccuuggaaguaaaguccauuucuucuguucuccaggugacuucagguggaacauucauuggcauuggacggaaaacaccagauugccaagggaacaccaaguauuuccgcuguaaauucugcaauuucacuuauaugggcaacucauccaccgaauuagaacaacauuuucuucagacucacccaaacaaaauaaaagcuucucuccccuccucugagguugcaaaaccuucagagaaaaacucuaacaaguccaucccugcacuucaauccagugauucuggagacuugggaaaauggcaggacaagauaacagucaaagcaggagaugacacuccuguuggguacucagugcccauaaagccccucgauuccucuagacaaaaugguacagaggccaccaguuacuacugguguaaauuuuguaguuucagcugugagucaucuagcucacuuaaacugcuagaacauuauggcaagcagcacggagcagugcagucaggcggccuuaauccagaguuaaaugauaagcuuuccaggggcucugucauuaaucagaaugaucuagccaaaaguucagaaggagagacaaugaccaagacagacaagagcucgaguggggcuaaaaagaaggacuucuccagcaagggagccgaggauaauaugguaacgagcuauaauugucaguucugugacuuccgauauuccaaaagccauggcccugauguaauuguaguggggccacuucuccgucauuaucaacagcuccauaacauucacaaguguaccauuaaacacuguccauucugucccagaggacuuugcagcccagaaaagcaccuuggagaaauuacuuauccguuugcuuguagaaaaaguaauuguucccacugugcacucuugcuucugcacuugucuccuggggcggcuggaagcucgcgagucaaacaucagugccaucaguguucauucaccaccccugacguagauguacuccucuuucacuaugaaagugugcaugagucccaagcaucggaugucaaacaagaagcaaaucaccugcaaggaucggaugggcagcagucugucaaggaaagcaaagaacacucauguaccaaaugugauuuuauuacccaaguggaagaagagauuucccgacacuacaggugaggcaugggggguggggucgggaggaauauacaaauaaaauaauagaaaaaauccauagaaagagggcugaaccgggaauuguugagagugauuccaaugacuuggggaaguuauaggagaagaccacauaaaaguucaucacagauuugcaggugauauaguuacagcugugaucacuguagauuuuaauuugguuccuucuuuuggacuguaugcucauguuucauacuuguguuauaccauuuacugauugucuuuuuaaauucacagugauucuaauaaugcugaugaguuuacuaauuuaccguaguccauuuauuuauccuuacuaaauaugacuccacauccuauauuuuuuugacagagcuaaaugaaagaugcuauuguaaauauauccuauucucuauucugcaaaaaaauuuugagaaccuguugcucauuuuuauuuuaaaaugagauuauauauucuucuggcuuugaacaauucugcaacauccuuguuuagcauacaaacaguaaucuaaaggugagaauuuuuguacuaugugugauuuuggauguagacuugcuccuccaagcagguaaaacugcuugaguuauuccagauucuuaaauggaugugggaaguuuguguuuuccuucugcuuucacucuauucucuuuauaaacauuaacuuucccaguuaaucuuuuauaauaucuagagauaagcauaggauauguaucuuuauuucauguaugcauucauucuuuaauuaauugauuucaaaaauccuauuguaccaggcauugaauauacaagagaagacauagucagugcccucauggaacuuacaguuuaguagggaagaugagacacuuagaugauuacaagaguaauaagugucauaaaagaugaaguacaaggcaguguguuugaauauaaugauaacauaaccuaauaugguagauuaggaaauuacuuccucgggaaggagcauuuaaacugagacuugguuauaaauaggaauuaguucagcaaagcauuggugguacccugcguuuagguauuauuuagugcucauuggguacuuucucauuauuaugccuuucagcaucaaaguagaaagcuuuacuuacuauaccaauaugcuagucuaaagaucuauucaauuucuacaucccaugauauuaaacaguuucuuccacuccuuuuaaaaguuuuguguuagugcaaguguguguauguuuuuucagucaccaguaaugaagcaguucauguccaacaauaggcucauaaugugagauguuaauuugaagggcaucccaauguucacagugaaucaaaauguucaaaaaacacuuacuugagauuuacacuguuuaauuuauaaggucagcccugggaaagacacaguccugcaucaaauauguguucacacuugcaaugaguguuucuggcuccucugauguuagcugcauguuaauuuauuucugaggcucgcaaacaucagcugcuuucugagcuuuacuagcguggauauguguguaugugcacauugugcauguacauguguugagugauguaaaaaucagauaguccauucuuuuuuugaaaaggacaaggacaacuuuuuuuuugagaaaucuucaugauuuucuuuaaucaugaggaaaccagccagaacacacacacaucuuggaccugcacacccacguaugugcgcacacacacacacacgcacacgcacucauucugauacaucuagauaccagcucaguuggacaagugguuuuucuauugaugcagcugaggcauugcuugagaaugucugggaaaacaggguuuucacaugcuuuagguaaacaaaauaaucccccaagaaauaaaauaugaauaaaacuauuacugaauaaugucagaauuuaguuaauauucagugaugaaaguaagcucuagagaaaagagaacuauucuuuucuuguucaccacuguaucugcacgauuuaacacaguggcaggaugccuaaugggaguucaaugaguaucuuuauguaaaugagaucccugugaguuuuugacuucacaguaguuaugaauaagcugagauuuccaggugaguuacauuuuaaugcuucacuauuauauggucuuggaacccuucugaggaccuaggcuuccaugccaaaugacaguugucuguucauuuugaccuuaagucaacuucucagcauuuuauuagcuaaaaauugaaauagcacuuguccauagggcauuaaaauauucuugcacuuauguuuaaauccugauauaguuuggcugaccagggauccuuuaaggugcugaguaguuaucucuaaucuguuucugaguucuuauagagauauuugaaauuuggagccuuacaauuucagaagucacagcuuaguagaaaagauaaagaaacucgacugaaagcugaacaguaauaguggccccagagaugugaaagaacauagucacguggauguuuagaacuugaucugcuaucaaagcauuuucuaaaaaugcuccccuuuuaagauaaaauaagaggacaaguuuaccuuaucacguaguaucuuuauaauuuaauuuguuuacucagauuauucauguugggaaacuucugccauaauucuguguuauuucugugaaauauucuaggcuuuugagugcuuuauauagaagacuuaaugguguaguaaaaauuagcauaagccaugaacuguauaauaugugaaaucauuuagcuauaaaaugacuauagcugagaagcagaagaguuuaucuagagcucugagugaaaaaccucagugucgauucuguugcaugggugcuuucuuuaagagcuaaguuaaacuugguggaacugcaaacaugaucuagucagcaacagggacuuaguacauucacuuaauguuuaguauuuaccuauaauaccccuaacucagacuauaacuggguuauuauauuccacccaugaaugguuuucucacugcauuucuuuuauuauuuaucauuuaauucaacuguguaccugcucucuauuaacugcuacuuuucuuaucaaaauuuucaguguuauaacuuagguuuuuggcacgaguaggaggauuacuucccuacaaaacaacuauacuagauaaaacauauuuuguaaugcauugccagacuucuacaaaguaagaaaaauuuuuggagccuuuguucucccuuucaucaagagugcacuaaacacagaguagggagaagugaaggguaagcuuggaaugugagguuacacugagggcaaaugccaaugucgauguugcauuugaucugaagacuaagccuggaguuacucauagagagaaggggacgaaucugaguuuugcuuuaagcuuagaucuuaaagguggcuaggauuuuuacauuaguucuuccucugacuucuggcauaauuaaacacaaauuugucuguagaaaaguacuccaaauuuuaccuccaagauauugauagaugcagauaaaucuuacaugagcucacuauuacgaaaauucaccauauggacaggaaaauaagccaucaugugugaaaucaguagaaaacacaaauaauagauguauauacccagucacuucagauacaggaguuuucaauuauaaaauacuaauaagcauucaaagauaugaauguuacaauuaaaaaaucaucaagcaacaugagacuauaugaacaggcacuucgcaaaagaagauauuuaugcggccaauaaacauaugagaaaagcucaucaccacugaucauuagagaaaugcaagucaaaaacacaaugagauaccaucucaugccaguuagaauggagauuauuaaaaagucaggaaacagaugcuggugaggauguggagaaauaggaacacuuuuacacuguuggugggaguguaaauuaguucaaccauuguggaagacuaugugaugauuccucaaggaucuagaaccagaaauaccauuugacccagcaaucccauuacuggguauauacgcaaaggauuauaaaucauucuacuauaaagacacaugcacauguauguuuauuguaccauuguucacaauagcaaagacuuggaaccaacccaaauguccaccaaugauagauuggauaaagaaaauguggcacauauacaccacggaauacuaugcagccauaaaaaaacgaguugguguccuuugcagggacauggauggagccggaaaccaucauucucagcaaacuaacacaggaacagaaaaccaaacaccgcauguucucacuuauaagugggaguugaacaaugagaacauauggacacgguguggagggggacaucacacacugggcuuguuggagagucgggggcaaggggagggagagcauuaggacaaauaccuaaugcauguggggcuuaaaaccuagaugacagguugauaggugcagcaaaccaccauggcacauguauaccuguguaacaaaccugcacggucugcacauguaccccaaaacuuaaaguaaaauuaaaaaaaaaucaagaucaccaaaaaauuaacaaauaacauuguuuuaauugagaaauauaacucucgaaacuuaaaacauauggauugauuaaacuacauauuagacaaagagagcaaaugaauuaaucaaaaugaggcauuagacagaauauuuaagagagagcaaggaggggcaaaauaucaaagacauuuaguaagauauggaauauaaugagcuauuguaacauacaucuaaucagagucccagaagaaagaaaauguacagaauagagaguagguaaucaguauuugaggagaaaauggaaaaagauuuucuagaaccaaugaaagacauaaauacucagauacaaagaagcguagcauacacuaagcaggaugauguauaggaauaaauucaguuacacacacauuguagcaaaaaugagaaugccaaggcagagacauccuuaaaaacagcuguagacuaacaagaaaucgacuacucagaaaagacauuuagguuggcagacuuuuuauuagcaacaauggaaacuggaggaaggaggaauauuauucagaguuuggaaaaaacaucaaauagucaaccuuguauuuucugcccaucaaagcuaucuccuaagaauaagagcaaagcaaagacauuuucugauaagugaagaccagggaaacaucugagcaaauccaaacaaacauugccugucuuguuuauguaguucaaaaaggaacagacuaggcagggcacaguggcucacaccugaaaucccagcaugugggaggccaaggcuugaacccagaaguuugagaucagccugggcagcauaccaagaucucgucucuaaaaaaaacaaaaaauaaaaacaugaucugaguauaguggugauuaccuguggucccagguacucaggcgcugagaugggaggaucacuuaagcccaggaggucgaggcugcaguaagccaugaucaugccacuggccugggcgacaaagacuaagguauugcuuagugcuacuauguaaguuugaagggaaaaugacuagaauuaagguauucuaagacaccugaauuguugggaguuagcgagcuaggacuuuguuauacauacuuggaaaaauuuaaggauaacuaaugaaagaauaggaaaugaaugcauaacuuccaaaacuauagaggagaaaaaauggaaugaugaaauaaagaacacccauaaaauucaaucaacuuuuuaaaaaauggugagaaaauaugugggaaguguuagacauguagacauuuuaaaguaaaaucuauaaaaauuguagauaucaaaagucuuaaccugugucuguuaaacuuuuccacugaaaagauaucagaugauguaacuguauccugcauacuguauauacaccugaaacauaagucucuggauguucaaaagaaaagaauagacuuaguuauaccagcaaauauaaacuaaaggaaaauugagguaucuuuauuaaucucauacaauuuuaagaauuuauuacaaauagccuauggaggaaagaagggaucauugcauaauaagagguuuaacuucuucagaaaguacaaugguucuaaauacauaacacauaaauacaaauaaguaaagcaaaaagugauagaggaacuacagggaaaacaugacacaccacacucacaaugauaaaguuuuaggaaaauuccuuauuaaaaguuaagcacaaaaaauuuuucaaaauugaaaagauuugagcaacaaauuaucacaccugauuugauaaaaauauacaaauucuguaccaaacaauuagagaauguacaugcuuuugaagcacauauagagcaguucuaaaaauugagacauauuaagccaaaaagaaauuaaaugucaaaaaaacaguaucucauagaacaucuccuuugacucagugcaaugaaaugagaccucaaugacaaaaagcuaaggauugauaaaguuauacagggccaaucauaaccaaacaaaaagaaagagaucccuuuauaucccuuuauuaaucucagaaaacauagauuuuacgauaaaacaccuuaugagggauagaaauggucggaacauacuacuuuggaaggcaaauuuggcaaaauuuggcaauaucagauguucauauucccagugacuacauaauuuuacuuuucagaagaaaaccuuuucauagguuugcuaggaaacgugcaaaaauguucauaauugcauuuuuuagaaagaacaaaacaaccaaaacaaagucaguccaaaauaaaaacaggaaaaaacucugauugucuuuccaaaaaagauuaauuuauuuguagaauuuucaagcaguggaauguuuuacaguagugaauuuaauaaaugacaagugacuacaacauaaaugaaucuuauaagaauaauuuugacggaauaaaaacagaugauaaagacaagucacagugggauaguguuuuauauaaauucaaaagauaaaacuauacaaauuuucauguuauauguuuaugauauacauaugaauaucauaugcaugcauacauauacauacauauguguacaugcauggauaaauacaucugaaauauacacauacauagauguauguauacauacauaugauauaugcacauagauauauguauauauguaugcauacauauaaguauauauguauaugauacucauguauaucauauacauauacucuacuguaccauaaauaguacuuucuuuaucauauguaaucauaucuauaucuauccauauagaaucucuuccucucuacacacgcauagaucucgauucaguuauguaaaaucacauucuaugauucuguaaucgcuucaguuuuuaauuuguuugcgaacuuagauguaaaugaauauguguguguuuauuuauuuguaugucacuaacauacaguguacagcuuuaaaauuaaaaaaugcaucaauucucaucauugcccaugucaaguaaauauaugaaugaaugaucaaucucacuauuaaauaacuuacugugaaagaacuacuaccaacucaguaauauaauuauggucuaguacaaauauuaaaauguucauuguuggcuaaaauguggaaaacuacacacauauuuugguaguguaugcgaugacaagacuguguauuaggagauuuacgaaugcauuuuaaaauuuuuaaacagugcuugcaacuuccagacguaaaauggguaaaaucagacugaaagaguugacauugguugcaguagguagucaaauuaauuuagcuccugcucaaucucuaucuuacauuuaaauuuguguauguuaugugucauauuuuuaaaaauaauaccuaauaaaucaguugcuuauaauaccuugaaauaaacaugauaguucaauuagaaaauacccacuaugagacaaaaaguuacccaggauguuauaguucaccaaacaaacaaacaaacaaacaaauaaaaccucacaaagcaauauuaccuuuauuuguauacaugauuuauuagaaauuucggaacuaaugcuucugaauacuaugcaagaacaguuaucaagucuuggaauaagauacauuuuagccacaguuucaauuccauugacauuuguauaaauaauuuccuauuccuuauuuacuuucuauuuuauugaaagacuuucuacaugaacauuuuguagggaauguuuaccuuuugaaaggggauucuaaguuugauuuuuaagauaugguguuaguaguguuuuuucuaccacuugaagaugugagcaccucaucccauguccccaaaagccaguuacuauuacugagcaaauccuaaucagauuauuucaacuuaaaaaugcaagaugaguaaacaacauaauuauuuucauccagaauuucaauuuuucuuggauuauguucuguagacuauuucuccucuuuuaacuaguuuacaguucucaaggacugaccuaauaauccaucuguaauucuguuuuugucuuuguuccugcuacucucuucucguuuuucauuuuaucauuuuacaguggcaguaaugccacaugccacucauuguagacauuuauagcaacaaugcauauauuacaaaaaugacuaacuuuauuagauuucagaccuacuugaacuacauuuaaauuuaaguauuugaaucaccucccuuuuccccacuucugugauaauuuaucuguaguuguuugauucuguaauaaccaaaaaaaaccucugaaagucuaaucaauuaguauuuaugauuuauucauuuacuuugaugcuucauuuagucauugaagaauaaaaacugugguuaaaauuauucauugauugucuuuaagauuuaaaaaaauuacugaaaguaacaugcuauuaucuaguaaaaaagagcucuucaagugaugacauaaaucucaaguuaacauuuaaaagaaaaaaaacaaggcaucccucagcugcaggguugguuuauuauaaaaauaaaaauauuaucagagcauaguaaaggaguagcaucuuuuagcugauuuuuuucuagaagcauuccucaaugcuuuaugaauuaugaaaauaauucauaauauucucuacuaaugaaugaaauacuacuauugugaauaaagacuauugugcauugaaacauggaaggaucaaaaaacaaaugcuuuuuuauggcacaugaaaauucuauaaaguagauaagaauaacauuuuucacagagguucuaagucacuugaauuaaauacaaauuugaucuuuuuaggcaauuugaugucguuugccuagagagaaagcaugauuuaguuuuuuaaucaaaauuucuuugacuugccuccacauugucgaauauuguaugggacacagugagauuuuauaaaaguaugucccaaauauuuuaugcagcauucacuaaaauauucauuuauuaucugaaauuuaaauuuaacugagcauucuguguuuuaugugaugaccuugugcuuaugcuaaugagaucuauaaaaugacaucuuuuuuucucagauaauaugaagacaguguuugcugucaguguggcaggaggauauagcauuuagauuaauacaaagcauauauuuguaaaaaauuugaaauuaguuuggcuuaauguacccagagguuuuaggaguuuuuaacuaaugaaggguuuauucauaggaucacucaaaauaugccaucugcaaaauaucuguguacaucuuaauauuucucugcugcuuugugacccuacauauuaaauccagcauccugaacauccagagcugugacuguccauuucuuuguuauuaagcagauacuuacugucaaucuggauguuuugugaugaggggaaucaauagaugugugagcuuuggucucgaccuuaggguaauuacauauacuuguaaagugaggcauaugugauuuuaaucacauaccaucugugauuaaaaaaauugaagaggaauacaaggauuuagaauaacgaagaagacacuagauuuauucuuggauugaaucauuugggaagucuuuauggaugcgggggugguuaaguugggucuugagaaauagaggaaaaauuuccugaaugucuuugaaguuuucauguuaaugcugaugaaaagaaagugcauuuaguagguuggaggagaguccaaauuaauguacuuucacaaugacuaaacuuuuauucuugagaaaaguuuucuuuuacugggguuuauuauaaucuagucuuauuauuuggaagugugacauuacauugaagaucuugucaguuauuauugagagacugauacaugucagaaaauaugcucaaaucuuuuagguacuaauuccugaacaaccauugcuuuaacuaucaaauaacguacgugaaacaguaaccauagacaagagcaaaaguauucuauuuugccuucaauauuuuuauguuaauuaacucuucugugcuuccacuucuuuaucugcaaaaugggguggaaauauauacuuuguguuauugcugcgggcaauauauguaaaugaccuggcacuaaagaauauuuaaagacaaucuccaaacaaugauaaagaaaaaaugaauugggauuauuccugacaauuuugugcuuguaguuuauuuuauaaagcugugaauguugacucagaagguguaugugacuuaaaaacuauaacaauguugccauucauaaaaaauucaucuuggaccugaguaugguggugcaugccucuaaucccagcuacucaggaggcugacgugggaggaucccuugagcccaggaguucaaggccagccugggcgacauagugagaccucguuucuuaaaaaaaaaaaaauuuauuugggaauguucuaaaagugcugaauauauacagguauauuaagaguacacuccaagccaacacacuugucaugagcuauuuaugaccauagcugcaugauucuugcuacucaagguguggucuggggaccuuguaagaaauacaaaguauuaucaggaucugggaaaauuugaaauaaaagaagaaacacagaauauuagauucuacccuauucuuccagcaucagaauaugaauuugaaugaaauccccaggugauuuuuacacauuaguuugagaagccuggucuaaauuuuaguauagguuauugaaaaguucauauugcuccaggcuuuugacaguaauguugucuuuuuaauauguuuucuguccuucaguuagaacugauaauauaaggagaaaggaguuguucaagucucaagagcacuuuauagcaaauugccuuuucugcuucaccuagugguguucaauagccugaaagauugagcaguuuaacaguuuacugcuuaaaugucaagcuuuacucuuuuuucauuaauaguaguaagacccagagucuuaagauucugaauaacaauaauaguaagaucauuaccuguauuuuauuaaagccuugggaguuaggagaugucuugugaguuuauucauuaaguugcuuagagccaugauguagcuaguaauacaguuuauggguacuggucccugcguuggugucauuugaggacuuuguuaaaguuaaacauuuagauucucagauuaugcccaggauauucugguucagugggauaagaaagacuuggaaucucuaucgcugagaaagaaacucuuuggguugcaaugcugcccagccuguuuugcaaaccauugcuguagucaguuucuuuuuucucuguuagaagaccuuuuccauccccuguguuuucauuuggcauaucgucaguaguuaacauuuauauaaaauuagaaagguaggaaguggaaaguagaaaaauauaacauuguucugggaguuugaagcccuguguucuugacuugauauagauaaaaugggcaaggcacucuuucuccauuuuacuaucugugaaaugggccguauacuucaguggaacaugagaaccuguagacaugagugcuuugaacuuucaaaagaagugugaauugagcuuguuuuuacaaccuuguuguaauauccuuccguuaaaauguguuuuccuuuucgacauaaaaccugggucucacggaaaacuuaccccugcacuuucuguuuccuuuguacuuuauuccuauccccacucuucucuguguuccuacagcucuccagcaccuguaccaugggcgguuuugccuaggucgguugguucacgagguccucuccaggaugaugacagcagcuccugcugagacaugccaggagucagggaguuuuccuuugggacaggaacuucaaacuagaaaaccuagaagacucagacaccuugucucagggugucauacccugugaugaacucauguuuugggcagggaccuaggaccuuguauauuuaggaagaaguacuaguuaaauaauaggugaagauuauguaacuucaauaucuacugauucugcaaucuagaaauauucuuaagcgaccccuauuccuucaucuuuauucagaaucaguagacauugaaguaacauaaucuuaauuacuuagcuauauuccuagauaugccauguucuaaacaacuuuaaugaauacauucauaaaacauccuuaccucccaagguuuuaauaaaacacagguaaugcccuuacugucuuuguuauuuagaauuugaagauacuggcucugacugcuauuaaugaaaaaagaguaaagcuugacaauuaagcaguaaaaggcuaaacugcucauucuuucaugucauuaaacgccgcuagaugaagcagaaaagcauagaauauauucuacugggccauguccuaaagcaaaggaucuucuaggacauaagcuugguuuuaaaaauguuuuuuuuuuuuggucaugguuaagguacaugggggaauggcaaugaaugauaccaaaacaccaguuuguaaguuuaaacucuugcagaaacaguacggaauguggauucacagagaacagaggggcuuuauuuaauuuuaggauuuauacugauuaacucucauuuauuuacuuauuaugcacaagaaccauaucaagagacaacuuuauuuucauuuugcagaugaggaaacugagacagguucaguaaauuauucgaaguuacuuacauuguagaauacagagccaaaguuugaagcuuaagcauucuccuuaagagucuacacgcuuacaugugguuggucauuucaccaguaagaacugagagucuaccguuugaaaauaauuuugcuuugugguccacaagaauuuuguauuucuuuucauauauguugaucccuucuccuucuugucacccugguauuuacagucuugauaucuugaaacagaaucacuaugauucuuuggcauuuuaucacuggagcuaccaguuuugguagaagugucagugguaauuuguaguuuuaauuuauaggcauggauuucuuuagagaauucaagcagagaucucaccaugucaaggaaccacaaauaugcuaaaguggacagugaguccauuauaaccaucuuggggugaaaaucaaucaugguuuguuaagugcuuucagaaguuguuguugcuguuuuaauuuccaugacucaauauauuguguagaauauauucaguaggguaauuuuggauuuauguguuuaucucccguuagauuaaacuagaauguguguggguuuuuuuuguuguuguuguuuuguuuuguuugagauggcgucucgcucugucgcccagguuggagcacagugucgugaucucggcucacugcaaccuccgccucccagguucaaguaauucuccugccucagccucccgaguaacugggauuacaggcucccgccaccacacccagcuaauuuuuguauuuuuauuagagaugggguuucaccauguuggucaggcuggucucgaacuucugaccucaggugaucugcccgccucugcuucccaaagugcugagauuacaggcgugagccaccaggcccugccuagaauguguuuuugauaagaagcuuuuguagaugagcuccacagagguucuagguccuagauuuuagguauugucuauugucuuuuguauucuuaguccuguuuuugaauuuucuggccuugacauugguggcaagauuauuccucuuguugauaaucgucuucacguuaaagguuaggcuguuuccacuugagggaauuaauuuuacuauugugcuuuuauggucaauucauccucccauuauuugucauuuguuguauauuucuuuacuacuuaaacaaugaaaaaaauagggaaaagauuggaaacaaucuucuguaaaaaguaaauauggauauuuacucaacaaaauguaagcucuuguaugcuacauuaagcacucucaacaaauacuugagauuuuguuucauguuuuauaccuuugaauuuuccuuccauaaaauaggaacauucuuuuggaauuucagccaucagacaugucuuauaaaggaaugaaguuauugauaaacauuacagccccagaguaauuaaaacaugcauuugagcaccuacuccccagcugauugccuuccuuuaccuuugacgagauccccugucccuaccaugaccuacaaagcucuagauaacccuucaagcuugucaguugacauucuuccucacacuuauuccucuaaaaccacaauguccucuuuucagugucucagacuagcuagaauguggcuuccuuuccccuuccucauccuccaaggauagcuucuuuucacccuuugauuucauauaucucccucagaaaguccuuccugauuaccuacgcagcccuuuauaccaauuacuauccauuucauucuuagcaccugucacucuuuguacuuaauagacuuauagucaugugaaacuuccugucuagucauuccugacgagacucuaagcagcaggugggcaaagacuauauaucuuuuauucaccaauguguacccagugccuggcaaggaaauauuuugaugauuaucuaaaauuacauguaugaguacauaacuuacaguaucuuacagcuuuaaguaauagcucacaaaauuuauuuuguuacuuuaauuugguaauucauagcaaguuauaucagggaaguagaaaguguuucccugauauuuauuuagacagccauacacaguuuuuauaguuaaacaaaauaugacuuuuuccacaucacuuguguaucuuucggguaugcuuuuuacagugcaauacuucuguucuucuuuuuuaaucaaauauuugcccuaauguagcagucacuguucucucuuuaacagcagaagaugguagggaauuugauaauaaaauugucuuguuuuaugccauuuaaaaagaaaacacacacacacccuuuuaaugaauauauuuguaaagccucuauuaugguguuugacacucaacagacacucaauuucuugaauguguuuacguucucauagauggauagaauuuguuuagagaaaaaucauggguuauaaauacaucuuauuuucuagacuuuacagaucagugagcaauauuuaauucacuaaauggauuuaaauuugaugauagaaaagaacacuuuauuucuuuuuuaaaaucauuuaauaauuugauaaugauuuauuauuuuauauuuaaauuuaguuccuuuuaauauauggaaaagcuguacaaagcauuucagcauuagaaauugaaguguaucuacagggggaaaaauccucaauuuaguuuaaauaacagaaagugaaaagggcauuuuaaaucaggugugaaaacuuaagaauagugacuuaaaugauauaauucaugauuauccaucaggguaaacugcaucuaucaaggcaaaaugaacagaguggggcauuuaacaguaauucaaacuaaccaguuuuaaugcuaaucaccuggaauguaugcgcacaagcacgagcagcgugcgugcgugcgugcacgaugcgugugugugugugugugugugucuguguuauaccuauuacugcuaauauaacaagggcacuuugaacucuuuauauagaacugaaaaugccuguuaauuacauuccaguuuugggguguuaagaauauugcauuucuuucuaccuacuauauugcaugaguagguagaaaauucaggugcuuaaaggcuauuaaaaauaaaacaacccuucagaacgcugucuuugcaguaacuguuuucuucuucuccaggagagcacacagcugcuacaaaugccgucagugcaguuuuacagcugccgauacucagucacuacuggagcacuucaacacuguucacugccaggaacaggacaucacuacagccaacggcgaagaggacggucaugccauauccaccaucaaagaggagcccaaaauugacuucagggucuacaaucugcuaacuccagacucuaaaaugggagagccaguuucugagaguguggugaagagagagaagcuggaagagaaggacgggcucaaagagaaaguuuggaccgagaguuccagugaugaccuucgcaaugugacuuggagaggggcagacauccugcgggggaguccgucauacacccaagcaagccuggggcugcugacgccugugucuggcacccaagagcagacaaagacucuaagggauagucccaauguggaggccgcccaucuggcgcgaccuauuuauggcuuggcuguggaaaccaagggauuccugcagggggcgccagcuggcggagagaagucuggggcccucccccagcaguauccugcaucgggagaaaacaaguccaaggaugaaucccagucccuguuacggguaggaugguuucauuuuuaaauaauucauuuguuuugaagggcaaaaggaggaacacacauucuuucucuacaggauuguguugugugugaagugaaacuuaaugaucugucucaaucuggggauuuauacuccuaaggccaaaguggcagcaaguaacucauguguguuugugugugcugugcacuuacuugauacaguguuaggcagucacuuguuugucuuugcucuuagcucagauugaauguugguuaaucauuccuggugacuauacaaaacaacaaggccauauuuggagaagggagguuuagaaucccagaaggauguacaucugcuacacugaaauaacuaaaugacuuuuaaauuuuaggcugcuaugacaauauaugguuaauaaggaagucagaagagauuuaaaucacuaagaauguaauguccuugaugagauguucauaccaaaauacggaguuuuuuaaaacccacgauauaauuauguauaaaugacaaugcuuguuguugucgaguugccaacaagagggggaaaaaugagaaaaggcuaagugugaauagugugaaaagcggccaaagaagagugccaugcauuugauaugaacaggaucuuuuagggggaaagaccuaguuccauguggaaaaagaaaacaaaaccucugaguaagguaagauccucgauugcucucuucauacuauguagacucagcauuguuaaaaaguauuuuagauuuugaaaauucaugagcucccaauaagugauaguugcucgaugccuaagacaccaccucuuggacauuuuaccuuaagucugugaaaguuuugagcuucucuggaugauuuugaagcuuuguuugugcauagaagguaggaucagaaaccagcuaaccuuuacaaaagauccaguugggaaauagaguuccauuagccaggugcuuugaccugcgggucauagaccagugaguucucucuggauguauucuggggagaaaaauugcucuucccaaugucugcuuggcugcucugcucucauuuccugcagauucucugaagccuaucugugcuucucaguauucucuagcggaguugaaaaacgccccuuagaggugcacaguuaauuauagaagcuguuagcuuucccaucuguagucaugcccuggagcuaagagaaggacuugaauacagaagaggagaugcccccuguacagagagaaacaaagaauccuuccugcagggaagaagcaaguuuauuaggaguaacuucgggaaaaaaagagaaacaguuucugugcccuucaagaggggguucaauuuagggaacuccccuccagugaauauacauggagcugcauuuuuaucauugucaauauuuguuguuuucucagcaugucauuacucuucuggccucaagugacucauggcuucugguuauaaggcgggaaugaaauguccuauguuuuauuaaauucauacugcauuuugagaguaugguauauuugggggccuuauaucuauaucaccggaaccccuuuccuuccuuuuucuacuuaaaauugguuucauccaugacaucuucauuugacaccauauuguuugacuguuucuggaauauuaccuuuucugccauuguuuauauacucuaagacuuugaaaugacaauuuauuaagcaaugguauaaaaaaccugagcguagugguugcauuuuuugagcaagauggagauguuaauacuuuucuaaaaaguuguuuuucucaauuccuccacuuccuuaaaucccugauuucaaguuucuauugcaucauuuuaacagccuuuucaguuccuccacauuagcugcugaaguaggaaaccuuaaacaagagauuccuuagcuguguucuacaauaauagccaaauuccaacccuaugauuuauuaucuucaaaggcuguaaucuacuaaauuucagagaucugauaaaauuacauuaauauauacaaauacaugcauaugcauauauaaaaggaagaauauugaaucauucugugguugcaauaaaauuuaaaucuuuuaagauucacauuuuauauuugaauagugcuuuuggaaaucaccaauuuuacuggauauuuggaauaggaaggguagccaauuuaauuuauugggcaacauuuagguuauuagcuguauaugaaauuuucaauguguacauaucuuagaugaugagcuuuuuaagacaccuaacagaauuaagaaacagcccauucucauugugaauuugacaccaauucuacuuuggugguauuaguugguauucugaaauuaucauaccgaauuaccuaccucuaauucauuacccuaccagugguagaaaaaaaaaaaaaagcagaauuuugaggucauguuuacuaaaggccaaaaaaaaaguacuauaaguuuauaguuucagaggcauaguuauuagugaagauguccuguaauaauuuaaaauacaccauagaaauauacagauauaauuuacauguuuugaacccaaauuacaguaguguauaaauauaugccuacagaaugcauguuuauauuugaaacaauaaaauagaacuugaaaguaacuacaauuauucagaaauuguaagcaauuuaagaaauguaaacuaucagauuuuaaaaguaccuuuuuaauuaaauaguuuuuucaauauagcauuaauagagcaaguauauuaauacauuuauauauacaguuucuaauacuaaaguaaaacuuaaucauuuaaaaauacuauacagagugauaucaagaauuaaguauggaaaacuugcccaacagaaaauguugauuuaauauaguucaauacuaugcugguaaauaauggaaacauuuugaaauaaaaggcugaauguaguuaggauuguguuacaaagcacauaauuaaaauguugcuuucagcauauuagucuuucugauaacuuuuuuuuuuaaacugguuuuagcaaugaaaguuugcuguacuucucaaagugaggaaggaaauauaagaaucacaagaagagcuaaaauuucgaaauguucucuucauuaacauuagugguuuucuccuuuuuuuggcuuaugucagggucaguguuuggcuuuuaguuuuguguucaauaugauaucauuuauguauauuuuuauuuaguaaaugucuauauuuuucccuuguuauuaguauggaauugaucuugauauaaaaauuuucaguugcauaugccucuguguugacuucugugcuuugaguaugacaaaagccacauugccauaaacuugaucuuauaaauugcucuaggaaaacuaggcuuuuuuuugcauauuaaucacacaauauuucuacaaaauuuuugaguauuuucuuguguuaguaggaagaaguauuaagggcuuuagaaucuuugcuagaaauagucuaagcuuauaugacaacuuuauuaucuuaacauuucuagaauagaucuuauagaacaugaaucaccuccugaaaaugguuaccaacauuuacuaauaauauuuugaaaacccaguguuuuuauuuaaaguuuaggucugugaagagguuaacauguuuaaaauuaccuguaccaacaguauaaguaaauuauuuuauauauuccaauagauguuucuuaaucauuuuaaacuaaguaguauaguauagucagcauucauguaaaguuguauacuuuucugacaaguuuuuuuuuuaugauguacaucuacacaaagguauuuauuuuuuagauaaauuuaugcagaugcaacuguauuaauuuuauuguuuccugaauaagaaauucuggauuuuauuuuuguaauggaauuuuuagauuggauauuccauugcagaaaacuuggcuuuuuaucugauaacuacaugaauaaggauccaaaaaucgaucauuaaauuucacaaaaaaauuaaccaacauuguguaguuuuucauuuguuaauaaaauacggaaguacaguuaagcuuauugggugagucuuuagggggagcucauggaaaaucaacauucagguaaacuccuccauguuauuugucaaaacggaauguuauagauaacuuguagcucagguucuuccauagguucaaaugcuguaguuauuagagcacuuuuuucuugcagcuagaggaaagauaaaucuccuugagauugaucuugguuuccaguuuaaauuucuuuagaaaagucugucaguuguaacaucuacauuuugugcuacuuggcuucagcggagaugcucaaccaugggccuggggaguugaguuccaaguucuggaaguugaguuccaaguugagccacugacuuucaaaggaagggccucccaggaucuccguucaucugucgcuuggagaggaucaugcugccugccacccucacaggaguguugugcagcuuaguuaauuaacguuugucaggccauuugagauccucagaugcagagugcuagauaaguggaaauagucugauuauuuguucauuuuguaagugugauaccaggacaguacaaugagaauguuauuuccccuuuucuucagcagcguuaaauuuauaguuuaaagauuguugauaccggacagacuauugagaugcaaaaauguucuuuuggggacaguccauuggcagccaaacagacguuuaaacaagugacaauguugaaugccuuuacaaccacugacagaagacugcaggagcuuuuuuuuaacuaaagauggucugaagugaaaagugauauucauuguuuugcuucauauuuaauuaaaaugaaagcaaaauuccaguuaucaaagagguagcacugacuuaauguuuauguacauaacuguuuucucacccgauuuggacuuuuuacaugugcauaaguaaaauaccaaagagaucagacuauaucaggaaaaaugggaaguauauaccucucuaaacacugguuaugaagccaugacuuuaggcccuguugguaguuucucuuuagguagcaguugauauuuucuuugccugagaguaaaauaaaugauuaaaaacuauugacuauaugcagagaugaaaaauccuuguacaugucucugcuucugugccauauagauguauuucuguugacaucuauuugaaaaauauaugauuuaaacucaaauauguuuuaguuuagauuuuaaaaauacaauccauguaucaaauucauuauguguaauagugaacaugacaguucuguuuuaccguguaaaagugaaguagcuuuuucuuauuuauugauuauucaucuuuuacauuuauauaccauuuuugacaguagaaaguugucaaauucguuccauauuccauagguauagaaguuugguuuuauuaguuugauuaaugagauuuuuaagcaaucuaauuucuuuucuauaagucugcuucauuaacccacacauuuuuuaaagcacuuuuuuuuuaaugcacacacaauaauuguacauauuguggggaacauagugcuguugugauacauauaaugugugguggaaggauuaggguaauuuguauauccaucaccucaacauuuguaauuucuuuguauuagggacauucacuauuccagcuauuugaaacuacauacuacuguuaaguacaggcguccuacagugcuacagaacacugaaacuuacuccucccgucuagcuauaacuucauauccuucaacaaaucucugccuauucucccuuucccccuacccuuccuauccucuaauaucuucucuuccguuuuugguuucuacaagauaaauuuuuuuuuuuuuuagcuuccacauauaagugagaacaugcaguguuuaacuuucuauuccaggcuuauuucacuuaaaauaacguucgccuguucuauucacguugcugcaagugacagaauuuuauucuuuuuuuaugacugaauauauuccauuguguguauuuaccucauuuuguuuauucauuuaucugucguuggacaccuaggcugauuccguaucuugauuauugucaauagugcugcagugaacauggggguacaggugucucuuuaauauacuaauuuccuuuccuuuggaaaaauacucaggagagggauugcuagaucauguauguagcucuguuugcgguuuuuuugaggagccuccauacuguucuccauaguggcugcccuaguuuacacucccacccacauuaauagcacuugaaaaacgacaacaacaauguuuuuguaaccuaggcuguuugugaggucuggcauaguucugcuggcccagguuucuaaagcaggugaagcagauguaucuuagugaauuggacuguagguuugcagcuacugugaaauguuauccuuuagugcaguaucuguucauuauuuccuauauaacuaucuuuugcuuggcuucucuuuuccauggacugcaugagucaggacauaacagggcccccaaaagaacccauuguugagcauucuuagauguuggaagugaagaguauacagaagguggcccaaguuucaggagcacagggccagaaugauucaaaaaugagguauguaguguugaugugaaucugguaauuuuccggcagagcccagucugauggguccauuuuacaggcacauuaauaccuaaaaugccacaacgagguuuuauuuuggauuuuuggggauuuuguuauuuucaccaaaaagguaaauauuaucuccauugucucucauauauauauauauauauauuuuuuuuuuuucuucucucccuuccauuagauacuguucaaaacuuuccuuaaguguuuguaagcaaaggcauugauuaguagacugcucugcuuguuaacucaaggaagcuuggcaagcuagguacugcuguaucuaguuguguuaucaguuuaaggaaaggcaaauuguuucauugauguuugaagacccuuuuuccuuuuggagaagcaauacuacuuauagacuuuuauuaugaacuauaauuuacaaauacaaggaagucuggaacacagcuuuauaucagugguuaggagugaagcaaaggaaucuuaguuuuguuuuuuucugaugacagcacacuugugauaaauugagcguuuggcaucauuguucaucucagaaugauuaaaugccucccucucacuuguaauuuuauauguuaacuugccucuuuuaaacaaggcaguuucuuaauuuugaagaauuacuuuggacauauuaauuaggaaaaggauaaaccauuuucuaccauggaaauuuauauauguguaacaucaugaauaaccagaaaaugcuaaguauauacacuauagauaucuauuuuuaaaggcaaaauacacuuuauaauuuuugcuaccauuaaaaaagguacugauuaugaaucaaacuuuuaugagaauuuagguacaaaauggaaaagauuuuuaaaauagauuucugguuaaaaugauauuuugugugaaggaagugauaagaucccugacaacaugauuuauugaauugcauuugccuguaguguuacauuuaguuuaaauuuuuauacaagacugaugcuugaucauaaaaaaagucuugguagacaaagcacauagaaucucagggaauuaacuuucugauuguagcuauauacauuggguaacacaagaauaccuguuuguagguguuaaauuugaauucuuaaugaagaaaagaaaaucuggugaaacuacuuuaaaacaauuguauaggaaagcauuacaaaaaauauuugguuaaaauagacggauauuuauaacugguugucaauuuagcauucaguuucuaggauuaagcuuacuaccuuuccauuaauuuauuacuggauggauuccuuucauccucaccagaacucuuugagguugaaacuauuauuauccccaucauuuaaaugaguaaacugaggcuuggauauuaaguauuuugccuagaucacacugcuuauaauggcagacauuaaauucuagcucuggcaauucuagagucccugcucauaaccauugcauagccucuuuugguucaauaugguuugcuaauaaauacuugggugacuuucuacaguuucagaauuaauuuguuucaucuaagcauacacguuuuuauguguguauguacaaaacaaaauaccuuuuugaaauuacauaagugauacaugcuuauugcgaaagaguuggauaauacaauauacuguaaagaagaugaaaaccacucauaaauuccaaccuguaaauacuuucguguucauauuuuggcaucuaauguauccuuuauguauauuuaaauauauauuuuauucaaguauaggaucauguaccucccuguuuuauaauuuucuuuuuuaauuuuucaguguauuguggacaucuuuucucaucaacaaauacaucccacaauguucauuuuugugccucauuauaccauggaauagugacauccuaguauguuuaagacauuccuuauuaaugaacaauuaggcuacuuccaauuuuuaauuauaaaggacauuuugaaggacuuccuuguacauauuauucuauugcuuuaucaucuuuuugggauaauuucauguaguauauuuccaguuauuuaaaugagaaaguacaugguuuauaacaaaugguauuuaacguccaagucacugcuaucuaaagggguaauuuuuaagguauaaaauaauuuggcuuauaaaaaaugcgugggaaaaauauccuagaaauauuuaaggauuaacuucuaaauuguaaauugacauauuuaaugauagauucaaaaaauuaggagaaaagcaaguggcaauuuuaucacauauauggaauacaguacauguccgauacaagguaaauaguauaauaagcuuacuuuauauugcauaugcaguauaguuuauucuuuagagaaauugauuuguaagaagaacucauuuucuuaagcagaguugagucaaggguuuuaauuaaaagcagucuacucaggcuuugccuuucucgggcgaauaauuucucucuuuucucugcuuuugcuuugccuccauggaugaugcuccugcuacccuucacgcuuugucaaaccaguuuugaaguuuucgccuucccccgauguaugucgcauguguggguaauggcaugggcuuugagggaguacaagagaaaagaauugauuucucuuuucuuuaaaagauggcauuuaauuaucuuuguuuuuauuuuuuugcugaaauauauuaaaugcacauugauuccguuaaguauuuuucuuugauaaaguugucagaaugucagaauaugcuuuuuuucuguuauugaugcauaauauuucauacauuggugagguauacgugggaauuuucugcaaacauagaauaaauaauggucaagucaggguuuuugggguauccauuaccuugaguauuuaucagaauuucaaugugcugguaacauuuuaaguccucuguucuagccauuuugaaauaugcaauauauuauugcuaacuauagaauauuuuuauuauuuuuuaugaaaauuugaagaagcaggggcaagaauacuuucugaauuaacauugcauuugugcuaccuauaugcuaaaaaaacagauucucaggccacucuuaaccauacauuuauaaaaagauguaugauguuauuuaugaauguuuaagacaaacaaguuaagccacucuucuauauggaaucuaaaaauguacaaacacugcauuugaaagagacauucacuuuacuuaaaaauaauuauuugcuauuuuuuuaaaaaaagacucagagugggacuuuugagacauccucuuuuguacauugaacaguggaaaaaaacuuuacuuguuaacauuuuagaaguauauuuguuugcaaaaucaugguauaauugaaggcaauacuggcuauauuuuaggagaugcacauauuuggcuuaucuaaaucuuagugucagaaauugccuaccugaaaguucccugguaauauagaaaaaucuguccucuuugccugacuuacaaacuaauucuaagaagguuggauguuuuuaaaguguaaauugucuggauggacaguuuguggucuacaaauuuauuauccagcuaauacugucauaacuuuaugcugugugacuacugaguguuuuugaguuuuuaaaaucagagcuuuccucaaauucacaugugauuaaaauauuuuugaagagucuaaaauauauacuaaccuuugagguuccagcuggguuuggagguagguaugcuccacauuuaacucuggcugugguucaggccugccuguauuuuauuuucugguaaaauuagauguuauuuuuucuuuuugcucuucccuugugauguaguggaaagugcucuggauuggaggaaaggagacuuuguguucuagauucacuuugugacuaacuagccgugugacccugggugagucacucaagccucauauacuguuuccugcuuuggaagauuauaguuugaaguaugcaguuucucaaaucucuuuacaauugcagagucaagcaaaucuagagucaaguaaauuuccuuuaaaaccuuaaacauucagaucuaugaauugauacccgaggcaacuuuaagacaaaaucuuauauuuuggacguaaugaugcugauguccaaagaucuagaucuauaucuauaucuauaucuauaucuauauauauauaugaacuacaaauucuuaaauaugauuuccaaccaguggcugagaauccauaaguuauaagcaacugucacacauacagucugaaagcuucaaaaauuguauuauuugaacuuaucuuguacaagaaagcccauucuuuggaaacaacuuugcugcaaaagaaucaugucaaggggcugcugaugaaugaaguuaaaggaaaguaagcacaaugagaaaauaauucuaugagaaagugacaugcuuaaagucuccuuccucaguuucuuggcauugagcgaugaugccuguuuuguucacagucagauguucaaaucagaauuuuggaugcagaaacuaauuuuaguagguggggugcaaauuucuuaugaguccaugaauagacucuaaucccagcuguuucauuacaauuauaaaaauaaaauuggcugugaaucauucaaacucuguuuaauggaugugaauaauucaguuucaucccacugaaaucuuaaaacuauaaaccuaucuuuguucuuuauguuccuucagagaucauaugucauuacucauauaugaauuauuugaaguaugggugaucaugaugaaagugaccaaauuucuacuuagcuccuguggguuucaggagaggagguggccucuagggugaggcuagggauuaaguggagaaacaaauugggaaaaguccaggaaaagagaaaaggguguuaaauuaggauuucuuggcauuaucuuuccuaucaagauauauguucauuauagacauuuuagaaaauauaaacaagcaaaaagaagaaaauaaguuuucaacguuuuuaauguauuuacuucuggacacagacacacaggcacaugcacacucagacaugcucacucacacacauagacaugcaccugcaaacauagauuuguauguuuauuauuaaauaacuuuuaauuucacuuucuaauaaauuacacgcuguuuuauagcagcguauauucugcuacaucauauuuauugacuucauaguauuucacuauauguuguacuaguuguccuagaaaaacugucuaucgauuucuuauuguuggacauuuauuucuauuuuuugcuauuaucaauagugccacuuuuaguauguuuauagcugaauaauugcaacuugcuugcgauuuuaaauuuugagaauuggcgucccaacagucaggcuccucuaugggaccacacaguaguagaguuuauuggcaagcauaggucacuuuaccagaucauguauauagacuccugagaaacaggaaaacaguauuauuucuuggcuuccauuauuuugaauugccuugcagugauagcuaagaaauagaaacccugaaguuuuuuaaacauuauuauaguggaaaaagugaauaugauuauuugaauaaggugcauuucuugagcagcagcaaagaaucagccagguauugauuuuacuuucauaauugaaagauuucucagucacuuggacauucagagaauauuucauaggacaaugcacuuauaaaguuauauauauauaugggauuuaacugccuucaaaacauuucuuaauaugucaaauuucuuaauguguuuuggugagcacaugaaguugaugccaguaacuacucagugaaguguuuggugcacaaacugaauuuugaaauauuuaaauuuucuuucauuugcuuacagcuauuuguacaguuuauuguaagauaagaaugaaaaucagguguuaaagcaaagaguacaaaacuauucuauguccugucucuuuucaguugcuucuccaagcauuagacuucucuaggcaaaguccuuucauaacacuagagauucauuauauuugguaguucaugaaauuuuaacaagacacacuucuguuugugggauuggaaugcguguuggugaguguccgaauuuaaauauauugguauucauauggauucaggauuuauuuucaaagaacagauauucacuagaccaaacuaaccuguacucaaacuugaaagaaauagaaauagaaaaagcagaggauaacuuuguggaguuaauuccugauauacuggucucuaaaguuucuuguuguccgauaaauauuaauuuagcaccugcuggguuucaggcaggaacuguggaagaacuuauaaaggguaugaaaaugaguauaucaagauuucuguacucaaguuauauacaguuagcuguaggugauaagacagguauggugacagcuaaaauacaaucagacuuccauaaaagaggugaagggagacgagaaugauuaugauuguuuaaagaggaacagaucacauuguguugagaaaaccgacuuaguugucccaaaagguuuucugagcuuguuucggaaaggaagacuggacuuuuagcaggugaauaugacagcaugaaggguaagccaauauagaagaaacaauguaagauuacaaggggcauuuucaggauauaggaaagagaaaagcuugaugaaaaguuagguauaguauaguauggggagcuaagacuugacauaaagguuaggauaauuuucuaaaauguuuauuugaaaaacuuuaucucagaaggaaauagggaaccauuccaggauuugggcaaaggauaauuugaugaaaccuuuaauaggguuaauaugaccaucuuacauagguugacauggaaaggagguggacgggguugaggugacgaagacucauuaguaggcugaucucuuacucuaugaguaauaacagggagccuacacuaggauaaugauguugggaagugauuucuguagcuaugcugagcagacagucuucaagaguuagcaaaguuuauaugugcgggugacaaaaaagaggcuuugaguuuugaugacugaaaggagacaaauaauagcuaaucuuugauaaagacuaacuaugggcaaggcuuuacucuuuguuuguaguaacuuacuuaauccucauuauaaccccuuuauauagaugcuguauuuucuccauuuuacagagaggaaguagagccucagagauguuaugucacuugucaaaagucacccagcuagugaauggcuggaucaaacuggaucauguccaaguagccuggcuucaaaguucacacgcuuuacuauauuuauucuuuuuuuuuuuucuuuugagauggaguuucgcucuuguugcccaggcuggagcacaauggcaugaucucagcuuaccacaaccuccaccuccuggguucaagcgacucuccugccucagccucccgaguagcugggaugcgccaccacgccuggcuaauuuuguauuuuuaguagagacgggguuucuccauuguugguuaggcuggucucgaacuccugaccucaggugauccacccaccucggccucccaaagugcugggauuacaggcgugagccacggagucuggcguauauuuauuuucaguguaucauuagcagaauucuagagucagcuguucugugaggguaaaauaaugaagcugguuuuguacuuaccaaguuuguaaggcauucagaugaaaauaucuaauggauagcuggaaacguaggcugucauagggaauagaggaguuggaaugacuuccaaauuaacuaacauucauuuaauaauugaauauaaacugaaagccuaguuuguucagaauauuauaggagcagcauuaccaugacuaagcuauagacacugauucuuuaagacuuuugcaaaccaguagcaaaaauaauguucaauaaaccgauuacagcacaagaaaaaaagagugucagguaccacagagugagaaaaaacaacaacaauaacaaaaaaaaaauagcaaaauguuguagaaauuuaaaaaaggaaaugaccccuucucaauuaaucuaucaagacaguguuccagaagagguugcuuaucaguugguucuugaaaagugguauuuggaaagcuuaagaaacauaguacacuagccuacagagaaucuaagcagaaguugaacuuuucacuccaacuaaaaaucuauguuaaaaaaaaugagugaggcccccucugcagugaaaguuacuauuuugacauuugugagaucaaauuuuaagauccucuggguaugucaaagucuuuucguaauugauaggauucagaaacaccacaaagacaugcaugcuuuaaguaucuuauuguaaccagcuaaacuaaaagaagaguacguuuuagaacagaagguggguauuuaaaucaaagucuaaaauaaaaauuuaauuguuuaauuauguaaauaacuucaaaacguuuaucuucuuuuaaauauauaaauauauauguaggguguguauauauguaaauagcguuuauucagauauaaauaaaaaauagcccuacuacuuagggucguauauacauauuaucaaagaaaaaaauauacaugaaaagauucuugaauacccauuuaaaaaugaaugccguauuuacuaugccuguuggauagauucauuauauauaagaacuaucaaauuuuaguuuuauguauugguguucugauuuauucgcuaaucauuucucuuagauuuaacccaguggcuuauuuucaagucuuguuuaaugucuuauuuuauaauugaggaaaaaagagaaaugcuugccugugauauaucaccuguuguuuaaucgcuaacacuguuacauaucuuaauacuguaucacauuaagucauuuuaaaagcauucugcuuucccuuuuguuuaaaauuccuacgaucccugggauauugguaggggguuaauggaagucuugauuaaaaucuuccaagcuuuaaggcuuucaguucuuguaaacaauuuggaucugagagauaggccuauuuaugacuuuuuacuagccuauuuacccauuuaauguuaagaaaaaaauaugcuuauuaaaaguuuuguuauaauaaguacaaauuaaaaugucuuuuaaaaaaucagccacacuucguugugugaugaucacagaauuuaugguaguucuuuugaaaauugucugaagauguauuauaaucauuuuaaaaguaaaggaacuacccugaguauaccaauuuuccauuauuuuaaacaaaccuuuuaaguuuuauaucuagauugcuuuuaaguaguuauuuccaaacuugaaggacuaugaacucuaaucauaaucaaucugcacuugugucauaauagcuaaccuaacuauauagugggugaaagucuuggaaauagguaacaauacaguuggaguuuacacuugggcuuacaggcccaguccagacgauugauccaguggaccagcccaagcuagucugaccuuucuuauggcuggcaacacugacugcacaguauucugguucggucagaagucuugguuauucuauuuuuaaugaacagacaugcugaguuucaaacauggugguuuugguuuacaugggauugaguuggcaugcauguaguuuccaguucuuaugauuuuaagguaucaauuucauggcaauguugggguuucugugauacucccugggcuugaaauugaaguucauugaagugugagugugugugugugugugugugugugugugugaguguguguguguuuuuuuugagguuuuuccacuaaaagcaaggagcuuuuagacaaguaugggacacaguagaacaaagauaugagagauacugcaaauacuaguucuuuuaauuuauccauuugcaaauuuuccuccuuuagcagacugagagcuccugagggcugugcauuuuuauauuuuuguuucuuguuggcccuguuauacugcuaaucuuuuaggaggucuaaaaucaauauaucuuuaauggaauagaauuauaugaggaaauaugcauuuuuuaaaauuuggaaaaccauauuuuauuugcuguaugagacugccguaccgccuguguaaauuuucuaccauuaagauuauaauuauaaauugauuauuauuuguauacucuuuuaggacugaugaauuaguaaauuauuacuuugugcauuauuuccaauaaccuuuaggguauaagauuaucuagugaguuacuuacucuggaaaaaaucaauuacagcaauuuaggguucguauaacaauaaaaaggauuugagcuuuaauggaacauuuuaacacuuggcauguaucuauaucuacauauauaucuauauauaucccuuuuuucugaguuaucuggugaaacagagauuucuuuauagaauuuugugacacaggaaucuagagacacaaucugccagugcauuucuagguuuuaaaaguuucaguucaaaccuaaaaagucuauuuguuaaaucaugacuccaaaauuuauuuuuuauauaccuucuuuuuuuaauaaaauugacucuagguucaauuuugguugaacuuaaucagucuucuuucuacacagcuauauuauuaguuuauauagaacacagugcuggcaaguguugaaacaaaaaugugaagaaugauuuaccauaccaauauacugcuuccuucuaaagaagggagauauuuuagaauauuagauacugggcucaagauaaccagaaauguguaaugggaccauuuaucuauaucauuuuauggccaagucagagaagcaaaggcauauagcccagaaagugugauaagaagaagagaaagauacuaguagauuauuauuccuuaagucugcagcaugacuuaacuagagacaaaccuggauacgagaacuugaaagcuuuugugaacucaggaaugcauaugauguuuguacuacaaacucaaccucaucaucuuaaucucuuugccuagaagagaugaauaaaaguacagguuauauuuaugaaacugaaaucuauaaaggcauggagcucuuuuccucaagugggaauucuuguguguuuauuugacccuuuagcaaauuaguggaaguaaaggagggagagaggguauagcuguauggaaauaaagcuggugaaguauucugcucuucuguucuucuuagucuugauggugaaccaugccuacacuauacuaucacucugguaccagauuuauugccugccaggauuggaauucaugcagagaggaaggauucaugaaaaaaauaaucaaagucaggaaagucuuuuucuguaaucuugucucauacagugaguuauuuuugucuggguaguuuacggggauguaacuccuucagucaucuaaccgugauguaguaaaagucauuugcaggaaaugaaacuccacuuuguuacuuuuuucacuuaaaggcuaaucugauuagcuuuaaaacauuuguucaucuuuuaauucaguauuuguaugaugccuauggaagacauauggauuuaaauagaacuuggcuaaccaucugccaauaagagaaagugagaugcuaaaucagagaggcaggaaagucuauuucaguaaaagcuauuuugaucugaaauacuguaggcagucuuacagaguauuuuaauugggaggauauugaugcaugcuaguaaaagaaguguauuugcugauaugguugaaguuauguaaucauuaaauuucuauauaaguuuagagauguggaacuaugugaaauuuugauccuguuaauuauaauuuuuuuuccuaaaaaagccauuuguggaaaaaaauuuucugauauauuuuuuagagcaguggcacguuuuauaucucaugccagaaacuagagcauaaaauaucaacuuuucaaauaaauuaacuagaaauaaagaacaauuuauucagugcuaauuuguugauaauuuuuuauaguaaacuauguuuuaaaaauuuaacuuuggggaaauuagaaagaagaaaaagaauaucuuuucucaugaugguaaaaugcugauguauaaagcugaaaaauuuacaauuaugucauauuuauguuuuaauuuaaaauugugagaguuuagagucauguaagcauuaagaaagauaaaauaucugaauuauauauauuugcauauaugugcauguauauacuauucaacuuaaccuuuauaaauaagccuuauuuuuauuauucagauuaauuguucauucuuauauaaaaugugucuggcauuugguuuuugcugggggaguacaauaauacaugguaucugccuucugggaagaaguacaguaaugggucaggaauuaggacagucacugucagucacagucaucaucucaguuaauccuccaaauaacauuaugaugcugggcauugucaacucaauuuuauugauggcacuaagguauagaaaaguuaaguaaguugccccaaaauaacacaacugguuuaaaacucucaguaugagagguguugaaaccauagccucuuacaacuagaagaucacuguauucaauacucuaaucccugauauaucaugaaugcugaaagaggauuuagacucuacuacacagacgcccugaaagagcugcaggaggcacagggaauuauauuaacauaguggauugcacguuagggacagaaauggaccaaggagcacaugagaaguccacauugauagaggugccuggcaugggcuccccuucucugcccagaugguguuggugugaccugauggguggcaccuucuugacaaggauccuugcuuuagauauuuggaauauuuuauguuaucaagcuauuuagaaauuuuaagucacugcaaaagugcucauuccaaauucuguuucuugccuuugucuugaauccauaucugaauauuuaggaagauuugguauugguauagagagguaucaauuuggcaaagauccuucuuugccaaauuccuggaaguggaauugcugugucaaggacagugcaccugaaaauguggacagguaaugccagauuuccccaccccccuuucuaauaacagugaaugaccugagaaguaauuguguccauuuagaauuucauuagauuacgauggaaaugaagguagaaaugaagaaucaacauguggaaaaaauaugucuguaacuaggaauugauguacugaguuuuucuguccauguugauuuauuauucccuugauggcauuuuugagaccaauuauuucaacauguggugaaucuuuuuauucaucugucucucuguaucuggaacaaguauaucuuggauauaccugaggccuaaaacuugguguuaaccagacuuuccucucuaugguguaaacugccauaguuggcaagaaauauuccagggaaagcaauguaaauuuucucaaaugagaaagaugcguggguuuauuuaggauaaaaagcagagacauaaaugcuacaaacauauaugguauuagaaugauuauuacauuuauccuaucagguuuugaagcaguauuauugccuuaguuucuugcaucaauuuuucucuucauuuuuccaucuuaucucuuuccuuucacagaaugguuugaugaaauuauaggcacuaaaccauuuuuaauuacagaucucuugaaaacauaucaucucacuaaacuucgaggcaaaaugaaaaugugugauuaucccaauuuauuagaacuuuuguagcugucuuaaauuuuuacagauagagguugaaguugccauuacuuagugaagagucauuguccgugguuugaagaaugagugacaaaauuaaucaaauucuguuuuuuuuucuguuuucugauuucuggaauauugccauuuuccauauguuuuucugaccuuaggaauaccagcuggcuacaaaaaaaaagaagaaagaaaaaaaugcaaaaacaacagcaaaacucagaaaucauugcuucccuaagccaugccauuggcacugccccucccuuagugccacauaaccuggagcucacuagcaagguucuagaucugcaucacuuccauuuucuauuuugccaacuggccuugagcaacagguguguauucuucuuguugcugcaggcuugaaggaacuguaggguagcuucuguccacaauucugaccacuugccuuuuggcaaucuguuuagugacuuuaggcucuucuaucaaggccaucuuguagacugggggguuguccagaauuuuaugauacaugcaacauucugaccaccugcuaagacuuaaaugaacagacuacauguagauauucuuucuuucucucauacuuaacuuuugcccaugcacauuaguaucaaagauguuaugguaauucaauauguacaguuuucuuuaaaauaggauauggccacgaauuugcuaaaaucuaugccaugguaugaggauaacuuacaugaaaauaugguacaagauuagguaaacaguguuguucauaugagaacuuaaaaauucccuuaccuugaaguuucaaguaaaugucuuucguccuuuuaauuuggugugauaagaaauauugccuuugguguaaucagaauuauguagcaugaugcuucuucuuggugcuguuauuuuuacugcaguaaauauuuauuuuaguuggcauuguugaguuaccucauuugugagcacagcuaguaaagcuaugguuaaauuuuauugcuuuuacucuuagaaucacuuucucagcuaguuuaccuuggagagacaacuuuacguuuuccaccaaauuaaagaagcugagaaaauuggguggaauuuuuuucuuuuuuuuucuguuuaaaaugugguuacuuuguaguacuuuggcgaacucacuaauguauguaugaaagcacacgcuuaucaaauggaaaauaaaaucaaaacaaugaacuccaguauguuuaguaauaaagaaaacaaaaaaaaaaaccugucauuuuuuccaaugcaauuaaauacaaagagaccacuaauauuacauuuaucuaauucaugucuucucggcaauaugaaccauucagauguuccuccaccucuuuugagagggauguaugcugucagacuuuaccaaugggauacacaguugggguuuuggaaauaauuuugaaucuccuugcaggguagccugcuaaaagacaggguuguagaaccacuuccgagggccuucuaaacuuaaaaaagaaaaacaccuguagcugucagcacuacuuucagcaaacaguccacaucguuaugugucauuuaacugcuuucugcuugucagcaggagucuuuguuucacaccuaagaguugucacaucagaaaucagaauaaaggccuaaggucucuauucccacggggcaguaacauguuauguauuauuuuccucuaaguauucuccaucuacucaacucucuccuggaaaccuacauguuuauucgaagccccuauauauauaguguaggguaugaagaaaaacguguuuggcuuuuuaaugacagucuuuucaaguguauguaccauuauuuauaaaccuaugaauguaacauucaguggaguuaauguguucacaaguauaccaugaguguggaugguggccagaaaaguauuauuccugaaaagaacacaacuauguaagcaacuccuguauuuugacuacuugcuguagauaaacaugcuccccucauccaagucugcuacaggaguggacagaaaucuugggguaccaauauugugaggggguugguugaauucagcauuuuggcaacagaaacuggaaagaaauaauuggcggcccauacgguauguguaaugggcacuaugagcuguuuaaacguacaccaauuauuuugaagcuuuccaaacccaucugucaccauauugucuagucacaugacauagaauugucauuucucccugcauaaacugauacaguuacaauugauuuuugcuucaaucguuuguauaaauagaccugugucaucaggaucuauuguuuuuguuuuguuuugcuuuugcuuuuguuuccccuaccagugaucuaugguacaauuuacuugaaaaacaaaaacagguauagcuagagggccacagcauaaaaaauaaaauuaaguauuaaaggcacuuaauauaggguuaaaaaauacccugugaaagcuacggcacaucuuuuccaauguguacaauugagucaagaaagcauaguuguaucuuuauugcaaaucuaauaauguaccccauaguauuguauuuaaucgcugcuauuuuucucuccuauucaucauuguguaacguguaauuugacauaaauuccuggccacugacucuuucugcgguguuggcaggcucaguucauaacuggagguaauuggagugagauuugagcacuguucacugcaagaacugaacaauguuuaggauaccucugauucucgugagaauucuguggggcauaaaggggaacaugaaagaauaggaaagugcacuuuucuuuuuuuccaacgguggcagaaucaggagauuucuugguaacugauucacugguuccugagucuguuuuaccucuggcaauguuaaauaaacccaagacugcauugauuucccuuagaagguguauacucuagcaguacccauuaucauugcaugaguuaucauaacaccuaauaccucagcuggaguuuaagcauuaugacagcuugggaacuuaaagugaguacaguaaagacuuuaggagggccugugaauacaaguuaaagaucacgugguuggcucccauggaagauuuacauuguuaaaguaaacuuguguggucacuuugaagucauagauuuuccauauaaauuaaugaagaaaaauaaauuucucuaagauaguguuucucuuuuuacauuugcaugagaggaaaugaaacaguauaaaguuuuaauuuccccaccuucuggcuaaccaucgguuuagugauuagcagaggagacuuuuauauuagguuuggagcucaguuuccuggcugcaauucauugaaccuugacguaaaucugaaauaaguauuuuguaagggguuagccuuuugugcagggugugugagaaauccugcuggaccagguugguuacagaaacuagugucaaguugccugugcccuaaguggugaauaagaaaaugcagacaacagaaaaguagaagaaaaaaaucuuccuaagaacacccucacccgccacuuccgaaagccuuacugucuaccuuaaaaggacuugcaguucuuuuuagugaugcauguuuguugggugggacguuuuuucuuuuuuagaaauuauacagucauugcuaguggguagagugugucaguacagaagacaaguguuucauucacauaauccacauguuguguggugcuuguugaggcugguugcuuugcauuuaaucuacucgaucaugcuauuugccuuaggugaucagcaaccuuuaauguaaauccuagccaaucuaauaaacuaauggagagagaggaacaccacacacacacacacacacacacacacacacacacacacacacacacacagacacuguggguagggggaguaggcaugcguucuuucaugguuuauauccacauuaucuuagaagguagaaaaguuaugugccaucucuccuuugaucucuccuuugauauauaugcuccuuuuuuucuccuuuuguuuaaguaaguacacuauauuguuugguaauagaaaaagaacaucuuaucagcgcagugucuugaacuuggaaacuugaaaaaaaauucaaaauuuuguucagccugacuagucuauauucaguuagucuuaaaauuguuuuaaaacaaaucauguuacuaaaauucaacaacauuuuuuccccuuauauaaacugcaguucaguauuguuuaagcuuuuuuuuuuuuuuuccuggcaaucacacugaccaacuguuuugaguuuuggauuauuuuggaaaagagaagagggaacaauucuugauaauuccaauuacagauuugaauuaaguacuaaaacuuaaaaaugugguuuuuuuaaauaaacaacuucuuuaaaauauugaaaaaaguuaggaaaauugaugaaagugaauaaccauuuucuuuauccauuggaacaaucagaguaaagagacuauugaaagcuucaaaauaaagggaauggucuuccucuuugauauaaguacguuuaaauggcucuacagaauuaggauuuuuauuuuuaauaucauuggucuauuuuuuaaaauuacaauguuuguuaagagggugaaauuauacuugccuacaaaaauuuaccuucucauaccuccuuucauggagcuuuuuauuguuauauuuguuuuguucuuacugcuaucgucuugauguauuauaacugcuuauuacucaaggggcauuuauacacguacugggaaaacguaauucuucguucaucauuaaguuuugaaaaauauuuuuggauuugucgaucaugaucugcacaugauuaaggugcuuggcuucccuucccucugcaagcucaguucauauugguaauuccuagguuuuuguuuuuacuagcaauuguguucuuuuuuuuuuagaugggguuguaaguuuuuggaguauuccaguacaugcuugaugguaguauuaaugguggucagaacagguuggguacuuuuucuugcauuuuucuugcaugcauucguagcugugcaugacuggagccaguagcuugacgaugcacacugaguauagauggaucuuuagacuuuacucagguuaucguuccuccuguagcagguuucguucaauuuauccuacuguaaagguuaccgaggguaaaauucuauuuccauuacuuaauaguguuagguauuguguuguuguuguuucuacaugcccccaaauugcaccccuuguugguacuggaguuccaaacuaauuaagagaaaaaaaaaaacacaagauuaaggaaguugagagaacaaaauaucaccuuucauuugauucagcuaguguugaagaauguggcuuguccuguguucagaucagcuuccuaaaauugaauuucacagccuuguagaaguagcucauggcugccuugugugugccagagaccccagacugcacauacaaaugccaagaugcacgccuugccuucacgguguuuucagccugucagggaagauaagccaugcacacagaugcccagaauauaggugaagauuuguaaaugucaaaugcaaggaauaagcauuucaaaaauugguguaauauucacacuucucuuacuuuguaccacagagguuuuguuuauaaaauauuuugaaacauucacauagaaagcguucuguuaggacaaaguaaucguugcaccaguccaugauuaauguuaauguuccuuuugucuuuauaaaaauaaagcugugguuuucguacuuugaguuccaguaaauguguuagagguaaugagguaggagaauguuaacguuaaaaucauaauaagcagaguuagacuuuuauuguuuaccuccuaaaacaagcuuucugccuuuaagcugaaguuuuacuugguguuaccaacucaguagggauuuuuaugcuaaacugaugguguuuaauacuucagcagucgaaagaggagugaaaaaucguuacuuguuuuccuaccauggugucugccagguagcauuguaaaaaucuaaaugugccuuggguaucacuccaggccauucauccaguccaguuucugaaaggacccugcauuuuacccagaguugauaaaaguaaacuuuguaaguucaggagcaggggcaguuuacaccaauguacaaauuuuacucacaauuucuuaaguuaaaaguuucuuuuaacuuuucucacaguguggcuaauuuugcauuugggacucccuaaaauggauucagcagcauuucccuggaauguucaaaauaguucaaggcacaaaguaaccuagauauuuaaauggccccuuuacaccuuagcaacgugguuguuaugauuuuaugaaaacagucuuuguuucuuuucucugcuaacuucuggcuuuagucagcaaagauuucucugccucauuaauguuguaaggacucuaaauaaaauuuuucuucguggauuccuuuuugggcaggccugauauugaucacugauuuaaugcuucuaguuuccugaccuguuuuauaaauugugggaauagccuuuuuagauuuugaaugcccacaguaguccucuuucuagcuuugggaaaugauuugagaaaugaaggaauguugauuuuauuuuuacucuacuuugaaaacaaacaaacaaacagauuaaucagauuaauaaacagcaacaugaagguggauggagcugagaagagagucaucuuuaaauucucuuaaaguauaagcaacucauucuugugcuuugggaaccuagugccucccaagaaagucaagaugaagauuugaaauguauacauuuaugacucaguauuucuauaaguauauaauguuaguaaaggaauuguauaaaaagacuuaaaaggccaguucauccauccauugucuguuauugaagucaacaacuugaugauuugguuucauauaaaagauguacaccugggggaaagugcauuucaagggcacuuucaaggguaagauuuuacaggaauuugacauuuuuuaaaaaauaaaaucuuuggaaauuugauuccaaauuuuaauucauuuauaaacucuguauugcccuaaaaugauuuucucauauggcaucgaaugugaugaagcuagauucauucacacauucaauaaacauauaucagugucugcugagagcagggcuuuaugcuggguacuggguauucaguagugaaccauacagaaauaucucucauggcaguuacuucuucuguguauaucugaacauucaaggguaauaaacauaaaccauuuguggugcgugagaccuaggaauaaaucagaaugagcucacaccuacuuacuucuuauuauaacccuaagauugacacuuuaugaauuuaguguuauccaaauaaugaugcaguaucaaagaugaauaccuagauuuaaaaugcuaaaagcuuguuuuagaaagccagugaauaauguacucucacuuuuguaucaauauuucaagugcugcuggguaacauauugaaaugcucacaccagccauggaugauaauaaauauggcauuuuuauuaauguuaauaaacuggguagcauaaauggagaagacaucuucauaggauuucauaauguauuuuguuauucagaaauauuaauguacuuuguaaugcugaugcaguaacauuaaagaauaaaagacagagguuuuaucuugaaauuguaugguguuuaguagauuuugaaauguggauacauuuaaaauaaaguucaagagccccuaaggcagcugauaaccacggguauucugauagcaauguuaccccuuaacauaugaauuuuuuuagguauagcaucuuuguaaaagugguuuuaaauuucaucuccuuauccuuuaaaaaaauaccacauuagcauuccaaagauucuuuaucauuucuaguuauagcaguuguuuuaucauuaacacggugcuuucuuauaucuagcagguuugauucuagauaauuugauaacuccaaaagcguaugcaauuugucauaaaacuauguuacagaaauauaauuguaauuauggauuugaaaaaucuuaauuguacagaaccccacugaguagaugaugaaaaaaagcagugauuaaguacaggccaauaaugggaagauauaaauccacaaagugaauuuuaugcuuccaggaguaaguguuuuucauacuuaauugcuaaaaugcuuugcagcacugagaagaaauauugagaagcaagauuaguugugccaaacuauaaccuugaauucuauggaaaaccagugccuggaugccuuaguggcucagccucuuuaucuaggggagguagaacagcuaggcuuaagccucgacuggccauuccuuccccacuggcuuguuuucugauuuucauuuauaaucaucuggaaauugaagagcuuugauugaacgccagugggagauuuuagcuuuauuucaucaaccuuucccaauauuaacaguaaauuacaacuaucuuuauuacugcuagauuaaguuaaauuauaguaagaugguuuaucaucauguguccuuuaucccuggucuuagacuagaguuuacagaauaucucacaaauuugaagaauaauauacaauguuuuaucuguguuagcaagaaaugcaaagccuuuuuuuuuuuuuuccugucuguuuugugaauugagcuuagaacuguccucguaauuagaaaucugguuacuuggauucuaagcuuagaguuucuuaguuuuaagaacacaucaccucauaauuguaccauaauuaugaacguuacaaguaguaguguuuuugugucucuuacugucagugacaagcaaaaaauucgcuagaauauauuacucuucccuaacucugagauggaagacagauaauagccauggugcuugaaacauguggugcuauugggaugggaaauuguaacagcauuugacaugcaagggucauguuugcaccucuucuuggauccagugaaaauguauuaguucauucucacuuugcaaugaagaaauauccaagacuggguaauuugcaaaggaaagaggugucauugacucacaguucuuuauggcugggaaggccuuaggcaacuuauaaucauggcggaaagggaagcagacauguccuucacaaggcagcaggagagagaagaaugaaagcugaaugaagggggaagccccuuauaaaaccaucagcucucucaagaacucagucacuaucacaaggacaacaagggguaacugcucccaugauucaauuacuucccacugggucacuuccaugacauguggggauuaugggaccugcaauucaagaugagauuagagugggacauagccaaaccguauuaagaggcuuuuagauuuuggggggaaaaggagaaaguuucauuguagucaugacuuaccaucuuuugaguuugagacauaugaggaugagaaacagggucuuaaauaaccagugauauaguuuggcuguguccccacccaaaucuagucuugaauucccauguauugugggagggaccuggugggaguuaauugaaucaugggggcaggucuuucccaugguguucucaugauagugaguaagucucacgagaucaggugguuuuaaaaagagggguuucccugcacaagcucucucucuuugccuaaugccauccauguaagaugugacuugcuucuccuugccuuccaccuugauugugaggccucuucagccauguggaauuguaaguccauuaaaccucuuucuuuuguaaauugcucagucuuggauaugucuuuaucagcagcaugaaagcauacuaauacaaccaguaaacuccagcacugaaucuguucuuugcaugggcugacguuuaaauugcuagggcuaaaaaugcuagggaugagguaauaggaagcuuggaaauguggcauacaugcauacuuagcaucauaaaaaauaggaaaugccacuagacaugaugaauuucuggagaucuuagacagaaguguucccaacuucauuaaguugccagauuugcugaauagauauuuguguguaaaggacucaaaaauacuaggaauauauagcaguaggauacacuacuuggccuaagaaacaugcagucuguuuuguaaagcagaacacaggcacaugaauuggcacaggaauggcauuugccauccuuuuagacagauaugguagcaguauaccauaugaauaucaaaagagcacagaauaaauaaaggaccaugguuuugaauaaaaggacguugauuuucaagaccuguacaguugacuccgagagauuuaaagcuagggucagucuuuggauggaggauaugcaggcauugcagguguguuaauaggcaauuuaaauaugcugcuuaucagucaguaaaaaaaaguucagaauuuagaauaucacaguauuucaaagcagccauucaggcauauuaucuuugccaucaguuucucuguuaaaaaaaauaguuuugucauucuguaguuuuuaaaagacaauuucaaaacuuucagggggaagcaauaauugccaacaggaaccuugacaccuagagguugccaaugugaucagccuuuugaaugguaaucuuuuaccaucccuguuugagauccacauguagaguaguugggauauauugaaaucacacuuagugucuuagucuugaaaguucuuuuuacuuuauuuuauuuuauuuuuuuucagacaaagucucugucguccaggcuggaauacaguggugcaaucaugguucacugcagccucccuccucccaggcucaggugauccucccaccucagccuccugaguagcugggacuacauagcaagccaccaugccuggcuuuuuuuuuuguuuguuuguuuguuuguuuguauuuuuuguagagacgagauuuuaccauguugcucaggcuggucucgaacuccuagacucaagcaaucugcccacuuagccccgaagagcugagauuacaggcgugagccacugugcccugcuagucuuuaaaauucugcaauagguuuagcagugucuuagcagaaagugcuauuugagugcuggcgacuggcuugcauaguggaaauauacuggccugagcucugcccaccugaccacauacugaugucauuauccucccuucaucaacccccucugcuucacauagucuugucugaagggaaugggucagcuggaagaaaaaaaaaaagaaguacuugccaaagaaaucuguuuucuaaaauccauagaaaaggucauuaauguuucauaacauauuggaaguguucggaaaaacuguuagguuuucuuucuuguuuuuaauaauuacaaaggaauucuugauguuggaagugagaaacagauguugaaauaaucaguuucauuuaccuuacauacuccuacauuuaggacauguaaucuuaagaguccgauugaaauucuaccugauaugaaagaaauucuaccugauaucuuacugaauguucuaagagcgaaguuagcaguacagaaaaaaaaccaaguauauuuuuuaauuggauuaucauuuaggaacuauccauucagaagacugugaaaacugugauuguuaagugucuguuaaacuguguuugccuuugacaguuaguagcuucuaggguuuggguguuuggggaauguagcucccacagauacuuugggaagagauaggaagguaucaguaacuaggaaguagaaagagagucccucaguguuugagguagaaccacuuauuuucgcccucuugcccuguuccauucaugcucauugucaaacuggucucagucacccuguucuucccuuuguccuucuccucaccuacccccgggccucucaucucccucuucacacuggcacgccuuucaaagggccuucuccucugaaccugugccaucuagagcagcugcccuuaucucaggacuccauugacuugcccccuuuucuaaucuguuuggaagccuuaucucuucguuuuggccucuacacuguaauuuauuucugcuucuauuauuacauugauaaaucucacauuuaaccagacuuugagggauaugcuguugaacugauguaaaucuugaaucgaaaacugcggugcaauccucauuggucauaaugugugggcuguuuugcgcauaauaacugauggaggcaucucaguuuuaaaguuugagaaugaagcauuguucaguuuugucacccugaaucaaucauuuuauuuugugcauuguuuuaucgugauguuuuuggaauaaagauugguucuaggaaaggggugggucauuucauuuggugauaacggaaaugcccuucuacuuuuuaagugucuuugguaugagguggggcccuagguagggccuggaugucugacuguccugucauuuugaaaagcucccuuuuaagacaagugggacucuacucuuagguuaucucugaggacuugaaagaaagggagaaaaaaauccuccccuauuauucauuaaugacuagaaaugcugagccaguuucacagauuuucuucucuuguuugcuuuucuauuaauauuaagaaugcuuuugaggaacuaguuuagugaaugggaaagcaauaaacacuuuuguagaaauguuuauuaauauuucauacuuuuaaacauuccacacucuuaguuucuuuaaaauuaaaaauguuuuuauaacuuguaguauacaaauacauuuuaagaauuuuuggaaaaaaguaaguguuuaauaaagacuauaaauuuggaauucaaguuuagcaaauacucagcuaucagagccugauaauaaauucauugaaguguuaauuguaugaggaauaucaugaacuccacauauucucuauuuauaaucagaucacaaauuuagaugauuuuccaaauuuuagcuaucacuuucuaaaggauucaacagucuaauauaaauuuauuuaccucuaugcuacugugaaaaagaagaagagcaaugaaaguuucuaauaucuaucaucagaguaucuuagccuagaaaacuaaauguuauugaaaauuaagcugcuuauauauguuguggugacauuuacauucuccuaaauaauucauugucuauuuacuuaugacuacuuacuuaucaaagcuaccuucauaucaaagaggaaaauagaauauuguacaauaacauauauuaucauaaacgauaagcagcaauaaugguuuuuaacuagcuagaaagguuuuuaacagcguggucagccuaaacuucauguuaguauauuaguguguuaguuaagaaacuacuuuuugaaggauuuacauauaccuauacauagagugaguuaaacauucagaauguggauaauucauuuguugauucagucauuauuuauuuuuacagacacucuaaaugaucaagauucugaucugggcauugcaauuacaaaguugaaauaugcaagauuccugcccaaguaaagguuacaucucaauaaucuugguaaaaagcaacaaaaaauacuacuuacucaacauaauaaaaaauuuuaauauauuaugauuuauauaauguuauguauaaaaauauguaauuuugguacuguuuaaaaaucaagguuuuauguaaacuuaaaauuggcccacuaucauuaggacacacgcuuugaguuucuuuaguagcagauguaauacuuuugugaauauucgucuuauucucuuggacaccuuaucucccuauuagguagugaugcauuuuuacauuucagcauucuagaaguguguagucugugaccauuguacuaggucaaauuuaauuaguuauuucuuggaugaaccuuucacuguggauauugccaggauuaaaguuugaagguaagagggcuuuaggggguggggggaauugcugacaaauaaaguaccuucaaugaguuguauaaauuggagauucaguuuuuauaagagcuaaugggaacacuuauuauaacaaccaaaugguuacaaaaauuauaagaagaguguuauugauauagcucaaauaugguacaguuugcaguuugcugguuguguuuaguuaaguuaccaaggaaguuacuaugcuacaguuuuuaauuaaaaauacuaauuuauuuauuucuguacuguaacaaagggauauauugcauaaaugauggucauuugcuguauaauauauuucuguugaaaaguuaugcauaaaauucuuaguuuaauaugcauuugauuuuccacucaugauuacuaaucuuugcauuaaaguaacaggauuauugcuuuuucaugaugugaagggauaaagugguaggaguaaacaacagaucagaauaucuuuucauuuuuuuuaaagaggugaaaugacucccuuaacaaauuccagcauuuuuagauuguaaaguacauuauguaacuucauucaucauguagaccucagacagauacuuuaauuuuuuuuugaaaaggucuuguagcacacuuaaucugcagaucuuuucuggcaggaggaaaaaaaagcauauacuguuagauuuggugacauaaaggucaaaagauaaacuguaagugauaccuauguuuauuuuuuugacaguguuaaauuagcaaccccucagaccucucuuggagcaguacaaccugaguaauugaacaugucgcuggggaguaugcuugguuaagcugauuccuauuauguugacuugucagggaccaauaauuaaagcugaagagcgaugcucauuagugucugcaagaugauucgaagaaugagaagaaguccuugaggcacaccugcaaaaggcaggcauugcauggaggugagagcagacggacuggccugcuuuucugcuauguuagcaagccagcgauaaaggggauacacuaaauuaaguguugcaaauguauucuccccaauuuagauuauaaaaugcauuuuacuuccgccuuugaacauaauuuuauuccaauuuuauuccauguaaucauauuuugcucaauuaugcuuuuaaugcuauauaagauguuuuagaaacuagauauaagucuauucaaaagcacuuugaaaaacuuuauacuaugaaucauuucauucauuuuccuggaagcaucauaauaaucaaaaucugcuuugcuucuuugaacucucaauacucugcacguaaaacaugugaguuauccagcuuugaugauaaagacuuuaguggcauacauuugucacauuuacuucacaaaaauggaauuuuuaaauguguauuuaacacguacuaaaccacauacaguauacaagcauuggcucccgagaaggccagaggaaaacacuacaucauaaguauagaauuuauauuuaucacaacuugagcaaagcuguugacuuuuggaaacaauucaaacuuuuuagcacuggaaugauacagaaacucaauccuaaagcucugagaagcauuuuucuucuuuugaaauuugccuuagguaggcucacuuuuuacaaaucuaucauaaaaucaugggauauacaaauauccuaauauuuuggaauauuaagaaaaauaauuuauuggaucuuuuuucuguaaucugguuuugaaaaaagugcuuuauaguggugaaguggccuuuuuacuuccaguguugugccuguuaaauuuauccugugcacuuuggcuggagggaugcaugugccuuuuauucagagugaaggcuggagucuuuacacagaaguccuccguguuuguaucuucaggagucacugugagauuaucucuuugaagaggcccuuccugaaacuaaacuuuguagaacuuguauuacugauauuccauguuagcaugaaauuguccguguuucgguuuccuccaacugaaggaagucccucaauggaagggacugauucucgcuaauguuuacaugaacagugguuggagcucaauaaaaguugguuaaacuuaacauagucaaggugcagaagagacuugcaggguaguuauagauuuccaagaauaccaagggcuuuagaagucaaauagaacaaccuccaacucaaugucaagaauuucuuacaggauguucuuuaacagauagguccucuccuggcuugguagaagauuuccaguaccagagaggucacuacuuugcaaaguagcuguuucuagauugaucaacuccaauuuauaguaaugacaaaugguaguuaaaagaguuguacuuuauaugaauuugcauuaauugucauuuagucuucacaguauccuuaagauuuagccacuaaauaugauuaucuucauuguacagauaaggcuccugaacuucagagagguugagugacuuacccaaagccccacagcuaaguaguggcugagccagcaugagaguccaccaguaucugacuuaagagcuggaaugcuuuggcaucauagcccacagcugccccucuuuuguuauuguuacagaacuauuuuuaauuacuuuccuuuaaaagccccacaaaucauugguugccauuagaaaucauucuuuuuugagacagagucuugcucaguugcccaggcuggaguacaauagugagaucuuggcucacugcaaccuccacccccgguuaagcaauucuacugucgcagccucccaaguagcugggauuacaggugcccaccaccacgccuggcuaauuuuuuguauuuuuaguagagaugggguuucgccauguuggucaggcuggucucaaacuccugaccucaggugauccacccacgugggucucccaaagugcugggauuacaggcaugagccaccaggcccagccuagaaaucauuuuuguuuuguuuguuuucuuuaauagagcaaggagagacucuugcaacauuuguuaccuauccaggguuacuaggacagcauugcccauccuacaauugcugcauaguagugguaugaaaagcacuccccaaaacaaauagauucuugaguuuauccaguaaaacucuaauuuacucuaauuuaacacuuccugugucuuaaaucuuaacuccaaagggcuguuuuguuuagcguuuuuuuuuuuuuuuuuaauagaguauuauaguagagaagcuacuugaccaagguuccuaagucugucugaguagcugcaaacauuugggcgaacuacacaacucaaggaauauagauagccuuuucagcugucaaaaggggacaggggaaucccuuuucuacuaaucguccaucuuugauauuggaguacaauggacuauauaugagaacauucuuaccaauugauguauuaaaacuuauaacuuuugcuuagaagaauuuaugguauugauguuaucaucuuauacaauaugauguuuuccuaggaccugucauauuggaaacauaauugauauugacucuuguuacaauuauauaaugcugaauacauauucauuugcaugaaagagauugacagugauugaauuuagcaggaucugucauaagccuugagcauucuuuucuuaaagguuccugauagcaggggguuagggagagauguuuagacauuucaauuuuuuaaugaauuuauugauauacaguaggaacaguucggcuuucacauuaauucauacauuucaaagauuuuucuuugugauagaaugauguaaagcuauuauauauucugcccagaaugucucucaucuguuucuuuaaaaaacguuaaagcaccauugaaccaauuuuuacgguacuauuaaucaguguaaucaguauuaauacacuacuuuaccagcucagugccacuugucaguaauaugacagggugaauuuuacaucuucuucacaaaggcuuucaucuauuagggagagaaaaaggagaucaggauuuuaauuguuagcaaucagaagccuaugugauuaagacaggcauucugaauaagacacagcacagauuauacugagaauauuuuucauccuuuacuaauucuuuuaugaauuugaauguagucuuauuuaccugaaacuuuaauuauagacucaaaggagaguaauaugccuauuagaaauauaagaauuuaauguuaaagguuuuaaugugguucuggcuggcuucuuucucucuuuauaucuuggcuugcaguguucccaaauccucagguuuccuccaaaugaauguuguuggccaggcacaguggcucaugccuguaauuccagcacuuugggaggcugaggugggcagaaucaggaguucgcgaucagcagggcgugguggcgggcggggcaccuguaaucccagcuacucaggaggcugaggcaggagaaucgcuugaaccugggaggcagagguugcggugagcugggauugcaccacuacacuccagccugggcgacagagugagacucugucucaaaaacaaacaaacaaaacccaaaaaacaaaaacaaaaaaaugaauguuguugauuugguuucuaaaaugcccacaauuaaaacuugauuucuuuagguuuaggauuauuuauauauauguauuuuuugaaucuugcugugucacccaggcuggaauacacuggugcaaucauggcucacugcagccucaaccuccugaguuucagugauccuccugccuuagccuccugaguagcugggcuuagaggcaugcgccaaccacaccagacuuauuuuuuuuuuuuuuuauguagagaugguguuucacuacguugcucaggcuggucuugaacuccugaccccaagcaguucuccugcuucagcucucaaagugcugggauuacugaugugagccacuaugccuggccagguuuaggauuauuaugcguagaaguuuucucuuaaaauagaagugauccuuagaguagccacaaguuaauuuauuucuaguguuuacaacccagcacaguuuaguucucagguaauuaauucacuguucaaaguagacaacaggacacaaaaggaaaaccgaaauaagugcagcguagaaggaaugguggagagauggcuaagauaaaggcagcuacucuucgggagugaaaggaaugaagccuuucccgggaugaggguagcucaagggacuagggaccguggcaagauggugaagagucucucuagagggaggcagguugggagaaaacagagaagccuaagaaagaaguucugauugcccugaagcuaauuacggugacugccuucuauuugaaacacuaaccugugugugaugcguuuaaugaccagagaaucaaauaacuugcuuaaaauccuagcucuaggggcagguauucacacucaggucacuaccauacagccacaagcuuaaaccccaugcuucacuggcccagcuaaagcuaaagacucaucagauuauuucagcuuagcacagaguuaaaaagacggagaggcagagggagagagggcuauagaagggaagagagagagggagaaagggaaggggagggcgagagguagagacagagagagagaauugagucauucuuuguucccuuuccugauuuaaaaaagcaagugaugcuuagaaagucaguuuaacaaaguauggguaauaaaagcaucuuuuaaucauuugcuauuugauauggcauuuuuaugauuuuaucaggcaugaauuauaccauuugauauauuucuuaauauaauuaaaaaguaaaauuaaguaaacaucccguaauuuggaugcuagauuaaaaacuuaauuucuaggaaauuacaaagucugugaugaacuucaaauguaguugacaacuacacuggcaguuuuauuauuuaaacauuugaacuggacuuugugggaacaguuaacguaggauugggacguuuuucuuugaauuauuuaauaauugccucuuguccguacuugugacaucugugcuucuguuuuaccaaccuggaucucgaaggaaccucugcucuguguuaaaaaguaagcaaauuuuaacuaaaguugcuuauucagcucacaguaaugaagaguuauguaaacuguuuugcccaaguuuacagaugucugcuuauauuagguacuuauaauaguagauauuuugaaaagauuuuuaaaaaguaauuuauggaaauaauuuauggaaauguuacauuaguuaaacacuaaaaccuccguggcucugugugugugugugugugugugugugugugucacauuuuacaugccagagaguuacauuuauauuuuuuccuacuuuauccauuggauguauauuauuucuugaaacacuaaggauaagaacaugccaaauucagaguuacuuacaaaagcaaauauuauuaugcuaucacuguuauaucuuugaaauuaaaaacaaauaguaucccagguaucacuuaaguguauuagaauauagauuugauuguuagagaaagucaccuauuaguacgauguuuuuauauuuuuuguuuauuuagcauuuuuuagcuagcauugggaaucuuguuaaaacuauugcaaaugcuuuuuaaauauauauguauauaguguauacauauguguguauuuaauuaaaugcaagaauuuaauuuuuacauauuauauaaauauauauauucauuucaauuuguugcauguuauuuauuuugaaaguugcuugcugcccaccauugacauuuucuaaauauguucuuacauauaaauaaugcuagcuuaaguucacaauguggacaauuugaaaagauauucuuuuucuuuaggugagggaugauaauaauuaaagacacuguaauuccauuguuauauacuuuuuugagaucauaaacuguuuuagguuaucugcaaguuuuauuguacucugugauaucuuagauaaaagaauuaaaauuggugaaauaaguugcaaagugugcauuucacucagauaacuuucuauuccuuuucacuucuuugaaucuguucuugaaauaaaacaaugaagccauuuguccuaaaaauaauguugaaaaauugauucaucaaguauaacuaaaagauaguaugaauuugacugaugagaucauuaguuguauuggaauuuuucauaaaucugaauuggaucuuuaucuaaaauaugaaugaagaaauggucugccuaauuuuaauauuuuuuuaaaguaaguacaguaaauaguauaggucuauuuauuuguuuuuaguuuggccuuaauuucagaugguuucaaggguagaauaauugacaccauugaaugccuugugcuauuuuaaugacuuucugcucuuuaaguuaaguuguagcaaccaauaauguccaaggcucuuaggcauagugaagaagggauaugaauuaucuagauaggaauuagagagaauauuuaagaaaacacagaguuaacuauuaaacuugacgucuuccaccauccagugaaaaaugcuacugaauagaggaaggaaaaguauaauucgugcaguuuaauuagauagguuaccacacugacaccaguggaagaaacuccagugugaauucagacagcagcaccuuauguuucuuuauuucagcauacucggucaucaguguauucuuucuuccugugcuugacugcauuugauaguaguuucugagugugaaagcuuugucaagaaggauccuuuccaaccauaagcgugcauccacuuuggaaacuaccuagaaaagcugcaaaugauaauuuugauaaagagaauuuuguuuggaagauacuaaaaauacaguuaacaaugagcaaauagcauucucugacuuacucgaaggaccaguuuauauguaauuuuagauaccugcauuuuuaaaugauuguauuuauuaguaugaauuuuagaaaaaauauuaaaagaggggaaccaaaaaaaguuauaucuugcuuuuuuucuuguccuuucccuccaccuucuucuccuccuucuccuguaguuaaguucaauuacuuguaaaaucugagguucaucaacuacagaauuucacaaaagcaaaaacugggaauucuacagaaguuacacuggagaaugauuuaauaaauuaaugaaaggguguuaacgaaugcaaauguuacagcauugguggacguaagugccuccauaucaggcaaaaaugguuguguuugaauccuuguugauagaaauaacauuaaguuauuauaaauauuguacaugaaauggguuuucuuaggcugcuggaugucuaauaauuuuagugagugaaucaauaaaauacagcuuuuuaauuaguauuuuuagguguaguuggaagaauugcuuagcacacugugguguuagguauagcucuagcaacauccucagcagaugccagggagguacaggacuuagauuucaguggcuuccuggcccuuccaccugccuccaauccagcauuuuauaggucacauucaugacauuccucagggucaggaaguaaaauauuuuuauacauuaacuuacuaaauccucauaguaaugcuaugagauagauacuauaacucccauuucccugauaaggcaaaugaggccugaagaaggcaaguggcuggcugggaguuaaauuaggcuacuuagugaugggcugcaauuugagauuucauacuagauccuuccucuuagccgcuuguuucuucugcuuccuuuccauuguuguguucacaaaaaugccacuucacagguuugaaauuauucucuuuuuagccugaaauguucuuuacauuucuugauaggaggauuuuauuuuaugucuaaauacauuuucuuguucacuuuugucuugaugaauuacaaguaacaguuuuuaaauuccaugucuuaauguuuaggauauuugcauuuuuauguuuuauuauuaagggaacugucaauauuauguuaaacagacaugagcaucgaacguguuguagagcaaauuucagagaaaucacuucuuaaauuauuuuugucaggacaaaucaaagaauuguauaagauagguaauugaucuauaaacuggugaaggggucauuuuaaaauccaggcuaauuuaaguuagauucuuacuugacuuacaguauuguguuggcuuugguucauuuuuuucaccuucuccugguacauaaaaagaagaaagauucuuggcuuaaacaaaucgcuaaaguuaaucuuguaugaagaagaaaaaaugaggacaucauuuuucaauuugcuaaagaguuagccucaauuuuuaaaacuuuuuaucuugguauauagauauauauuuuuuaaaugcucacuugcauaucuuagaaccaaaggccuaauaacaaaaaauaaacacuugguucuuucagaagaaaaaucacagauggcaaaaaaaauuuaaaaaaaauuauuggaucuuuugaaagcuaauuggcaauuuuuaugucauugcuaaucuugaaagagacaauagauaaaacuccauauuagagguggauguguaauacauaacccaauagcaauagcaacagagcugacauagccacaauuuaguuuaauccuugucaccucuaugugguacacugagguccuggaagcugugucuuuuccauaagaccaugccugcuucccuauaacagugauagugaggauaacaacagcgagcccacuuacuuauuuucccuuuguguuucaagugguggugaaaauauucucagucuuuuuuuuuuacccgucuguccuuugggccuccacaucccuuaggacaccaaccugcuucaaaacugccauaaugacuugcugaaaucguuuaugucaagguuaaggagaguauagauucucugcuuuuugcaaguauaaaagagaaaaugugagucuucucccuguauuuguucaauaaauugaaaggagaaagcuuaagcuugugcuuuucccucauggaacuaugauuauuucagaguaggucauauugugggacuuaaaacuguaauuauagcauugggcaguucucucauaauaauaauaguuagcauuuauauaacccguuucaucuucaaagcauuucacaggcacuaauuaauccucacaacaugucugugaggugaguaucaucauccccauuuuacagauguggaaauugauucaaguaaguuaagagucuugccaugggccauaggaggaagucagagucuaaaagcagggugcaaacuugggaguggccggcgccuaaauccuuuuccacagcccuaaauuagaccuucucccuuuuucuccccaucuccccgucuuuauuucuuuuuuuuucuaaguucuggaaaggacucuggcguuuuuccuuucagucuuccuuuuagagaguaguuuuuuuaacacugcccccagaaauaaauaaaucaucuuaguauaauagcuuuaaagaucuaaugugucuaaucaggauauaaauauuucggaaagucaggaaaugaauuagguuugggugcaagaaaggauuccaaauuacauuuugccuaauaaauaucgcauccguaaacaguaaaaguaaugauagugauuaguuaacaguaccaaauaaaacgugcauuuaaaaugaaccugaccgggcauuuuugugucaugcugacugauguguacacaguccauucuuugaaaaaucaaggcgcucauuugaauuguaaauugccaacacugcaaauaguaaauugcaguagucuuauugugcugugaugugacaaauuacaaauggaauauuggcuaggcuuccauaucuugcauuucucuuccacuugcugcuacuaucaccauuaaucucuuuugcagaaguucuauggcaaauuguucuggacauggaaaggacauuaaguugcauuguugacuauugcagggcucuguguggcuucucugaccucugacuucucuuauugguguaauccaguauagugauacucauuuuggguccugcuguguguggauauaaggguucuggcacaguuuaugucugacauuucacuuaaauauuguauuacggucaagaauuuuggcugaaaugugucaaguauaucuuaaaguggaaugugguccuuuaaaauacauccauaucagaaacauaaacuauauuaaggaugaguagcuucuuaguuuggccuuucguuuuacaaaugaggaaccugagauugaaugcuguuaauaaagauuaguuuuuggauauaaggcaggcuauguaacugucagagcugaaaaacaauugauuucaaguggaaugcuugaccucugaaccuaauuuuuaauuauugaguuuucauuuuaaaacacaaguaaauuauggauauaaguuuggaaguaugucuacaaagagagguuacuuuuuaaaggugaaaguguucuauugccuuggcauaaccagugaaaauugguuacacuagaauaaagaauagcuauaguuuccuguucuuuaucguucguggugaaagcauuaauguguauugaguggaggguagaguugaaaauuuugcacuguggugaaaaagaaagauggauaucaaaaaaguauaguaagaaacccuccuaagccaucccuauguaaccaguucucucuggaccuucuugguaaaaugcaccaucugauguccacagcaugcugagugccuucagauaguaggcuuuguucucuaauguaacauacauucgcuucugcuacuauuaguugaccuguacguucaccaagaguuguuggggauuguuccaaaccuguuaugguaugugaacuuauuaauauacuuauguaaauaaauuaaauauuauauaaguguauaaaaucugagaaugaaaaggaaguucuucagugacacaaaaaugaaugcuucagaaagaaagauuuaauaaaaauguaucacuugaggugucagauuaagugugggugagauaauuguagcagauuggggaaaagaucauaagcauuugaaaauuuuauuuucuuuuuaauuuucauggguauauauuagauauauauuuauggggugcguaaguuguuuugauacaggcaugcaaugaagaaauuuuagaggaucuauuaugugcacaaguuuauguaaaaaagacaacugguauguaauucaaaguuuagccaaaguauguauuuuuuguguuuugacauauaauuccugauuaaauaaaauaauuaauuuaaauaauauaauuaguaauuuaaauggugauuacauuuuuuuuuaugauuccccacuuuaacugacuuuuucaguuaacugacuacuacugaucagucaacugauaagaugaauucugcaguaauggaagaucaagaaaugcuauucucaagaucuuuuuauucaccucuucaagaauccuuuuuauuuuucugagaauggaaaguucuaacuaaauucuuuguugcuggacucauuucguuuuauugugguuuauuuauaggaggcacacagaaccaaccaccagucauccaucgcuuguuuugaguuuuucuguuacaauauugcugaucuuuaauauauuccuuaauauuuaccaaugucuuacuacauuuucuuauuaauuauacuuucccacuagcuuucugauuucacuauaacauuugugaauucucaaauaucgcuguuaaauguguccauugugcuguuuuucuauuuuguacuaaagcauguuaagcuuucuuccaugauggaauuuauaacucaagagaaauaaaaucagauuaugaauucuaaauucuaaggaaugagaaaagaaugugggauagaagagacauugcggucaagagguggugugugaaguuugaaaguucuguugccaaacauaugcaacucucauucaagagaaaaacaaucugcaaagacuuugaagaaugagagaaacaugauucuuaggagcaggcuuucagauucucgaugauggaucauguagacggcagauauuauccagcaaaaucaggauaauuccugagucggaggcugcauuccagccucuaugucccaggcuggagcaguggcaggaucucagcucauugcaaccucugccucccgggcucaagcaauccuacuaucucggccucccgaguagcugagacuacaggugugugccaccaugccuggcuaauuuugggggauuauuuauuuuuauuuuaauuuuuguagagaugggauuuugccauguuguccaggcuggucucaaagccaugggcucaagcagucuucccuucucagccucccaguguuggaauuacaggcaugagccaccaugccuggccaaauuucuuuaucucaauugacccaucuucagguuugcugauucuugcaucuaccaacucaaauucgauugcuuuacuuuucaacuacauaauuuucauuucguucuuuuugaauaauaaauaauaaaaucaggaacuggguagaggaugggacuagacauaaaauauuuagaaauggugcaaaaauuagauagcugaagcuaaauagauugaguuagagcccagaaauuuuuuaaaauaacauuggaaauuaaaaugaaauuuaucuggaaccgcuaaccuuucuuugaaacccuuguugcuaccuauaccagugaaccuaucaugcuguguuacagucaugucuuuacugauaggucuccugcacuagccuagggaaggguucuuugcuucuuauuccuuauauuucuaggaucugagccauuauaggcccucaauacauuagcugaaugcaguaacaaaucaggaaguagaguuguuuuuacagccuuacuguuagguugacucagguuuaacaugaugugacauuuuuaagcaucuuggacuuacugcgugcacaucuguaguuucuuuuccuuaugguuuucuuugauguagauaugcaagguaagagaauacuuuacuuuuuugauauuauguuggagagguuguuuuaaaaaguacgacuuuagauuuagaagaacugaguucaaacuauagaucuauaaccucuuacuggcucaguagucauuaacaaguuauuuacauuuucugaaucucagauuaauugucagugaaauaggaguugucuucuugucucucaguauuuuuuaauauuacaauagaaaauacuaaauuagaauauuagaaaacauaugguaucuagcacagaguauguucucaguaauuuuuuauucuaaauauuggucacagaaaaaugaaugcaucucagaagauacauuuggaagcucauuuuuuuuuuuuauuuucugaaauugagaauuugacccucacucuccacucucagaaauuacucauagucauuuggguaguuggauugucuuuccauuggcuuucauauauaaggcaaaaaauguccaaaaauacugagaagcaccaaauggugcuaguaaugcaauucaugaacauuuuccaaauuugcuagcaagauagucgguaaaaugugccauuuucacaucuuguucauagagcaaacaaaauaauacuuaacuaugcaauaauauacaguauuaaaucccccugggaaaagaguugguuuuaaauacuuugaaaagaaacuuucaaguuagugauuuacacaguuaauuauaaacaacaagacuuguaauuaaguguugccauuuuggguugaauugguuucacccaucacuaauccgucuauccuugucuuuggcuguugagagauuacgggaaaaugcacacgaugaaaaguuuaacuugucaaguauaaauuuagaugcaaaguccggaauaucaaacaccacaagugauaauuaucagcaccuggaaauaauuuguaccacuaaguuaaguaaagaauucucuuucugcugauggggagauuuuaaccucaugaucacugaagcacucccugcaguuuacagugauguaucuugugguucauucccaguagucaacauagcaccaagcaauuaguagaacacuggaggauaaguguuagcucuguacaaugugacuaagauuaaaccgggagcaaauuagagcaaggauaauuguccaguuuuuaaguugcucgaaguccaacucacuuacguauuacauugagguuccugcaaagccuggauuuuuuguuuuugaaaaauaauaaauacaauuuuuaaaccguugaauuuccuggauuauauuuuaguaucuuaacauauguauuuucuccuaaguuaaaaauuuauuuuggagucucaggacaugucuuuuuuuuauaggagacuaauuugggucccccaaaacauuaucagaagacaaguuauuauaauacguaaacaugguauuuaaauaaauuuugcagaggcaucgacuuauggguuuuguggcagaaguugucuggauucucugauggcuuguuauaugugauuuucuuagcuuuauuaaguuucugugguuguuaaugagauuucuuuauaguccucuguagguaaggguugauuuugaaauuuuggcugcuuguguuuaagauuugauucucauucucaaacauuuacauguauaauuuugagaacacauuuuauuuaacacaauauaguaaacagaaugaaucauaacuaugaacguuuuccagaagcauuucuuagauaaauuauuuuauaaaaagaaaaacaacacaacaucuaagauuuagaguggaagaauauacuuguaguuaacuuccuuguugauuuaaaaaauauauuuggauuuauuuuggcagggugggggaaucaucuaauaaaaaauuuaaagcaaacuucauuuuuucuaaccagagugaagagacagggagagaaucaaauaugugugagcucccucuguugcucuguaacagcauuuuauucaugauuugugaugugauaaggaaauuuuugcuaaugugucaaaacaaauucaauuuuccuuuaaggcaauuuauaacuuuauuuaaauggaauauaaaggaagaacccccuauauguaaaauucugaccuucaaauuuauguuaauauuuuuaaauuauuaaaacauuaaaaaugcaucuauuucucaccacuaagagggaaaaaaaaaacaaaaaaaaaacuucagcuauauuuaguaaguacucacugaaguccuaaacauuaggauaaaaugcagggccuaauugaguaaaguaucaacugggaugaugauagugaacagguuggcaaauuugccaacuggauuuaugguaccuuuuauauuaauuacauaagaguaaaaugugaacucacaaaauaguaauggcaaaaaugaggaguuguuuuaaaaguauguaaauggcauuuuacaaugcugugaaauacauuuuuuuuuuuuuuuuuuugagacggagucucccucugucgcccaggcugcagugcaguggcgcaaucuccgcucacugcaagcuccgccucccggguucacgccauucuccugccucaggcuccugaguagcugggacuacaggcgcccgccaccacgccuggcuaauuuuuuuuuguauuuuuaguagcgaugggguuucaccauguuagccaggaugaucucaaucuccugaccuccugauccgcccgccucggccucccaaagugcugggauuacaggggugagccaccgcacccagccugugaaauacuauuuuuaugguaagcuagaauuuuaaaacuauuucuugcaaguuuaggauuaaaugaauuacauuauguaaaauuacaucuuugucuguauuacguauuuguauacaguugaauaguuuugguaacacguaccuuagugcuuuacauugauuggcucauuaauuuuauauuuugaguaauaaucaucuaauuuuauuauuguacaauucagucuuaaauuauguuaugaugugaaaaugguagcuuucuugaguguauuuauuuuuguaguagugggcaauguaauuaucacacauaaaaugaacugugagacuuuugagccugaaauauuauucauauuauaaugcucugcaguuuuauuaauaacaaugagagaugaagcacuaacuuuaacugguauccaaaguaggugaaucaaaaggcuugacucucauauauauauauaugacagucucauauauauauacacauauacauguauauauauaugaaaaaacuuagcauauauauguaauuuuuuuuguauuuuuaguagagaugggguuucaccguguuagccaggauggucuugaucuccugaccucgugaucugcccaccucggccucccaaagugcugggauuacaggggugagccaccgcacccagccugugaaauacuaauuauauauauauauauaugcgcuauauauaugcgcuauauaugcgcuauauauaugcgcuauauauaugcuauauauaugcuauauaugugugauauguauaugcuauauaugcacuauauacgcuauauauaugcacuauauauaugcacuauauaugcuauauauaugcgcuauauaugugcuauauauaugcuauauauaugugcuauguauaugcuauauauaugcgcuauauaugcucuauauaugcuauauaugcuauauauaugcuauauauaugcuauauaugcuauauauaugcuauauauaugcuauauaugcuauauaugcuauauauauaugcuauauaugcuauacauaugcuauauauaugcuauacauaugcuauauaugcaauacauaugcuauacauaugcuauauauaugcuauauauaugcuauacauaugcgauauauaugcuauacauaugcgauauauaugcuauauauaugcuuauauauaugcuauacauaugcuauauauaugcuauauauauaugcuuauauauaugcuauauauaugcuauauauauuuauaugccaaguguuuuacuuuagauaucuuuucaaaaggacuuuuucuucaccuucuccaaccuaaagcauucauuuuauagaaggcaguagaguaaguuccuaguguauuucuaacuuuaaaacuaguauuuauauuuuacccaaauaauuaguaaacugguaguugaaaaggaaaggauuaaguaauguaguuucuuucuccacauucugcugcugcuugaaucucauuccaaaacaguuuagcaucauauauuauuaccacucucugaauaucacuguuguugauaugcuuaacauaccuugaucuucaaaaaggaaaaaaagcgagaaagagaaugaguuuuggggaguugucucuuuugucuuuacaugacacaaagcaugaaacauguuuucuuuuucagcaguccuuugccauguguuaugacugaauguugcuccccaaauaccaucacaccggggguuagagcuucaaccuccaguaugaugguauugagguuagagcuucaaccuccagugugaugguaucgggguuagagcuucaaucuccagugugaugguacugcgguuagagcuucaaucuccagugugaugguaucgggguuagagcuucaaucuccagugugaugguaucgggguuagagcuucaaucuccagugugaugguacugcgguuagagcuucaaucuccagugugaugguaucgggguuagagcuucaaucuccagugugaugguaucgggguuagagcuucaaucuccagugugaugguacugcaguuagagcuucaaucuccagugugaugguauuaggguuagaucuucaaucuccagugugaugguaucaggguuagagcuucagccuccagugugaugguaucaggguuagagcuucagccuccagugugaugguaucgggguuagaucuucaauccccagugguggugguuagagcuucaaucuccagugugaugguauugggguuagagcuucaaucuccagucugaugguguuucgggauggggcuuuuaagauguaauuaggguuuaagaucauaagggaccuggucugauggggauuaguaggcuuauaugaagagacacaagagggcuugcucuaucucugacucucccacacacaaaguagaggccauguuagccuauggagagaagauggccaucugcaagccaggaagaaagcccucacuagaaaccaaacccugcaaaaccuuaauccuggacucccagccuucagaacugugagaaaauuuauuucuguuguuuaagccacccagucuaugguauuuuguucuggcagcccaagcagacuaagacaccauguucagacagaauuugaaaauuacuuuuaaguuugcaccagaauguaacuacauuugauauuuaaggggcaaaagcagguguagaguuuguaggaaaccuuuauguuauuuaaucccuguaaucaugguacccucuugagaguuugcauguuugaaauauuuaaauuuaacucacucaugauuuuuuucaggaaaaaaaaaaaaaaaaaaaaaaacagauuacaugugggaagcgggccccuuaauguuuggucuuguucagaaucagaaaguucauauagguacucccuguguggcauuguagacaggauuuaccguaauugacaacauuagaaauauuggaacuaguuuuccuacugaccuugauucaccagaggguggugggagaguauuugggagguuuucucaaagaguguggugaacaaccuagcggauaaccucacaguuaagacugaaucuucuguuuuugagccauuaaaaguuugcucaagcuagaauuuacucucucauauuccagcauucaguguugcuccaguaugaaauuuuagauccuauagaaguuaaagugcagaacaccugggacucauauccugucaaucacuaauuuaucuucuguuucacuccuuugguuuagaccguguucucuuuucuaaacucucacaauagcugcugaacuucucuucuuuccuguggguuguugucucuaaucuauccucuacucugccaacagaguaaccuuuaugaaaucugauaauguuccucuuuggcucuugaauaaaacccuucucugccuucuuaucauccucguggcacccaaagcccuucauuuauucacuacucuucugaugcagccucaucuccugauauuccucucucaugguuugcagaccagucagauuuauucacuuacuacucagagauuuugaggacuuuuuguguccaggacuaccaagauaauuaacguacagugccugucucaauauaaauauauuggucucaauauaaauucuauucaugcuucagaacucagcucaacccuucaaguccaaagggaagucuucucucauugggccuacuauuagggaguagcucuguccuguauauuuuacugaucuuucuaaaauggcaccauauuauaauuaguuguuuacagauuuauuucucuucuagacacugagcuuccaagauggggacuauguccuauccacauauuccagacaccaagcuuagugccugauugaaauaaucccucagccaguauuuguagauuuuaauuuacugcaauaugccugaaaagucuuuggguuauagauucuucaucuauucucugacuuacaguuuucaucagucaaauauuugcuguacuauuuaccaugccauuuaccauguaugguaaaaaaaaaaaaaugcgcucugauuucauuccauuucuugcuuagauuagguagacuuauuucagaaguauuggaccaauuauagauauuuugaaauccuggugcaaauauguauuuuccaaggucugauuaucuaaucuguauaucguuuuguauguuuggugacucucccaauaucucucuuuaugaauaucucaacaucgugagugucaguagcccuucgacuccuuuuucuucagauauucacaagcaugcagucccucagauuucgucauuccucauggcaacagccccauacaaccagcaacucagaaaccccgaucugugaccacauccucccauucuuucuuguaccuucuccauuucuucagccuuuaugaaauaagcacccgccuccaucagacgucuucaugcucuggauucccuguuaugccuccacuugugcucagcgauccuuuuacuggucuuuauuugacugcccauguuauuccucccaaacaaggcucuucacuuuguuuuuuuuaacccuucucagcuauguauucuaaacucuuacucuuuguaaguaauauuuuauuuuaccacaaaggcauccccagcuuccucccauuccuaacagggaaaggguacuccaccuucuuuccuaaccugucuucuuuaaucccuuucauccguccuucugacuuccacacuagccuuugauuucagucuuccuuucuaccaaucuauuuauuucugcacaaaaguauguuaaauuauccccuauuuucuuuacauuuuccucugaagcuuuuucccuuccuucagcucauggccuagagcugaaagauuccugccagguuagggccguaguuaauggauucaacaguaaucaacaaguaucuugaauuugcuagucugucuagugacccgauuugcaaacauuuuugauuacaagaauacuuugacuauuuaauuuaauagaaaguucagaacuagccgguuuaauauugucaggaagccuuucucuauuacuucagucugccugauguuuccuucucaaaauuucucaggcaccuauaucauucguuuuugcaguuaucuuguuaauucauaaaauuaacaaaucaaaaguucuuuagagaccucuuuguucugacaugaaaaucacuuaacauacucuuuuuuuaaauuuuauuauuauacuuuaaguucuaggguacauguauacaaugugcagguuuguuacauauguauacaugugccauguuggugugcugcacccauuaacucgucauuuacauuagguauaucuccuaaugcuaucccuccccccuucccccaccccaugacaggcccuggugugugauguuccccuuccuguguccagguguucucauuguucaauuccuaccuaugagugagaacaugcaguguuugguuuucuguccuugagauaguuugcugagaaugaugguuuccagcuucauccaugucccuacaaaggacaugaacucaucauuuuuuauggcugcauaauauuccaugguguauaugugccacauuuucuuaauccagucugucauugaugggcauuuggguugguuccaagucuuugcuguugugaauagugccacaauaaacauacggaaaaaucacuuaacauauuuuuuacugcaauugacaacccugacaaauggguuauguuucuccuguaauuacugcauuuaccuuaguguuacuccauguuuucacacugguuugcacacguaucuaaguucaaucaggguggauuauuuuugucuugccuuacccaggacuauacaccuaacuuguuuccucauacugauuaagugcucuuucuauaccagaucccuagguuacuggccuauuuucucccaagacgacuucacauuuuaccauuucuggacuuugucuugucuuucaccaauacucuuauugucucuaaauuucucagaacagugcugaaugugggggucaauauuuacuaauuuaugucaugauauuuauagaauaucugaaaacagagucagguaaaauaaagguuuguacauuaugcuggaauauuauggaauauuaucaugacauuaaaagucaggccuucaaagaauaaugacacaacacggucaguuuaugagauuuauuagaaugccuacaguacuaauaacaugaacuuuuuuaaaaaaauuauuaaguucuucagauugggaggaaaauauaggaacccgauauucaggcucagcuuuugguuacccugucuuuaccccuuucuuucugauggauuuucucauuuaaugcaucucugccauuuuaauuuuguaaagaucuccuauacacaaagcaccuuuauauuucccugccaguuacuguuagauauuuugugugauuagcauccucugaauguugaggaacuaugcuuucuacaugcugguuuaccaggugcugaaaacuagaguuaucaaguaacuaccugguguugcccucucauuuucuauaguucugcucaauauagugggcauuguuggcacaaaauaaauaaguacacuggacacuuucuguaauauaauacagauuuuaugcuguggaaacaugcugcagaugacuccagucucaugcauaugaauggggugcaaaauggguguggaauuuucuguaggguaaaccuuucucuucuucaggagagguagucauagauguuuacugcacuaagauguugaaagaaccuguccagugaaggcacauuuuuuuguuaauguaaaaucaauucuuaagaguaaucuuuuucagugauuuccggaucaugccuuuuaauuagcauaaaaacauggaagcaauauuaauaaugaaaauauauaucguguaauuuucaaucuacaucuuacauauacaauuguuauuuuaaaauuugacucagaucggcuucuucaaagacacagcaaaaccuugcauaaguuuuugaaggucuacacuuagauuuuacauauuugcucaccugaccuccacaguucugcucacuggcauguacaccauuucuguaccucuccugcaaaaaaaaucuccagcuguauuuuauuccuucucauucuuaccugauagccaaucagccaaaaugccaauuuuuugccaguuuuucauguacauuuccuuuuuauauucccugugucacugccucagcuuaguuuuuaaucgucuccuuccuagcucauagcauugguuccuuaauuguuuaacuggaugaugccagugauacuguucuuaauuucauucucuuggugagguucuuaacgguaaccauuguguaccuuguuuguccucauaauguuuagcuacucugauuugugauucuauucuaguugaccucacauucuauuuugaaauaguuuuuaaaagaaucauaaaaaauuagggaacuuaguauuuguccuuuauaacugcauguuauaccaucucuacaguugaaugacuauauauacauauauauaucuuuauaugccucuagaugagauuuuauacgucaucuagagacuauuuauaauaaagugauuaguaguuaaagacuacugauuaaucugaacacugucuacuggguuaguuuugaauuuuguuuuucaauuaucauuuauuacccuaggauuucuaguaccauucugaggauaguagcuggauuaauaauggucagugaaguuuaaggugucauaugaauguaacacaagaaaauuagagaucagguguguuugaaaucuuuuaaaaucguauuuaaauaaaaauguggcuuccuuauugguguggacucauacuuuauugguuguaauccugacccucucauuuucugucuaugcgagugcuauuuaaccucucucagagugcugcugugaggauuaagagagguagcguauaacucaaauuaaugccaugcuuugugacucuuaagugcucaguauauauuaguuguuauuauaacucauuuccuaugauaaauagguacacaauaaucuuauaguuauguacaaaggggaguguaacaacuuuuuucacguaaauugcucagcuugcaaauuauuauagaguuuaguaaauaaucagccuucaguuuuacuuucccagaaagguuguaucagucuuuuauggugacuauuuaaguuacuuacuuuuuucugcagugauugcuucuuaaugcugaaaucagaaagaaugucagcaagaaggagagcaggccaauuuauaauucuccauuugggauauaugaacaagcaauugauuaugcuuugaucuuuccgguuuuaccuguccauugaaaucuaagauggcuggaaacaaaaucguccucauuuccugguaauguguuagaaagguucuaauuugggguaccuuacucagauucugacacuuugagaauagauaaccaugaccguucgauuuuuauuuagaaggaacaguuuaucucaacccuauuagcugaaguguaauaccagaauggcuucuuuuuauuaaugcucaauuauccugagcauuuggggagguaaaugucucuucauuuauuaacuguacuuuuuuaaaguugacuuuucuucucaggaccauuuucaagugaggguauaauuggcuagugaaagagaccuuuaccucacaguuucaguuuuauuauaaauugcccauuagugcauuagaaacaaagugaaaaagugagaauuguaacuauucuuuuauucuauuuguucuaauccugccacugaauuuuuuucaacuuuuuuuuaauauaugaacucaguaugaaagauguuggggaaauugaauacauuauugguuaaguugucaggaauaguaugaucuucaaauauucauuuuucugacuucaaaacugaacaaagccucacacgcauuuggaguuaagcuauuucaccuuguauauuaaauauaauuuugcacaucugaaaaauagcagguaauguacucaccuaaacgauaucauucuuuugugaggcacauauuuucuugggagauuagagcuuagagaauaaagauuaagugacuacuaaaaauuaauaagaaggcggagucagaaugaaaaaaaaaggcugagggcugaagucuuuguuuauaucagcuuauauaaucaacaccuucucuuuaucaaauucuugaagccaugaguaauaacaauuuuauuuuaugaggaaacgugauauccccuggaaaacuuguauauaaauugcacagucuuauguucccaaaggaugcugggcccuugaaagaaacacaggguuauacauauauuagaggguagguaaguagcuggaaaaaucuaugaaaggaagccucacaucaguguaucucuccuagaaauuaaaccauuuggauucuccuuccuaaaaauuccuugguaggagaccaaguuugaguuauuguucaaaauugggcuacuggcaguguuucaagggucaauucuguaauuaauccuugugugacuaucuaauuuauugcuaguagaaacaaauagucugguucuuugacacauaauuuaaggcaggacagucuggggaucccuuuucuaauguacuagaacuaauguuuugucuuuagcacauagcuuauugccauuucuauauaaggcaugaauuugugauuuuuaacugugauuuuguuauuuuaaaauuuacaguacuuaggcauucucucuucucucuugcuuucagaauugagucccuuucuaacauuuuuguuuuuguccaaauuguaaauguauuauauuguuggaaaauagaagaaagaagcaacagauuuagaauguugaaagauaauaauaauacuguuuuuuaaaauauauuaccuacuaauucaaacaucuucagguuuuagaaaacuagacccauguugaguccauucuaguauuaccagcauuaccaguuugaguagaugacccagaacauucuuuaucuccuuucuuuuuuuugagacagucuugcucugucacccacgcuggaguguaaguggcgugaugucagcucacugcaaccuccagcucccggguucaagagauucuccugccucagucucucgaguagcugggauuacaggcacgcacuaccacaccugacuaauuuuuguauuuuuaguagaaaugggguuucaccguguuggccaggcugcucucgagacccagaacguucuuaaucauuuuacauguuuucauguuagccuaauuuaucuugauauuguguucugcccuucuucccacaguguaaaaucuuugcaaauaauuuauugcccaacaguauuuuucagcauguacucugccagugguaucacuaccauuuuagcugaaagauuugcuuaacacaccaucauuguugucuuuuaaauuauuuccauugguuauaccaaacaagugaaauccuguauagauuuccacuacuuugaacuccuccacauuucagugcucuuagaaauuuuugugauguuggaaauuuucuauaguaugugcuguccaauaugguagcacaauuuauagaauaugugcuuugcaucugaguuuuagaaauagcugugaagacaauauaaaaagaauaaguguugcuguuacauuaucuuuuuguauucagaagcuuuguuucuaaccacucucucacucuacuaagauguuaaugaaaaucaacacuauaguuuucaggaaucugcuaaauaaucagauugagaaugguuauuaccauucuacauauuaacccauaaaauauuaaauauauuccuguugcuuuuuucugcugccugucccaccaccaccauuguuuaggaugaaauaucuuauacacuggcauacaugguacuuaugaacguuccacaacaccauguggaacgcugagugagccugauagagauagaauacagcuucuucuuuccuggcuucucuguacuauagacaaauucuuacuuuaucugaauuuagaaguccuuaaaauuucauucaaauucaauuuguagggcauugaauuaguggcauuuuucucugauagguuuucuguaucuuaugagaaauuuuacuauacaauccucguauguucauagggagaacugaucugcuuucacuaaauccagaguaugccagaagaucugaccauaagauacuuaauuucugguaaaauugaaaguuuuuuuuguucaaauaaaaugcaucaggugcuuucggaagacuuggugaaaauaacaauaaauacauuuuuuaucuuuaaaagauguacuucuauguacugacaagaaacaaaucuuuaaaggacacaguuguuugaacuaaugacuccuucauuagcagccauacuaaaaucuuuguaaaaguucaagaaauuauacauuuuggaauaaccacuauuauaguguuacauauaucuauaagcaacuuugaucacugguauuggcuauguaaaauuauguugaucgauacuaagauguuuauugaagacaguuaauuuaauugcauucauacaucauuagauuuuuuuucaaagaagcuccauuuuaaugccauuuuauauuauuuuagaacuuucuauuguuuguuuaccacagauuuauauuugagaguaagaguugauauuaauacaaauggcaugugccuuuucugauauuacucuuagaaauaagaagaaaaugcugggugugguggcucacaccuguaaucccagcacuuugggaggcugaggugggcagaucaugaggucaggaguucgagaccagccugaccaacauggugaaacccugucucuacuaaaaauacaaaaauuagcugggcgugguggcgcaugccuguaaucccagcuacucaggaggcugaggcaagagaauugcuugaaccugggauguggagguugcggugagcugagaucacaccauugcacuccagccugagcaacagagcaagaugccaaaaaaaaaaaaaaaaaaaaaaaaggaagaagaagaaaaugcaaagaaaacaaaaaucagaauugugaguguuuuauguuaugaaacaauacaguggucuaucagcacaugccaauuauugcugaagagcagacaauaaagcgaccaguuaaagccaaaucugucccuuaauguacauauuuagcaucuagauggggaaguaaaacacauucucacccacuuaucuuauuauuuuaauaacacuaucauagaaaugauugaauaaauucaguuauggauaauuuuuaagaagcuugaccaaaaaacaauuuucuggacucuggaguuuuuguuuguaaaauuguugugaaauaguguccugauagauuguauucuuuuauuuuucgugaaggcuaaacuagucuuaaaacuauuuuggaaagagaauggaagauucuuuucuauaucuugauuuuggcaguaaccuugucagccuuccaguuggccaggaauuuuuuacaauucacuucauuugaguaacaauccugacacucaauugaugggcuggaaagaaagcuuccuuuugacagccaagccuuagccggagacucauccauguaucaacggauauuguuaucaucaugcucuuuuagauagccuuuuuguuuuguuucagguuggcuuugcgauauauuaaagccucggacuacagagaaaccuuuaaauauucagaauagaauuuagggauuaaucagcagucuuuuaaaugcaaguuugccuagaguuugagacagcuuuccaaaugguuuauauggauaguuauuauuauuuuugagacagagccucgcucuauugcccaggcuggagugcaguagagugaucucggcucacugcagcucuuauauagauaguuuuaauggaauugcuuuccagauacuaaacuuucacauguacccacauguucauaaccaccuuagaaaagaaaagcauagccauuacauaccccaagucuuaccauggugcauauuccugacggaagggagaucaaacacuauuuuuucuggaucccuccuucugguuuaugaaacuaccugaaaccuuuuaagcccuucugauuuaucaaaauuacugaaaccuuuuaagccucuugccuuucccgguccuuuacaauucuuauauauuucuguuaaggguaaaacuugcacuuaacaguauauuuugggauauguugggauucucugagaacaauuuuuuuuucuccccuaaacucaggaucuaaucuuggaaaagcaaaaucaaaagguuuaucacaggggauuugugugauucaaauaggauaaaagugccuagaaacaauagcuuggcuaauuguuaaucagaaggacaaugcaaauuuuuaaaucaacauggaaguaacaugauugcuaugaacuguagaucuuucagaaucaagaacuuaacaaagacaacaacaacaacaaaaaacucaaaguauagaaacuuauggugguaaaccacaucccuguuaucugaauuuauuacagaagguaaaaaauaaccuuuuacuaaucuuugcugagaacagaguaaaugcuguaagaccaauguauuauuuuaacaguuauuaaaaauaugucgaauuuacauuaacauaauauguaguggcaaauaauuuacaugcuuucuuuucuuugauauuauuuuaugaauaagucuaucaacuuaccaaaauuucacacauuucauuauuuccuuucaggcucauuauuuucugguguuaucaaacugagucagcucucaccucuuacacaacuuguacucacuuaaguuuugucuuucaccauaccuuuucauauuauaaagcgaccagacacuuuacuuugaaaacuucuuuuuuaaaaaauuuccacuugacaaaugaagaacauaauccauaacuuaguuacacaguugaacuuuucucccccauugcuuguauaaaguguggagcacccauaugaauuauaacacagagagcuaagagguagauauuugagauauaucuaucauuuauagucauuuucacagauaugcaaagcucauaaaugccaucacacaaucuccuacugucauacucauugauauuacacuuuauuauugugggaaaaaguacuuacauuauaauuacucaaagauauagccaugcuauaauucuaacagguuggugauuaguuugucaauacccuaucuuacguagaaauucaccaguuaucuaaaaacgauccauuaaaucgacuuaauuauguuuaaccugacaaacuacagcacauacuuauuguugacauaaaaagauuuugguugaauucauaguuuuaugucuuucucagugcucgacauuguuguuagcaguaaacguuuauaauacguuuaaguuuagauuaauucgucucuucaugaggacauuaaaccaaauuuuauuuaaaaaauaauuguaaucuuggaauauacuuaauauugguaaaaucagggaaagauauauaguguuuucaaaccaaaauuauaaaaaaugucauaguaguuugaauauuuaccuuaauugcauaaacuugguuuauauccuuauucaagaaugcucugagguuguaucuucuacaaauauugcuauuuuuuaaauaaaguauuagcacauuuaaauuuuuuaaauacagguguuuuuuauuuuuuuggaauucugggaacguuagaugaaugugauuauuaacuucucaaagcaaucauaacagaacucauuauuagagauauuauuguauaauuuauuaacacaucguggauauaggaaaacaucugaaaguuauagugagagaugaaguccuuucuaaauuaaauaaacacagaaaacacagagagcuuucagcuuccauucuucaaccucagccuugggucaagaguaaacaaacacaaaaacucacugcuucaaaugugaaauuuuucuucucuuuuuuuuuccuguguaugaaauaugugcuugcacaaacgaaucaauacaagaaacuacaaaauacaaucucuguugccucucauccaguggauaauagagaaucguaguuagagauuaccaaauggucagcaguaggauucacuaucauugccgucaccaacuaggaauaacuuauuugcugugugcacaccagaagaagaaccaaacaaguaggcuaggaaccagaaaauaguaacacaaacauagaguugggauaagaaagagaaauagagaacucuuacagaagguaaaguucuaauauugauaacuucuauuguuugaaauugacuccugggaccaaaaaaaagugugccuuugcuuaaauauuucuaguagguaaaucaccucugggaggcauaagcguggaaccuccaaaacugucgaagaauaguuaugaaaagguuugaaacaucacaccuguacaaauauagaguaaacauauguuaaaaauuuaacucauuaauaaggaaaauagugagauggaaaaacugcuuuaaaggaaaaucagaggaacgugaccuucugaagcuaauacuguccaauaagguaauggcacauuaaccuuugagguuaucauuucuuuuggggagaaaauuaacauguacuucacagaagucuaagaacuuuaauuaauaguaaauagcaaagucaaacacaaauacauucccuuagguaauuaaauaauccuuuugugagccugucaaacagucccuaguguauauuaaaagaacaugccaccuacauuuuuauuuuuugccuaauuuccaaguuuugcauaauuuuucauagcagugcuaacagauaaaaauaauagaugucaucuuuaaaauauucauguuaaaauuaguuuuccaaagccuacauaaacaauaaguuugacuacugaguagauuauacuugucaucuaguucaucucccaacagguuaaauggcuuuaccaagaaucuacagcaaguuauagggagaagagcugaaagauaaaugaggugagaugagccuggaaaauacccaguuuuauguuauuucuuuuuucuguacuuuaauugcucuuuagccuguuucuccugaucuccuagggcacaaaauguauggguauguaugcauacagagcauuccuggaacuuaaaccuaaggauaacuguguugaaacugcugacaggauaaaaaccucauguaauuaaaacugccaaucacaaucaggacauauauuaaugcuguuuuuuuuaaagugguuccaugucaucuguugaugaauuugcaaaacaauuaugauuacauugacagugaagagguauguauaugaaucaguguuuagaaucuagaugcuuauuuccgucuuugcugaauugaauauuuuagauggaauuaaaagggagcuauaaauuuugcaaaguuacugccaaaauauaguuacaaauuuuacaaaaagcauuucuugaaaagcauauucuagauuauuuuguuuagcaauuuauauuuuagaguuuuggaaaaacauuauauucaauauaauuaauucuucuuuucuuuugaacugucauagaacuucacucuguaaucuuauguuuuuaguaaauacagacuuaagacuuuuuaauuuauuuuucuuaguuuuuauuucuuuccauauuguuauuaauguuguuuacacaauaugggacaaaaccuuuugaauuuaaaguuauaauacagaaaauauuuuuauguauccuguauuuucugaccaaauaauuuaguaguuuuuuuguuggcaccacaucuauuguguacuaaauacacuggaaaaaaacaaaauauauauaauuuaaaauuccgcucuuaauuuuuuuaauccaaugaucaucuaucgaaauggacuuugagucacuaaauaaauuauuuugaaagagaaucuuuuuaugagauuuuaguuuauuccaaccccuuaacugggacaugauuucuaaaggaaacauauuucaaauuuacguaguggauuucaaaauuaauuaaaaauuuaaguuuaaaagaugacuacaaugagaaguuaugcugguaaauccuuucugauaauauuguuaagaaguuauauucaucugaaggauguguuucuacuuaguuuuucacaaugcgugccuuuauaacuaaaaugucauuuuuuuaaaugacauguuugcuuuuuugcuuuuuuucuuguccaauuuacuguccacgaaaauacuacuuauaaguuaauaagaaaaacgaaaaaguagcaggcaaaaaaaaaguucuaaaauauuaccauaaggauaauacaucaaagaaauuuuaauggaauuuucaucacuucauguugcuggacauguguaacuacugcacauauauuaaaguggucccuacccuuuaggaaaaugcauaggaaaguguugcauaguagcacaugagauggauaaccuugacaauuguaaaaggcaagugauguucaugaccaacauacuuuacacaugacuguauaugagcauuugauuuguaucuguugauauugugugagaagaaguuuaaauuucugaugguuuaguuugacgcuggcaaaaggcaaugcagagaaaauaucaccuuuacucuucuaaccucuauuuuaaagugaucggagcuaugccauacagaguuucuuuaacuuuaauaaguauauccacugucccuaauaauuuucuccauuuacacuaacaucuacagggguugaugcaauuuugugcaacugaaagcuugucaaauuuggaagcuccacuuuaggaaaaauaauucauaauuuuggauauaccuuuaggacaaaaauuaauauuuguguagaaugagaaaauaagucacagcaaauuacggaauuuaaauuuuaacaaauaacauaguuaucaugaaaacccaggaaaauagcauaauauuuguguucauuaucuuucugauaaucucuauaaucuuuuucucucacauuuuuguauuuuugcuuuuugaucaccuaaucauaugaugagacuuuucuaauauuuucuagagugagaauaguuuuugcuuuagccuggaauaauaaaaguguauuuuuuauuuuugauguuauaggauaguuuccuuuagcuuuacaacucauuauuggugugugauuuaaauuuauaguauugucauuccauuuggaaacacuucccaucaaauuucuuacauacauacuguaagguuuggauuuguuuucauuagcuaacuaauggcucugugcauugagccuguugcucuuuacuaccagaauuguguagugcugggcauguggaaguucuucugggauaugaccucuggcccuucauuuccuguccuacacugguggauguuuggaagccuuuccuacaccagagcggcuugcugaacaucuacuggauccaguuuuaguauggguucuuaaaaguuuuacuacauaguuagguaauagucaaaauuaacacaaaugcaauuaucaaacaaacccagucaaccaggauugaaagugucaaacagugcaacaaucaaggccauucuuugucaugaucaagagcacagagccuggagucagacugacaaagguuugagauugaugaaagauugucaggugacuuuuuggucucuccuacauagucuggaaaucagaauuuggagcuuuaaacuuuaacauggguaggaugccaacuaugcuuuaaaguuauuuucuuugaugcagaaagacauaauuuuuaguauaucauaacauuaauucacaccauuaaucuuuuuuucucugcauauugaaucauaggacuucuuuucacaacaauuuuuguuguuauaauguuauuuuaauguuacuaauuagcccugcagaaccccuaugacauccuuuggcaucgucucccaucgucucucucucucuuucucucucucucucauuuuaauaauaacuguuguauaaaaauugcaugaggaauaaguucccaacucccgugaucugcuuauaauagcuguacuuucuucauauagucuuaagaggcaugucuaguuuaaguaccuuccagagaagguguguauuuaugcaaaacuuuucaggggcuuguuaaaagugaagcuuuugcaugauuuguauaagaaaguaauuaggauaucuaucuaaaugauaauaagaauucaaugaguacagauuggcaauuccacuuugaagauuauggaaagauagagauuuuauauuuuaaaacaauuuguuaggaauaucaaagcagaaaauauucuagauuuggaugaacaaccauauauuuuguuuaaaaagcaagaaauugccccagauuacuucuugcauuagcaauguauauaucaaagacuccggaaaaggaauuuuuuuuuuuuuaaccacuaaccacuccuugcaaaaauaaggagcauuaggacuuuccucccuacccuuuacuuuuuuaauucuacuaauuguucacacaauuauaaaauauguagaagauuguuuuauuauguuuuuaucuguuuguucagugauaguguuauauaguaaaagaacacugguuugggauuaagcuuaacgguguuuuagucugagccucaagagacuuuauucauacucuuuaaccucuauaaaccucugcuuccugcacuccaaaaugggacuaacuauacuaccuugccuacuucuaaguuugcugugaguaucaaaugacaaaauguguaugaaaaugacaagccaaugugucauccuugcaauuaccauaguugguuagaaagauauuaagcaacgguuaaacuuuuaaauccuguuuuacuuguuuuuauuaugauagaguucuuucuucuauuauuuauagaguuauauauauguaucauccguauccaaacuaauauuaauguuauggcaacuugugcuuuuugagucuuuccaaagauuucaacaugauuuucauaaagcauaucaauuuuuuucacucacauugugugacaucagguuaaaaaguuacuaacuuaaauuucuuagaaauauugacuagaagaauauauaacaauauaaaauguagagacgaguaugaaauauauuuaaaacucauuacgauacuuuaguucauuugcuauuuguacaaaggaagcucaaguaauuucaguaccuauggcaagauuuauacauucuguaauuagauaucuuuuaaaaccuacggugauaauuuucuuaaaaauuggucuuaaaguaacauuguuaacacauugguaauaagaguauucauugccuuuguuuucuuuuccccucauuuuauauacaauuuuguuaaugacuguagauuuagugguauaugugguagcucauguaaugcucuaguaugcucaguuuaauuauagauuuuuuuaaaaggauaauugccaagcuuauuuguccugcacaacaucauugggaauacuuuaaaaaguuuucagggaaucagagaaaaccaaacuaaagauaauggccucagaacccaaauuauuuuuacucugucaugaauuuugcuaacaaaaucaaaauaaugaguacuaacugacaaggaccauuuaauaaucuacccagcuaagguuagcagucaauauuuuacaugauauuucacugauaacuuauuuaucauauuuuacaugauaacuuaagauucugugggucuuaaguuaugcauauucucuuuuauuacuuuaauaaauauuaaaccacaacaugauguaauuuuagcuuauuacuaaguauuauaagagcacuuagaauauaacuuuuuacaauuaccaaaaauuuuuuaaugucuuaucaacaugaaauacuuagucauuuauuuagaaaguauaaguuuauuaguggauuuacuguguccugauuuaggucaguuaccuuaaaaauacguucauuugucuguuuuuauuaaugcuacaugccaaacuaaugacauuuaaaaucauaggaaaaagagauuuggcauuugauuuauauuucauggcaaaaugcacagguuuggguaaucucagguucuuaaauucuuuccacauuaaauagugagcuaauucuaacuuuuuuacuguacuucuucguguuacugcauuagguuuuugaaucugcuuggaugacucccgaagagcaguuuagucuuugagaaaaccagaucuccauugcuuccaugaagaucuuauuaauauuuagauaauggagaguaacgaaaagaauuuggacauugaauaugucuuugucuucuagcuaucauucuccccaacuuaaucugugacccugagaaaguuacuucauuucucuugaguccucaacaaauuuuucuuacacaguauaugccaucuuaauuaucuuaaguauguacuugaucaucucuagagguuccuuucuagucuuagguuguaauagucuuugucauacuggaaaaacauuuuuaaaaaccaucaaaauguauucuuuuuuucuacacuggaauugacauauggcacuauaaagaucuugugaugguagaagucauacauuugaacaugagaauauuaaugacagcuuguaaccacaguauuucuuauccuauucuaagaaauaauuuuaguuauuaagcugguuuuuuuugguaugucuugaguuuauuugaacgauugaaguauuuggaauugcgucauguaauaguucacugcaaaauuaaaguaauuuguaugaaugagaaauggaaucaguaugguaaacucauuucauugugcaaaauaucuuuugcauggaaggcuuaguucuauuaauaauucaaggaaauuuuuaaaauaauucauuauacauuaaaaaaacuacuaagugugcuaacaucuugggauagacuacgggguaagaaagaaaagagaauauggacucuccauuuaauuauauguuauuaucuaauaaaacgaauauaugccuuuaucuaauaaaagagguauagugauauuacucccauuuuccagguaucaaaauggagacauagagugauuaugaaacauuacacagcugacgaguggcagagccaggauucaacucagcguagcuccgaaauccccucauuauuguguuacacugacucccaccuaaaacuagauuuggggcauaagcuuauaggcuguuaaaaauagugaguuuuugaacauaggaccaugucuucuuuaauucuuucuuuccaaagugaauguucuuauaaaucaaacaagagaguaucuuagagaagggagucaauucucucaguuauugggagaagaauagacucacauauguccugcaauaggcauuucuggauaaaaugucucaggauguguauuauauuuaaucuacuaugaugcaaugacauuguuuaacuuagauaccauguggauacuccuuauguucacuaaggguacguauagucuuuuguuaccuaggucauaacagagaagccuuuguguaccauaaucugacucucuagcuauaauuauguaacacuuuuauuucuuucacacaacucuuuauauauacaacuuaaacauauaugucuaucacaggacacuauucaacagaagacaccuauaauauaggagugugcuguugagaggaucaggagacucugauuucugauuugaaagaggaacuaugagaaaacuagaaauaguuuucuugcccaggguguucacaaaccuuuuucuauaguaaauguuuuagucuuugagccacaugguaucucugaacucaacugugacauuguaguaugaaaguagccauacacaauaaguaaaugaauggguauuacugguuuucaauaaaccuauacuuauagcauagacauuggcugucuauggaaccauaauuuauuaacccuugcucuguuaaguaaaagccuuuacaauggauagaaauaagacagacauaacucacacaaaaaggcacuucuugucuacuucuuuucuuuacaagaagccuaagguaugagcaccuaauugcaaaccauaccacguucacaaaugagaucaugauguaaauaauggaagaaccaaauauggugcuuaaaauaaaaaugguacccaaaaauauaaguccuugggaauauagugcaagaagaaacaccaaucauucucccuucugcugcaguuugggauuuuguugacauugguauuucauguuuauuacauggauugaaggcaacugaauucauguuaguuacauuauauuuacaaaaguucaauuuaauuucuauucaaauacuuaauauuaugagugccugacuacauuucagauauuuccaaaaggauggaaguaagagaauaggcaaacugaaacaaucuuuuuugaaaauauuuuuguaacagguuucuauaagaagguguggguacaaguguuuacauuuugugugguuagauccaccacaagauuaugaguaucuuaagaacaggucccaugccuuauucauuuuugugucauucccauuccccauaacaauacuugggaaaaaggaguuaaauguuuuugaagaugaaauaguaauuaaaguucacauguauauugauaugucuuuucugcaauaguaaacuaaucccauuaagauauauauuuaagacagauuuuuguaggcaaguaugcaguagucuuacaugaccauauauuuauggaauucaauauaugcacacacaaacuuuaauggaguaaguuuugaccaaaaucuaagaguaugauagauaaugccaaauacagaaaauauucauauauauauauaguaguuggugguggagacagauaaaauacauaguauuuuccggccaaaaauauuauggugauucauugaacuuuuucacucaugagcaugaauuuuuuagcucaaaaaaaaaccaugaagcauaauuuucuauuuuucacauucauuuuagagggaagaaugauacaguuauuucuagaaauaguugucuaagaacaaugaauuucuucucuuuaugauaggguccauuuuaaauuauguucauuuauguccaauucuugaagaaauaaggccaagcuuugaauuuauaguccgcaaauuuucuuuuuuaaaaacaaacuaguuccuaaggaaugcagauuuuuuuaaaaggcaaccaaaaccuaaaaaacuucucuccuuuuuuguccucuuauugcuuaaaaaaguacaugaacauacuguuuuuaaauuuaggcuuuuaaaaaauuguccucaugcugaguucuuguuugccaaguuucagcuuggagagaauuuuuauagcuuuuauaaaacccugaaaauagaaaauuuuaaauggaaaugcuuacacacccuuagugacagccacaaaucuugccacuuuuugagaaugaagguaauuuuuuaguauuuagggaugguagcaacacguugaugcgauaguuucuaaaggacagagcuuuuguuuagucguauguuagauauguuacauugguuuaucauauuaagauucauauuaagauuuagcuguauguucauacauuucguaugugauauaaaaguuuuaaauuuuagagugcauuuguccucuaccacauauaguuuauauguagaaauaugucuuauccaucuuuuugauaugucaccuauuauuuaacuugacuagcaauuuaacuugcaagcgauucacccuagaaguuagauuuauuguaguugaauaaacuguuguccucucacuuuuaucauauaaaccaaagggucaguugcccuuuggggaaacccagaauaugucagaucuuugucaggucgcugugggucuuugucaggucccaacucugucacagggauuuuaggcaacuagaaccacaggugucacuuccaaaauugauagcuuguuauacugcaaccagagucaauuuuagauuggagaagagaaagaaaaagaucggaaaugauugaagcugugggcaccaagaaagggcagugcuggaaagagaaugaaugacauacacacccaauaacagggagcguuggucauuuuugcauggaccaaaacaaaauugaagaaguacugcugaucaaaggccaauacaaugcacacauaucauucugguuagguugucuccugagaaaaauauuucucagcagcaguaugauuuauuuugaacaauaucugauugaacagcauucuaguaauguagaaaauuuauagacaucuacuaaauuuuauucuagcagauaauccacauuaaaagagacaaaaguccauguuuuaccuagaaccucucuguggcuccuuuucuccaccagaaagacaauaauuucauaucuggcagaaguuaaugcuuuuuaaguucuugacguguauacucuguggaagaagugaccuaaaaggaaaaccaaauaguuugauaaaggauaacuguaaagaacaaaaaaaguaaaacaaacuacuauaagacuaauaguccuugagacaagcgcaugaauuagugaugaaguauugcuuuacuacauccugaaaauucuuuacauuuauuucuucaguugaaugaagcuuucuaauaucugugucuggaacuaauucugauaaccuuggcauucaaaauggagauaaaggauagauagccuuccacaaaacgcuucaguauggcaagaagaaucaucuaauauugacaaauaaagcaacgugacaucuguguugaauuccaaauugacuuguugagcugugcaaaaaaguaaaagaaggugcuuauuuucaggaugugaaauacauugggaaaagccaaggucaaagaugaaacaugacucaaugccaaagauuuucaaucuuaaugaaaaucucuuucaauaagaaauugacgauugagaaacagugucauuguuagaaguucgauguucuuuugggggucuaacagacgaagccccagagaacugacuuuuauuaauagauagcuuaagauuuauagcuuaggaagaacagauuaauaguuuuuggaguaaagccugaauuauagaaggaugaccugagcccuggcaugagugaucaaucaguucagugucugcaacugcacaauuuuaagaacucuuaaaaggcucuuuggccacugaaaaugcauuauaaaggauaaguccauaaccagccaagucuggaauauauguuuauauggcuauacagauccaguguuucuuuaaaaauaaagcaaaggguaugacacagguugguuugcuguuacuuaggauauguacgauugaauugagccuaagauaagugggauguacuggguaaaauguggaugcuggaggaggaugcacagaggcuaauuugaauccaggagauuuuuccauuuaggaaauagaauuggagucagggaaguaaaaaucuugaauacaaagcuaagaaauugaauuuuccuuguuaaucaggguucaaccauugauguuuacaaaugagaaaaauguuucaugcagguuaauccuacugcaauauuggcaggaaagguggaggucagcgggaagagaccucuggaaaccuguugaagaaugaguacuuccaggguaaagcuacagcaggcaggacagcagagugguggccuaggcauuggagauaaaggcaaagauaaaacacagauggaaggaaaauuccuaaggcaccaugagacacuggauauugagugagagagaauccaaagaacgaagaaucacucacgucgagcucagccuacuaggacgucaauggguuccuuauuuguuuucuguaacucucuucucaaaauggaucaacuucuuucaaacuucccuagugcaaauucugguuugguuacuuuucuuuucuguaaaaugauaagaacauuaauuagucuugaaggaaccauuuacugcauugcagaugauuagaaaauugacaauaccaacaaaaauugaauuggauucuuuagguuuaauauuuggccuaaacuaacauauuucaccugccaugugccacacucacugauuauuccugagauauucaccaaacccuuccccacacuuggcagugaguucauuaaugacagguauuuauuuuuuaucugucuccauagccucaacacuuaauaacauuccuagcacuuaacagauguuccauaaaugaugauuaaaugaauaaauagaagccuagugugauucccagcuuugccuggaauagguccugcuccaauaggaacucuuauaccucuuuaaagagauaaggaguucggcuucagggaaaacaccuuguagacuccauuuaucauuacuuuucuagguuguugucauacaggaaaaaagaaaugaucugacacauuucuuuccagccuuacacacuaauacaguauaaggagccacagagaggaauuuuaagauuuuuuuuaagggagaguauuugauuggccaagauguuuguuuaauucaagagaaggaaagccccaaaugcugccuaaacauaaacucacaauucaaaacauuuuagaaauuaucuggcaacuuuacauagaguccaaauguuuccaggguaugcagaaagaugccccaaagucuuaaguacccccagggaaaguagaucaaaguuuagagaccauuuagacucacuuccaaaaggaucuggccucagaguuuugcaguagugagcaaaaauucuagaaaggucuagguucagaaaccauagcaaaguuacaagagaaagguuuucuagcuucuguuucuuaugccauucaacaagauuuagaaggaaaugcagccaaauuuaauggucguuaccugaugaaaaacagacauccuuuggauuauccucaagcagaacugaacagaacuaaaugcaauuagaagacuccacggaggccaagaugaucagaugaucgaggaaagcaaacugauauaaaauauaagcucaccauguuagguaacucauguguuuccaacauggugcuauuagaggagcauuagagaaauuuacuguaucaugaagugcacauucguuuccucggcugaggacaguacuacgacaauauuugacaggaaauguagagaauuuuuauuucagucaacucuaaaaagaauggcgaaauucuugaagcuguguaugaugauucucuauuaauauucuuuguucaaucuuuaaaauggcguuuauuucucaaaggaaaguucgugccaucaauauugauuccauuauauuugugauauacaucaaguuuuaucuucagagugaaaaguucuuuguauaucuuuguaguaaacacagauuuuguucucauuuugaacaugcacuaauuucuacaugaacuaaauuucuacaugaacugggcacauuggcuuaauuuaaauaaacauguuaagguggucauuacuauucaagagucaccaauguucugauuuuuuauuuuauguucugcuuuuuuauuuuagacaggcaaguuguuagcauuuuuuucaaggaacaaagaacaaaaauuaucuugauaagaacuuguuucugaaaagcuagauuagcucuucucugcacaccaaucaugcaaugacaguacaauuuagugacuuaagcaguacauuaggauucucagccuaggcagaagcuucacccucgggccagaccuauauaauaguuguaagaaaaugauuuauguguuguaauaaauguuacuucucaaucuguuugcuuguucaaugguugaggucccaaaagaaaaggucuaucucaaauuaggacuggcauguauuaucugucaacuuuauauaguacuguaaaagucauucagcugacaguaauauuagcggaauguuuuauagauuuuuguacugugugaagcuuuguaugggugacgagagacuuugggucuguggugcucugugguccgggauaaaguugcguguagaugagucguuucugugcuucucuguaaaugaacaucuggcucacauauugauuccaugugugaaaaugagaucagcccauauaaugaccagaaucaaucaggcuucagccgaggaguaacauacacuggucuugauuuguuagacaaccagaauuggcagcaccuugcauaauuuggcaccaauugacaaagauuaggcuguuuggggacccugaaugguuauuaauuugaaaaccccuuauauauuuugcagaguaaaaucagcuguaacuuauuuguuccagcccccuucuucucguacgagcccuaauuguuuuagacaaacgaacgagcuugcagccuguucacuuuacacaggaagacaugaauucuuugauccauacaguauucuuuagcucaaccuuggagcuauuuacugaggagauuuauuugcagacagacaguagaacaguucuuugugaauagaaaugaguacagcuucuauguguuuucagcucaaguuucugcuacuuacuguaagggagauaaaacuaagccaucuuuauuuuuaacccaaaucauucuuuuuuaaaauauaguuuuaaaaacugaaaaugaauuagacucuugaccuuuuuacuuuuuccucacaaguuauauuuacuagagcacagauugaacucagagaaugaccaaauaccauuucuuauuuugugaauuguguuaaucaugaagaaaaacuugugagauuuuaaaaugggacaggcguugauugugaacauuuuacaaaugugucucacuccuuaauuccaggcacaaauaaaacuaccuguguuguaugaacacuaguuaguucaagaaaagcaauaaaaaucuacuuuuaaaaauuauuacugccaaguaguuuuaaagauacagacucauuuacuuugaauuuaacuaguaauauuuagguaaguaucuaaaccaauauuuaauuuuuucaccaauuaaaugagaguuauuggaacagucucucuaaaugcuuuauauauaugagccaggcaauguaauaguaacaauaacaagauaguuucauaacuaagccuuucuauaaugccauaagauaugaacuccauuaggacuguuugauuucuacuugacacagaagagaaaaaaaaaugaugaguuugauuaacaaaaucaguucuagaagugaauuucaauucucaauuauauuugacaauaaauuacucaaccguagucaucucagagcuuaauuugcugagccucuugauaaccaguauaugaaaagucacccccauguuuuuuuuuccugcauguuuuuuuaccccauuuuuuccccuacaaauuuguaggucauuaacauuauucaugaaauuauuuccuuuauauuucuuuuaacuuaauuuuaccaauaacuuuuagaaaccugugaguagcgucauauaaaucuuuguaguucauuaacaagauaaauaacuuucacugcaaauaaauauauuuugacuccaaaagaaauaaugguaauuaaauguuuuauuuucuaauauacauuuuuaagucauagauuaauauugacagauuuucaaagccauuauaguuuugaaguuuuccccuucuacccauauacaacuuuccaaauuaggagauacaacuuuuagaggaaagcauuucaaacacuuaaacauacacauuuaaaaaaauuuguaagcuuuucaguguaaacaugcauucaaucuauauguccuacguuuucacagucuuucaaauugccuccagaagucuuaagaccugacuugguaaacaaaaagcucaugaguuugugccaaaugcuuuacacgaucauuuugcaaaaauugugaguagagucauuggaaccaaaugcauucuucuaguggguagauagguuauuuguuauuuguaaaaauuaaaaggguuagaagaaaauuucagauaaagaaugcuauauauaaguagaaauugguaaaccagaaggcuuuauaauuucagaucauucaaugacaaagucacacguaacaccuguuacagaagauacacuaucaaggugucaugugacaucuuaaaaaacuggugaagugugugguugucucaaacaugaaaaaauuuuagcgcauagguuuucccaugucauuacuagccacagguaagaauucuuguauauuaaaaauauuaccacugugauuucaaaagugaggccaaguacucuuauuggaaugugugacaauuuacugucuugucugcacuguagguaaacuguguuaacagagacaauacuuaaccauggauuuuguuauauuucaaacaugguguagacagcuuuauauuucacaagcuacuucuuugucuuuucuguacauuuguuuauuugguauaauucuuucauugaaauaauaaauccuaauugauaaugacaacauucagagaauucuacagaauucuacagaugucuuggaaagggcugucuuuuauuuauuucacucuuauuuauaugaguguuuguuugaugugauauauuuuuaccaggaugacagaugaugugguucucuauaugaauaugaagauauauaugcugugccuuauaaaaaugccagccaaagcccuuuccacagcugcugugcauuaaaauaaaauguuauccugugaugguguuacagucagauauuuucuuacaccuaaacaagaguuuucauuuuguuuucuuuaugacauaaucuuaauauauuuuaacuagcuaguuacagaaugaaucguuguuguaaaaggucauauauuuucaaaagcaacaaucuuuuguggauuucagaauaaauaugccuaacauuauaauuucauggaaagugacucagugcuaucaguauaacucauaaucauauggccugacuuaugcuaggaaaacuauuucccuuaacaagacuauugaaccugccuauucuaccacuuacaaaaaaacaaccaaccaaacacacauacacaacuguguuuaaagguagggcaagggccaauucucaguugggugcauuagguugugugcaugagggcacugaauuauauuaauuuaaaaaauaguucaaguuuuaauugcagaggaguugugaauacucugaaauaaucugaacuuuauuuuguagggaguaagaaucacagcuccuggucuuuguuccacccauguaucauucuauaauugauuugcaaauauagaauuugcaaccauuuguggacaaugguuguuuuuauaguagucccccaaacacucuagaguuucuggacucauugugccuaguucucauuccccuuggccuuggacaucuacaagacaggcuaaaaacacacuaaauauauuuuuaaauagucuaaguaagauguaauacauuucugaaguuggaguguuguaguggaauugaagccaaagcacuugguaaccaauuggaugccaguaggaaaugagaagguuuagggaauaaaacaagaauacaaggaaguuaaccugccuucccaagacuguaagcaaguuguaugggaaguauguagaauucaguugagcaaucuaaugaaacacacauuuggggauuucacgugugcccuuggaaaaauauguaaguuauugucuauaauaauaagagugcauaauuuucguucacagucacaaugauaccaaauaaggggauaacaugguuuucaaugaaguaacaauuugaugguuugaauuauaccauuaccauauuaagaaaggacuguucauucuuuucuaucagcucauaaauaacuccaggaucaaucaagaugaugacaaaauguguauugcauacugguuugcaucuuuguuaauacaugaauacauguugcugucuuucaaaguuauuuuuaaacucuuaguuuuguaaacauucauuauaauuuuuccaaagucaagggaacuucaugaaaucuggccuagccuucuaauuuuuuagauaaaacagaauuuuauuguauauucaauuuggagauuaggcucuaaccuacccuauauuuggcucuguuucaggauauuuaaauuucuuucauuguaauuuuuguuccuguauuuuuaauaauucugguauuuuucuuaaaauguagaaaacaaaucaagauagccuuacccaauuuaugccuagucuuaaacuuuuucuuuuuacuauugguaaaaaguguuuuuguuuuuauuuuuugacagcuagcccuggacagugguucaauuuuaugguaauucgcguacauugguguggcaucuuuaaguaguaucauucuuuuuuuuuuuuuugagacagagucuugcucugucucccgggcuggggcuggaaugcaguggugcgaucucggcucacugcaagcucugccuccuggguucaugccauucuccugccucagccucccaaguagcugggaauacaagcgcccgccaccacgcccagguaauuuuuuguagaagugggguuucaucguguuagccaggauggucucgaucuccugaccuggagauuugccugccucagccucccaaagugcugggauuacaggcgugagccaccacacgcagccuaagugugauucuuaaaaguauuuuaccuacagagagagaaacaccaucaaguagggcuuaucaguagguuguguaccaagaaaguuugacucuuucugggucuuuguauugaaaauuuauuauaaaaauaauuugucaaaaaauucccacugugccugguaaugaauauucccuuuauuaaauauuaaauacaugagaugccauuucaaaauaauguguaugcauguauguguguauguguauaaauagucuaagcaugaugaauuggcuggcuauuuuuaacaguuucaccgccaccacuuccugauugucccuagcuggcucuuuggcacucacacaauucacauacugcuuguuaaguaccuacugugggccaaauaccguguaucauuucuagauaaucuuauuucagcuuuggauuuugguguuugcauggauacuuuguaagcugucauagccgauagccuuuagguguuuugaaaccuacagucuuacaaauguccacauuucuguacugguagcuucucuuuucauaacccuauguuugccuggauccugcaucaaagaaauaaggggagggaauugauaauuggagguaauaagccuuucaguauucuaguguuugaaguuaaggcuuauuagggcucaaguauucaagguuuucucaucuguuuuaagcaauuggauucuauuauuuguuggccuucucuaucuuugaugccuguacuuaagaaaaccaaaacuguaacucagagaagagugucaugacuuaauugaucuugcccugaucuugagacuguauuuuguucuguuaagaaaaaaaggcgauucaaaucugcagcauaucaagguugugccuguaaucuuccugaugauucauuuuuagcucacuuuuaaaccauauaggaugauguguuucccacauauuuaaguauguguugacuguauaaugcuaaaaagguagacuugauaaacuuuguugauggugaaucauggaaaaugucaagcaggagggcaaggucagaugugcauuuuaggaguuguauccugcuggcaaugaagauggacuggaaugggcagcaaccaguguccagauaugaggagaucaguuauaaaucaauugaagaccuuaauaaaagcaauagacuggauuuagagaaguaggauagggguggguuucauagaaauuuaggaggucaaguuacccagaguuggugaagauaagauaccagaugugacaaacaaaaaugauuuucuauuuuggcucuggcugacaguaugaaaagcuguacuauuuacaaagauagagaaauaagaaguaacuggguuuuuuguuugguuuugguuagaggacucuguauagugauaaugauuuuauuuuucgugagcacuuugaacuucacauauuugggauccaggcuuuaauacugucagcuggugaaaauauggguguagaagauauuuuuguaugaacauaaaaauuuggaaauugagaguuuuuaaauauuaguugaaaaguggacauacuugaaauuccuuagguuuuaaaguuaacacucguuuguagauaacuagauuguugccauuauacuauaccaucauuuuuacuugcaugcuuaucucccuacuagcagguauacaccuugaggacagaauugucuaccuuuuuuucagguucucuaccaccuaacauaguagcuggaacauguucacugggccugcucagcuagguguuuagugaaugaauaaauaagugaauacguaguaaaccaaacaagaauguagaaugagaaggaagaaauccuggggaaaauaugauuugagauucuaguauuauuucugaagaguggucagacaacuuugaugagaaccagaaaagaguaguggggaccacugaaaacaagggaggauagagucgcacaaucaggaguuacugcucaguucauuuagcucccucccccgaaaccaagaugaauaaauuaccuauagaaagaucuacauacacaugggaagaaugucugguucauuuaggaugaaauuugagauuccuuaucauugucaagaauagaugccaucgcuggacuauauugucauuaaaaccaaguucaggucgggcgcgguggcuccugccuauaauccuagcacuuugggaggccgaggcgggcagauuacaaggucaggagaucgagaccaucuggcuaacacggugaaacccugucucuacuaaaaacacacacaaaaaaauuagccaggcaugguggcaggcgccuguagucccagcuacucgggaggcugaggcaagagaauggcgugaacccgggaggcggagcuugcagugagcugagaucacagcacaguacuccagccugggugacugaaaaccuauuccauguucuucacacaucaagugauaaacuggcaacaauguuuaaaaauauuguuucuaugucuuuagaaauuuucugaagguacaguuguucagggugaagauuuuuacagaauucaguaaggauggauuauaauaugcugaacauuugguugcuuuuguaauaauagagguggacagcugagacaaaucuagacaaaaucuuacacugacuguuuuguaacgacauacgaaugacccugaacuuuuuaaguaacuuaagaaauaggccgggcacggugccucacaccuguaaucccagcacuuugggaggccaaggcggguagaucacaaggucaggaguucgagaccagccuggccaacguggugaaaccccaucucuacuaaaauuacaaaaauuggccgggcguggugcugcgugccuauaaucccagcuacuugggaggcugaggcaggaggauugcuuaaaccugggaggcaaagguuccagugaguugagaucaugccacugcacaacagccuaggugauagagcgagaucgcgucuuggaaaaaaggaaagaaaagaaaaguuagcugaccacucuucagaaauaauacuagaaaagaaaagaaaagaaaagaaaagaaaagaaagaaagaaagaaagaaagaaagaaagaaagaaagaaagaaagaaauuuagcacuuuuccagaugucaucaugccuuaaccuaguacuacaaaucaauucacauuguauccuagcuccccauauuccuuuaguuguacugucuaauuagauauauugcuuagacacagcaaacaaauccaguaauuccucuuaaucucuguuuauuaauuuuuuaaaccuacaagaacacuaaagcagcauuucuucugcaccaaggaaauagaauggaaacacauuagacagaccaauuccauuacuagagacaucugcgaguuucaggagucaaucccuagcuugugguucugauuagggcucuaauguucuuguugauuuaaacuguuuuucuuguuguuuagagguaaaaucugaucuguaaaagaucccaauuugaaaaucuuuauuagcuuuuuaaaaagaagauuuugucuucaccagcuacagcaagggcccucucgaugguaggauguucaugagaaagagaaaggaaggaaagaggagcccaguaaagacacacaagaaggauauuggccacuggcaguauuauuuuuauguagcauuaugaaaacaacgaaaaauuguuuuauuuucuaaagaagcacaauauuuugauucauccauaaugugcauauaucauuaauguaacacauuacacuuucugggaauuuuugcucaagaaucauaaaauacuuuauaagcagacaagaauaauuuuaacaagcaguuuaggaaauaaccaagacgucuaugcccucugaaccuacauaaucauuguuggaaaguagcucuucaucugcucuuuaguauacucuuuuaauaaauaaaaauggagauaauaguuauaaguucugcuugagacauaaaaauauuguuaaaugccaaaaauaguaucugauuucugagaaauuuuguauuuuuuuauuuaaaaguacuucauuuuccaaaagauuuaauaagcagauuaaaaggaucaaugaaccuuuccauuuuaggaagucuauucugaagucuaccauaccucccaggagguagcugcccugugauagaaacagguuacauuauuacaacuucaguuaacaacccggauuaacucacuucugucugggguuauauuuguuuucuuuuaaugacaaaaguguauuuauaacacaucauguuuccaucaaccagggcauuucuucaaagaaauaugcaggaugaaguuccuuuaguguuuucaggcaaaguuuguuuuucuuuacuuugugugacacuaacuuuuucuuucaaauacauuaaauuuuguagcuacaggauucaaauauauaugcauggcuucuacuacauuacaucguuuuucuggcuuauuaguuuccauauaaguaaauuuuacaaauucugaaguuacucuccaagauuaaaacugaaaaugacaacaacaaacuuguguguuuuuguuggaaauauuccuauaguugaagccacugaaucaacuauauauauauauauauauauauauauauauauauagagagagagagagagagagagagagagagagagagagagagacgggcucucucuuuguugcccaggcuggagugcaguggcaugaucucagcucacugcagcauagacuuuagaggcucaggcgaugcucccaccucagccucccaguagcuggaacuacaggugcacaccacuuugcccggcuaauuuuuuguguuuuuuguagagauggggguuuugucauguuugcccagcuggucucaaacuccugggcucaagugauccaccagcuuggccucccaaagugcugggaugacaggcgugagccaccacacccagccuauaauuucuuuuguaacuuuauugguaugguaaggcaguagugcccauuguucugccuauauuacaccuguccauuguuuuucgaguucuuuuguuggccucuuacaguuuucuaaucuuccucgucauuugacuaauauuucuccauuccugauguuguuaaaugaccuuaccuacuccucuccuuuuuggaugccucuaaucugcugaggacuucaaaaccagaaauuuuaauaucacaagaaugcaccugauugguauaugcccacaaucaaaacccaggcauaugaacaaugcccuuuacaaaggcuuauugauguaacauaauuuuaaucucugcuauuuuugugucauauauaaugucaaaaauugggcaaguagagggucugcccuuugaaacugagcagcaugaaucagaaaagcuacucagaucacaaggauguucccuaaacaaaacugguagaauuaucccuuuccacuuucaaucaugucucuauuuuucuuuuguguaauuuccuguuuuucagaagaauuagaacuugagcaccuggagcccauuucuggacuugauauaagccccaaauaugauaagggaguggaggaaauagauguuucccaaggcuggggucccaaacccccaagccauggacccguaccagucuguggccuguuaggaacugggccacacagcaggugagaggcuguugagggagcaugauggcccgagcuccgccuccuaucagaucagcaacugccuuagauucgcauaggagaguaaacccuauugugaacuucgcaugaaaaggaucuagguugcacgcuccuuauuagaaucuaacuaaugccugaugaucugaggaggaacaguuucauccccaaaccauaccccucaucuguggaaaaauugucuuccacaaaaccugucccuggugccaaacagaguggggaccgcuguccuaaggcacauaugagaacuguguaaagguacuguguucacucagaggaauagucccaugagcaaagugaacauauuugauucccauauuuuuuaaccuucauuuucugguauuaguuuuuccucuuacuuuggacauaugaaaacauuacuugaaauaaaagguacauuugaguuuuaaauuugguaauuuuuagcaucauaacuuuaagcugcaaaacuugggguaggauguguguauaagaguaaaaauaguuuuaaauauacacauaaauguauauuaaaacuuuuucuaaaauggagauacaaauguagaaaacugcuaacuguuguaauaaauauuaaucaggacuucacgguauagacuacuaguuauuuugaaaaagucagaauucagugaguuuuuuguuguugugguugugaaauuggcauuauccuuucuucauaacauuuagaaauucacacuaccuuacauuuuucauaagaauugaaauaaccaguaaauuaguuuaauuuacuaauuuuuuucuccccuggcacuuuauaauaaaugauagccuuuauguuucagaaugaaaaaacaaaguacuugcaucuuuuuuaaauagacaaacucguuauaggauauucaucacauaugccuucuuucugccuagaaugauuuauuuuucugucuuuuuauauugauauaguuaaacaguuaccuguuugcaaaggaaaccuuauccagauguaggcucuucuuuucuguauuuaacaauugauuguuacaguuaaagaguacauugcuuauuuccauaacacaauggucuuuauuuugaaagacaacccauugguugaaaagagcuuagacuuuggagaccaaagagauggguucaaauuguguuucugccaauuaguaccggguucuauugauaguuucuuaggcuuuguaaauuauaauuuuguuuucaaccugggauaaauaacaccuauuauugcauaauuauuuuaaggauuggauguaauggauuuuuagaaacagcacaggauuugacauguuguaguuaguugcucaacuaaguguagcuacacguuuauuuuuugagccaugagaagcagagggggaauugaggggguucuagugguagaacgaggacucaaaucauucgcuuuaauauaaagugacaauuggaaaugaucauccaggaagaagacuaagggacuccagauacacccuuuuugaagaugucuaauaauucaagcaucacccugcucaauugaacuaaaaauuuggauuguguagaauuucauuugaacaguagaauuuuguuugaacaguaugauaagcucauuaaaaucuaucacuuguguguaaccugauccucugguuaauuccauguguuuuccuauggccuuuuaguucugcaaaagacugggcuuguaaagacuuugauuucauuuuuuuuuuuaacagaugauagcaaaagauauuuaguaccuagaaagguaaacuaauccuauuuucaugugcagucacccucuaguguaaauaaguaguuuucagucuucaaauggaaaacauuccaaugucaaauucuuuaggaauaggaauaggaaaaaggauucugaugcagugaguggcuaauuuauauaugauauaaauuuauauauaauuuaaauauauauauauauauuuuuuuccuccuuucugccauaauuuggcuucuccuuuucugacauaagaucuaucagacuauaguacagguuucagcacagaaguaaauaacagcauguuuccuugggagcaauugaacaacagaaugaaacagugcuuacuguuuuuugaaaguugugucagauugucaugguaauacagaguugcaucauguugucauaguaaccagaauuauaaaacgaauuuaaagaggaugaagagauaccuugugauuccuuuagcuuuaaagauuuuguucuaccgcuacuucuguuuauuuugcuuccuuuuugcaaaaugugucacacugcuauuuuuuuaaaaguagccaugguacauccucugcauggcuagagggaaugauggaaaucuuuacuucuucccaaaugaagaguugaagcaucaaaguuuaagucaucccauucucuuugagccagguaaaauucagggucaggagcacaucagauacacugcugugucaaaacaugccaacucugagcagggaggaaguuccacuccgagugggaugaaaagguauuucaccuuucuuaaugaugauucauagcuuuucuuucaagcgaaaaacauccuaaucuuacuuugaaggaaaagcaguauuaagcuuugggagccgauucaucgaacuguaucagaauugggguaauauuguuuuuucucuuuaauuagaaugauuuaggucauuauaauucaucaagagguuaaaaugugacccuugaggugaaaaacuaauuucaaggcuaaaccauuucuauuauuccaugagagagaaagagagaaaaaaauaggcuuacaaguaaguugagacuuucguugcuggagcgcauccaauaacuaauucuacaaauaauaaugacugaagaaaaauaaauuugucaacuuugaagucuugcuaaaaucaauuguuuuaaauauucuuucucuuagcuccuacccucuuggcguaagcaauuugcuuucguucuuuuuguugcuacauugccuccucucgacuugcuuuuuaacaaacgcuuuaagagccaugcaaguugcagcaaguuucaggcauuaauaguggccagguaguauaauacuauuuuuaaugaaugccuguuuucuauucuuuacugugcuuucuuuggaaagaggcccacgaaacaaaguauuaagaaaacacaccgcugcccuggaauguguguauuagcugcagauuauuuccuauuagcagauuagcugcaaggcuauuggcucagaaaggucuuugagaguauuuuguuuuguaacugauucaagccaugggagaaaauugccaccaugauuggaaagaagaauuagcuacuguugccauggacacuggaguucacagucccauuguuaaaucuagggcuucagaaugagaugucccagcaggaguucaaguuuuguuaaugaaaugaucgaauauauuuuuuucagaguugugacagaaccuugugaaagauauguggaauauauuuuuuauggaauuuagaguuuccuuuauaaaucaguguuuucuuuccaguaaaauaaaauaauuccaugcuauagcccucuaugaaaacuaauguacgcaucuauuuaaauauuuaauuaccucccuauuacauuuacauuuauagcauaucuuuuaaaauuauauguagauuacauaaaaacuaacauaaaauugcaaaucuuuaagucaaauuauuauaauauccaugccaguaugguuucuaacaauauaaauugaugauaguaaugcauguuggauguaccuuuuaaaaaaugcuuuauaggcggggcgugguggcucacgucuguaauccuagcacuuugggaggcugaggcggguggaucacuugaggucaggaguucgggaccagccugaccaacauggagaaacaccaucucuacuaaaaauacaaaauuagcugggcgucauggcgcacauguguaauccuagccacuugggaggcugaggcaggagaaacacuugaauccgggaggcagaagucgcagugagccaagaucauugcaccucagccugggcaacaggagccaaacugugucucaaauaaauaaaugcuucauagaauagaaacaggauagaauaguauauuaaugcuagcaauauguuuuaaaggcuauaugccaugugacauacaguagauucuagucuuuaaaacuggaaauaauucauggaaguuaaaagcuaguggcuuauuauggugauaggcuaaaaaccuguaaguucaaagauggaucacaaaauguuuucacuagcagacucuugcuaauaguccaggggguggauauucaggugcaggcuagaagccaggccuaaugcgcuucaagaagaacuuacagacuugaccagucuuuuaaaaaaguaucuuaccccuccuauuaaucaaaaaucccuuugucugggccaggcaagguggcucacaccuguaaucccagcacuuugggagaccaaggugaacagaucacuugaggucaaguguucaaaaccagccuggccaagauggugaaaccccaucucuacaauaaaauacaaaaauuagcugggugugguggcacacuacuguagucucagcuacucgggaggcugaggcaugaaaauugcuuggaccugggagguggugguugcagugagccgagaucuugccacugcacuccagccugggugacagagugagacucugucucaaacagaaacaaaaaacacuuugucucauuauccuacuaacaauacuguuuuguucacuuacuuuucagagaaacguagaguccauucauacuuuugccacuaacugaucaugugacuuugggucauuuaauuaucugucccucaguuuccucaucuauaaacuagaaugacaauagcacccaccccauagaguuauuuuugucgauugaauuaaacccauacacacacacacgaacacgcacacgcacgcacacacacacacacacacacacagugcuuggcacccaauaaauaacaauugacaauuguuguauucaguaacuuuugguggcucccuauuucugacaaaauguuuagauauucuaacacuggaacccugucuguuccugcaaaauuaucugccucucuaauuaacuccugaaaacauaucuaguuguugccuggacacacgccaaacacauuuccugaacauucuuaccucugaguccuuguuuagcaaagcuuccaaccaagagcacugucaccccucugauucugccuaaggucaguauuuucuaagacccauacucuuugaaguauuuccugacuaaccaaacgucaccccucuggauuuuuuguuucucaucucaauagauuuuuuuucuuuucaaaauuuuaaacauguauuagaagccaagugagaguuaguuugaaauuaaaagacccuuaaccuuucauaaucaucaaguccuccuggguauauuucauuuaugaaaauguuauuacaaaaagaaaagccauaucccuaggauauuugcuuuccacaaauuucauuuaucauaaaaauuuauauuaacucguuuguauuuggauucauucaaauacagauugaaugaaucugaaccugucauugguuugguuaacuuauuaucuagauacuuaucauuguguaaugauuccaguggccuuguugcuaacagguucucagcaacaggcgguugagggugggcagcaguaucaggcuugcuugcuugcuugcuuucucucucucucuuucuuucuuucauucuuccuuucuuucuuucuucuuucuuucuuccuuucuuucuuuccuuucuuuccuuucuuuucuaccaggucucgcucauggcucacugcauccuggaaauccugggcuuaaguaaucucaaacaauccucccucuucucuucgaccuccugaguaguggggacuacaggcauacgccagcacacuccacuaaguuuaccaugauuccuucugguagcacugaugggaagacucucagguuuaagccaaagcuaaaaagacaaaaaagcaagccaauuacacuucaggauggaauggguaaugaucuaaugcgcuaacacccuguacauauugccacuucucuuuccauuggaauaucuuggaauuuaaaucccauguaaauaaaugcaaaaacucccuuauuuggaguuuuaucuggcaacaucagcuaccugugauauucugaaagaggaaaagacaaagacaaaggucuccucaaacguaauagugaauaacaaagcuacaaaagagggaaauuggaaucgucuuuaacaaagucuaauuauuacaagguaaaggguuuagaugucuccuuuguuugucucccaguuagcaccucagaaggggaguagagaauuguuaccauaaacugacauccugaguacaaaauugaagaauuuucugaaaaaucacaauucagaauauaugucccucccaguauuuuguuguugauguuguuugguccuucaucccguguguuucgauaauuguagaaauagaauauuauaaaugcagagaaucuuuugaguuguguauucaaagagcugucaucucuccuggauuuaaucugaauaaaggagugaucgcuuucaaauuuauaaaauaauaaaccagccuccaaaauucugggaaaacauuuuucuaguccuugauauuaacuuaaagguaagauucuuaagaagauaaucacuguuucaaauuucaagagaugaauucuguggucuaagacaaucgaauucuuugggcugauacaccugugaauguuagcaauaacaauaacagacaaaaggaaugacagcagaaagguagacgauuacugagacacaauauaaaagaucgaaauguauugguuauuguacuaaguuuauagcugcuucuaguguaauuaugaauuuauaauauagaauuccaaauuauuagaacauuauucauuagcccuauuaagaaaaaguuauuuuugcaagcaugcaaaauuacauguauuacaugcauauguguguauauaguagauuguguauggauuuuaagguguggauuauaauuuucaaagaacuuuaauacauauaauggcauaauuaacuauauaucuuuauccccuuauaauaaagguauuuuaaaauauccucacauuaaagaaaaauuggaaugcaaagaguuauuucacgguuuuacuuucuugcuuacuaccauuucuggauuuuaugagaauucagacauuuaagaauuccuuguaaaacuuggucuugcccuaguaaaacuuccuugucuugguaagauaaaaaguuuguuugacagaacccuugugugugccuugcacugauaucuauuauaaaaauacaauuguaaaacaaaauggaauaaaauguagagauaaccaucagccagauaccacaaacauuauuucauuuguguuuucuucuacucuuacauuuagcuaaaaaagagacauugaggaucaguaacuuuuaauggaaacaaacaacacaauacauuuuuauguauggcauaaaaauuggcauguuaaaaguauuaaguuuaagauggauugagaaacccauauuugaauauugcaauuuuaccguuuaaaaaugguaagauauuauuuaccuguucuuuaaauaucuuuauaaaaaugauuugaaugucuuucagaaagccuuaauuuuaaaggagcucuuuuaaaaagccaaauucaugcuaauagggaccaauaaaguauauuucuaauaauauuuaccaugcucuacaaaaugucaugugugcauuuuuuucauccugccaaaagccacucuuugcuuugaaauucaaacauaauguggccucagagcauuauaauucaugaucuuuugauacaaauaaaugaaaacaaaauguacacucuuuaauuaauguuuaaaaauccaacucuuuauuaguaaaccaagaaauaugugauugcugaaccaaauucugccagacaaugguaugcuauaaaauuuuuaacugggaaagauuucauacugcacgaaaaauucugugguuuuuuucugcaaagcagaguaaaaaaagaaaacaguaacaacacuauuuuuccuuaaaagcuuguuguuuuuuaagauugggauucagucccagucuuuguuuugguuugguauaaugggaguaacuggacaauguggcuacacaaaaaugaaauaagacaauauguucccauaugcagugauaaagcaagcugacauuuuauuggugucucauauaguguauguuucuaagugaaaguguauauaccauguaauucacuugagaucagguauguauuccauuuugcauaagaaugggggcaggauguggaggaugagaaggccaaauuaagucauauagauuauuuuucaguagacaaaaagguguuauuauaauggagugggaguuuaaaagucauaagagcuauacuacuuauuagacaaaauuuuuuuaaaauagaaguaacugcagccugcuaaaauguuacauacuuuuuaugagaacguuuugaaaguauugaacuauauuaauacauaaccucauuuauaaugucacuguuuauaugagcugauuauuuuaacucuaaauuauccaagugucuauuuuauccuuauauaucuguuuucugccuuuuaguaugaauucuccaauauuaucuugagugagaagggaaaauguggucucuaaaagauucuagagaagcucuuugaaaaaugucugguuuguuuuuuuuguuuuuugguuuuuguuuuugacggaaucucacucuguugcgaggcuggagugcaguggugcgaucucagcucacugcaaccuccaccuccuggauucaaguaauucuccugccucagccuuuugaguagcugggacuacaggcguacaucaccacgcccagcuaauuuuuugggggguuucaccauguuggccaggauggucucgaucucuugaccucaugauccacccgcuuuggccucccaaagggcugggauuacaggcgugagccaccucaccuggccgguagucuuauuuauaucacacaggcauaccuuggagauaacugugggcuugguuccacaccacugcaauaaaaugaguaucaaaagaaaacaaaucccaugaauauuuuggcuucucagugcauauaaaaguuauguuuacauuauacuguaguguacuaaguauacaauagcauuaugucuuaagaaagagugugcauaucuuaauuuaaaaauaccuuauugcuaaaaauguuuauugauuaucuaagccucuaaggagucauagucauuugucugguggaggauuuugccuugauguugauggcugcugacugaucaggguggugucugcugaaggugaggguggcuguggcaguuucuugaaauaagacaacagugaagucugaugcaucaauugacucuucuuuucgugaaagauuuccuguaguaugcaaugcuauucaauaacauuuuacccacaguagaacuucauucaaaauuggagucaacccucucaaacccuaccucuucuuugucaacuacguugauguaauauucuuaauccuuuguucauuucaacaacauucacagcauauuuacuaggacuagauuucuucuuagaaaccacuuuuuuugcucauccauaagaagcaacuccuuauugguucaaauguuaucaugagauuacagcaaucaguuacaucuucaggcucaacuuguaauucuaguuaucuugcuauuuccaccaaaucuauaguuacuuacuccacgugaagucuuaaaauccucaaagucauucuugaggauuggaaucaacuucuuacaaacuccuguuaguguuaauauuuuaaccuccucccacgaauuacgaauguucuuaaugccaucuagaguggugaauccuuuuuugaagguuuucaauugacuuugcccagauccaucagagcagucacuaucuauggccgcuucagccuuauaaaauguauuucuugaauaauaagacuugaaaaguccuaauuacuccugggguccacaggcugcaggauaaauacugucuuugcaggaaugaaaaaaaacacugaucucuuuguacauauccaucagagcucugggguaaccaggugcauugucaaugagcagugaucuuuugaaaggaaucuuuuuuuuuuucugagaaguaggucucaacaaugggcuucaaauauucaguaaaccaugcuguaacagaugugcugucauccaggcuuugcugucccauuacagaaaacaggcagaguacauuuagcauaaaucuuaagggcuccagguauuuuagaaugauaaaugagcacuggcuugaauuucaagucagcagcuguauuagcccuuaaaaagagacucagccuguccuuugaagcuuugaguccaggcauugaauuuucuucucuagcuaugauagcccuagauggcaccuuuuaccaguagaaaacugucuuaucuccauugaaaaucuauuguuuauugcagcuaucuucaucaaucaccuuuccuacagcuucgggauaacuuggaguuucuccuucagcacuugcuucuuaaccuuauacuuuuauauggagauggcuucuuuccuucaaccucaugaaccaaccucugcuagauuaagauuuuucuucugcagcuuccucaccucucucagacuucauggaauugaagagaauuagggccuugcuuuggguuagacuuuggcuuaagggaauauuguggcugguuugaacuucaaucccgaccauuaaaacuuucuucauauuagcaaugagguaauuuugcuauuuuaucauuuguauauucacgugacuagcacuuuuaauuucuuucaagaacuuugccuuugcauucacaauucacuguugagcucaagaggccuagcuuucggccugucucaguuuuuggugugcuuuccucacuaagcuuaaucauuucuguuuuuuccuuuaaagugagacagcucuuccuuucacuugaacacuuaaaggcuacuguagggauauuaguuggccuaaguucaauauugucauaucucagggauuagggagacccuuggagagggagagagaugagggaauggcuggucaguggagcagucagaacacacgcagcacuuauuaaguacgcuaccuuaugagugugguucguagcacacugaaacaauuacaauaguaacaucaaagaucacagaucacacaucaccauaaaagauacuauaguaauaaugaaaaaguucggaauauugugagaauuaccaaaaugugacacugugacaugaagugagcacgugcuguugggaaaauggcuccuuuagacuugcaggaugcaggguugccacaaacugacauuuuguuaaaaaugcaguauuugugaagcacaauaaagcaaagccuaauaagacaaaguaugccugucacuauguaaugaaggagcauaauuuuauggaguuuuccuucaaaugugacaugacuaauuucuucuuuuuauuuccacugcucaucagaagccucuuuucuucucuccugauuuauugccuacuaccuggucuuccuguucucugaauuuccucucuccugaccauccugcaguuccugcuaagaucagcuucccaaauuauaucaucucuuuguucaaaaucaucugaugacucagauuguaacuuggguuuucaaagaaccguuuccuauaucugugccuuuucgccucagcuucucaguaaacuggcauagaucguggugaaguuuuuuuuuuaacauucccucacggagugacuauauauaguauugaugauauauauaggcaacauauauaguaacuacauuguuuggauaugguaugacucagcaagcaugggguacacuguaaaacuaaagaggcguauguucuauugcuguguguaacaaauuacuacaaauguagcagcuuaaaauacugcaaauuaauuaucucacaguuuuuuguagggcaggagacugggcacagcaugacuggauguucuguucagggucucacuacgcugaaauugagaugucagcugggccgugguucucaucugggcucagaguacuuuuccaagcucucugguuguugggagaauucauuuccuugcauccauagaacugagguccccauuuuccuuguagcuguuggccggagaccacugucaagccccuaugggcaguucccauguggcccucauagaugugugcuuucuuucaggccaggugaugcacgucucucugacuuccucuucugagaccagccaaacaaaacucagggcuuguguguguauaucaagcccaauuggauaaccuccuguuguaaggucaacuauuugggaccuaaauuucaucugucaaagcccuucagaacagguccuagaucaguguuauugaauaacugagagaaaguguauguacaggaggacccaggaaucuuggaggucaucuuacaguucugccuacuacaaggagcugcaguauccauaacugcaaaaagaaauguaguuuuagagcuaaugccucaggacaacugauucuccaagacuggugguggaagaacauuguguucuucauucaagaacuacuucuggaaaauuuccugaagugcaucaagcacuauuguagcaguuuuuaaauguucagucaaugagauaaaauuggaaaauuaguauggcaucuuaccccuacugucagauuuugaaaauagcauuguaggacaucacauuaauuggugugauuuccaggaaaaaagucauuuuugaagcucuuuuagaugaagcugaccuucucagaaagaauacuuuuauaauaacauugcuaaacagauaacaaacccuaaauaucaaagcaagaaacuaaagaagugaaaggaagcaggacaaaggacaacugacuuuguguccuuauuugccucuugaaggauguguuagagaagucuucagcaucuaaguacuauagcuauuacuucuaucauggggacaugauauuugacuugccucucucagauaaaauuuggaaauaugaaauauuaaagauuuaaacuuuuuugaaucuuuaauauuagauucugaaauugaauauauauuagucauauuaugauauuguguuuaccuguauuuugucuaacagauuuuuuuuuaagcuuuagcuaaugaagacacauggcauuguuaacagugguaaagaugggaggaauguuuagauuuucuaguuuggauguaguaugccuuguuuugagauacauugauguugguuuauuuuaauggcaaaagugcuuucauuauucuaaacuauuugauuuaucaugaccucaucccauucuguaacaagaagaagauuguuauauuuuucuccagaauuaacauuacaaugauuaauaagagaaaucauauauuuuacaaagccacuaugagucaaauacacauuuuucugugaaagcauuuuuggagcugggaaauauccucuccuguucucuguaguauccugucuggagaaaauccaguuuguaucuuuuauaugcuuuucaaaaauuacucaucuuuagaggcuacugggagcugauugugguguaauuucuuugcuguguucaauucugcggaucaaauuugcaaucugauaugcauacauaccucuagcuggcuuagaauagauggagauagcaccuuuucauacaugccugcagugucagugucuauccacaaauguuugggaauuagaccagaauguuaauauugaccuugccacuuccuugcugugagcuugggcaaguuacuuaaccacuuggagcuuaaaucucaucuguaaaauggagaugauuauuuaucauaggaugauacuuacaauuaauuuuuuuuuuuuuuuuuuuugagacaaggucucacucugucacccaggcuggagugcaguagcaugauuacagcucacugaagccuugaccuccaggcucaggugauccucccacaucagccucccaaguuagcugagaacacaggugcaugccaccaugccugguuaauuuuuguauuuuuuuauagagauggggucucaccauguugcccaggccggucuuacacuccuggacucaagcgauccaccugcccaaccucccaaagugcugggauuauaagcaugagacaccgugcucagccuagaauuaaauuaaaaaggcauaagcaaagaaucuaaggugaugccuagaacauucuaaucaccaauaaguauaguuuuuuacuuccucucucacuuuauccauucagcagaaagugacugaguguuuauucugugcuaguaucuguucaguuagguucuggaaacaugaggauaaauaagguaugaugucugcuccucaaaaggacaagaccuacuuauauggaaugacaauguuuaugcauuuacaguucaaggcaguuaaauaaaacucauauguaaaaggcaaauugcuacugcuuauuacuaaagauaguaaguuauacaaccaguuauauugaucacauggaaauaauuacauuaauuuucuuuguggguuuucccauggcuuucugugcauuuugguuucaguuaaggugggguucuuuuaucuaaaaugcccacaggauauggauccucauuauugagguuguauucuuguuucuuuuguugcuguaaccauguugauggucaacugaagcuauuuucauacacucucuagauuugaucuuugaugaaaagaaccaaaaagaaaucaaagaguuaccuugccuuagggacuuccuucuucuauuaaauugauguaucccaacuuuguugggguuuaaggaacacuaaaaggccuauguuuauucaguuaaacuugaaaguauugggacagaaugugcucuccuaguauugugauguuugccagagaagauguagucauuguuaaugauuguaaugaauuguuuauuuuuuacuuuaaguauuuuagauauucguaguaauugaaauaaggaaaacuacuuuguaauguaaaaaaaaauuaauuuacuuacuuauaacuguaagacuuuguacagccaaaauugaccuauauguuuaguuaggauucagugaaauccauuugcauauguagguuaaauuucaccuuauacaucaccaaacugcagcaagcuaggacuuuaaacaacuaaacauacacauauuaauucuuauuugaaaugauuuguuuuugcccucauugaaugaaugguuaguugcuauuaaaagauauuauucaaagagcaaagcuaaugaccugauuuuaaagaaugguucaccaaaauagaucaacuugcaguccugacugaguccccaguuuauacucaaucugggaucacuucccccaacauccacguuaucucaaggauucuuuuccuccucuguacuuccuuagcauuuugcaagggacagguggaagccauguccuauucugcccuguauucuguucauuuguaccauuauacugucuuccuaaacuuaccgaaauuuuccaagaacuguuuuccuucacuacauucuucacugugccuuugcauuaccuuaucucacaggguacucaguagaaaucuucauaaucgaaggcugaagccaaaaguuugguauuugaguuauaccaagauauuuuagaaaaacucagaggggggaaaaacagaugacugucucagcagauauacuuauccagguuuccacuguguuccugaaagcaguucuaaacauagucaaucucuguuucucaaauaguuauccucuuuauuugagaugagcagacaggagcuucuucaaacacugaaaguaguugcucagauuucagaaugaauagaauucucauaauaguuuuuaugcccuaguuuuuugaugaucugguacaguuagaugaggcucucuaguguuugaaucaugaaacaauaucacuucacuuccaucauauucuaagcccuugugauaguuaaggacaaguaaaaaauauaauuacucuguauggguuuuguugcagaagaguggggggggguugauuuuuauaguaaagugagggaucuauaagccaaguuauaaccucuguuuguuagcacuacaaaaguuuugagacaguuugaaauuuaaacucaaugcauuugaugaauaguacuuggcuaguuugcguuugcuucuuaauuucauuaauuuuugguggcaaccagccuuuacaacagcuauuuauaaaccugaaauaucugaucuguaaacgggcaaacaagucaaaucuguguauaucuuauuugccaaaccguuacauuuuucugcauauuucaucacuuuuacuugaaaaugggcuuguagaaagauaaacagcauauuuacaggaaagaaaaggcaaauaacaaauucuaaaauauaaaugcaaccuaauacuuucucucuauaaugguaaaaagaagggcauuuaauauuuucuccuaaaguauauuuaaauauuuucuagucaaccuacuuucuaaccaaugcuaauaauucugucgacuuauuuuaauggcugacaugcacguaaauuuaguguucauauugaaucaaaucauuagcaugaaaaauuacacaacagcaaguccuguuaacuaauuaugcuagauuggcacuucagaagagguucaucaauucaaguauuaucauuuguagaaagaaaccuuuuaaaagaagcuuucuauuuuaaaacuuguuaaugaaagggcuuaaaaauagagauauauguaugccgaaaaauggcccugaauauaauauaugcauucuuugcaugcaugcauuuuucgagagguuacacauuaagagauuugauauagccuuccagauauauuucugaccuaugguagcuuaaaaugaggacaauaaaaaucaaucuuuacccagauaaaaauuccacauaccuaagaaggcaucagguuucucaugccuuauuaacauuuauucuucugugcauaaauuaguccauuucauagcauaaauuacaacugacauuaucuccuguaaacucuauaauaaaagaguacagaaacucugccagccagccauuuuaauguugauuucuuuacuuauauuuaaacuucuaaauaauaauaacuaccauuacugggugcuucauuuauguuggacacucugcuagguguuuuguaugguauuucauuucaucucccuguugaaagcuauagauuaggcagagaagcucagagagguaaagugaauuucugagaacacaaacuucuaaauggaauugggauuugugcuuaauuuuaaucugucugacuuucacagucaucuucaguaugaacagaagaaaaucccugaacaccuuugaaauuuaaagcaaauuaaagcaaauacuaugccauuagaguauauacauaugaauaugauucacucccugugaacucugcuguauucucccaccucuaaugugccucgccucugcuucauugggaaguaaaaaaccauuuuacuaccugggaauugugaagcuaucugguccuuuuuaaaaauauaacacucuucugaggacuuucugaugcugugaucaaaugauguggagagaaucuucuaagaaauauauuugagguuuacgucauguugucauugaucauucuggcuuuauuuauuaaaagcaaaaccuuuuacacauuauugcuuucuguuuaagaacuuuccuuugcuacuuauuuauucuguugauguauuauuaauguccuagcugucuguuaaauauagacuguuauguuauuaaugcuguuaaauauagacauauucguaugaaaaggggaauauuuagauacaaaauuuuauaaaauacccaaaugccuuaagaaauuaucagacaaaucuuuguuuuguuuuguuuugcuuuguuuuguuuggugggugagggacuuguuuuuucccacugaucagccccauucuugggauuaaguuauagggaaaauaaguuuuguuucauuuuauuuuauuuuuucacugugcaaaccacuauauauugcuuguaucuaucagcuucuggucagauacauuuugucuauggaaacuuuccaacucaaaguaaucuuuaacucacuuaauaauuuuucacuugaauuguaguuaaugucuuuccuguuguugccuccuguaccagacuacaaguuacguaagagcaugauaaauguuuaauucaaucauaguuuugacgaaguguucaauuaauauuuguuuaacugacaauuguuauuuuaauaacaaauuuauugacuguguaaaguguuguacuuauuguuuaaugauuuuuuaagguaacuggaaaacauaaaggcaugccaggaaauuaugccugauuuauuauuuuuccccccaaaauacucguggcuugugcauaguauauguucaaaacuguuuauuaaguuagcugaauaauauguaaauacauauauacauauauauacauauauacacauauauacauguauacauuuauauacauauauacacauauauacauauauacauuuauauacauauauacacauacauauauacacaucuacacauauauacacauauauacauauauacauuuauauacauauauacauauauauauacuuuuuuuuuuugagaucaagucucacucucgcccaagcuggagugcaguggcgugaucucggcucacugcaggcuucuccucccagguucaagcaauucuucugcuucagccacccaaguagcugggauuacaggcaccugccaccacaccuggcuaauuuuuguauuuuuaggacagaugggguuucaccauguuggccgggcuggucucaaacuccugaccucaagugauccaccugccucgaccucccaaagugcugggauuacaggcaugagccacugugcccggccuugaauaauauuuuuaaaguagaauuuucuaacguauccuuugugcucauguugaaaauuuaacugcuccacccacaagcaagcauggggaaaucaaacaauguuaaaaggcuaguaauacuuauagguuuuaugauucaauuuacuauguguuuaaaauuguuuuuugaaaaaauugaguuaugucacuaaaacugagucaauacagcucaaaaaugaagaaauacguaucuccgauaagcauauuaugugaauuucaacaucacuauugagaaaaggaauauaaauuugaaugaaaaugaaacucuaucuuucuauaucacauugcauagguguaggcuagugaguacuuugauguaaauugcuguaucuuuugaggcaucuauuuggcaauauagaucagaauuuuaaaucagcauacuuuguuugccagaaaucuaucaggaccacuuguaguaauuuuguuaaaaggaauaucaaacacuuggauguucaucacaguauugauuguauuagaggaaggaaagggagaaagggaggagaauggaagagagaaagggagggaggaagauuggaagcaauugagauaugugauagcaugggauuugcugaacacacuauaauauaccauggcauggaaaagcaugcacacuuaaaaaaggacaauguggauggaucuagcuauugacaugagaugaaauuaaaugaaaaaaaaaaagaauguagauugaagaaacagucuguauuuuaagauccuguugucuuuuugaguguuuccuaugugauguagccaacuaaggauacagagaugaacacaagagccuuuguacuaauggaacuuacuacuauggagcugauagagguuauuuuacaccucaaagacaugaccugguucuaacauuaugagucuaagcuggagaagguuuaguguauugaccauacugaacuguguuggaaauuggaaauucaccucugugcuggaguuuccaauuugcucuucuguuggaguuucuaaucagcugugaagaaaucaugggauaauaguuuagaaauuccuacaagaugcugugguagaagguaaagauacaggagcacuucuagacacuugagagccucuaccaguugugaaggaacccugcuaguccagagcuaauggugcauguauccuuaaauauuacaauaggacauugguacuacuggcacaccuauaauuguuuuaugcugaaaaaauacauuucuuaugcucuugucacuuucugucuaugacauauuuguuuauuauaaauguauuauucuuccaagugucauguucucucauauuauauuacuuuuuuucuaauuccauaucuagaagugauaacacacagguauuucugugucacauuucucacuuaauucauucaaauguuucaaauuuuuuuauucccacuuuuuuaaaugauaggauguggaugaagaggauacugugccaaccaaccucguguuauuaacuguguuucuguaaugaaggcuauaaaauugaaguguaauuuaugauaugauuuuuagauaauggcuauaauuauuguuguuuuugagaaaugcagacauacgaaggagauagagaauaaguaauuauauaugaguguuaagugcauuuucagaauuggagggcgauauucuuuauuccuuguuaagccuuuggaaaucaaaagcaugguuguaucaguuguggcucugaauauuuuuaugguucugucuuuugcuugaucauguugguccuuuugagauucaaacauuuauaaaaauucauaauuuugugcaaauauugaggaccuaaaauugcaaagucuauauaaaccaagagcugcuugcugguuaggcagaaaccaaauuuccuccuagcucugccuugcauuuucaaucagaauuacuuguuuguuacaauaugauuuucuucaaaaauagaugcucugaggcaaaaggcgagccacaggcuauauguugaauagaagguugauuaguuggccgaacuucaggagugggagccugaagccaugcuuccuagggaaauaacucccucucugauaguuuguuuugcuaauuacuagucccaauuugagcucaauauuaccaacaauugcuuuauaguuacuuaugagucagguucaacauuuuaugcugauuuuacuugcacuuaaacaaauagaaaguauauuuucugggccgggcgcgguggcucacgccuguaaucccagcacuuugggaggccgaggcgggcggaucacgaggucaggagaucgagaccaucccggcuaaaacggugaaaccccgucucuacuaaaaauacaaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaaagaaaguauauuuucugaacaccucuuuuugguaaagcauguuguauauuugauaauuuacaauuuaguuugcuguuuucuuuuguucuuuguugcuuacuuucugugcuucaaguuuauugaacuucaaguuuauugagcuagaacuuaucacagaugguaaauguggaaaaugugauggauguagaacuccucccacauaggagugaaaugggagacuacuuuuguuuuguaauugauaguaugaagccuuacauggacuaucuucaauaugcauucauuacaugauacauuccugguauuaaauuguaaucgucgagauagcacugcuaaacgagauagcacugcuaaaguuuaugucugugguuuacuauuuaguauaauuauucuuagcuuaauaagcuuucuguacuauuaaaugaaauaauggaaucucagauuaacauuucuuuaaaaaaauuguauucagcauauuaccauacauuuacugagacugaacugcuuucuuuucaauuuucgugaaacuuaaauggcuuccguuuuucugugcaguaaauuaaaggugcuuacacaguuaugauaguuuccaagaagaauuucaaauuggcaucaacuaauugcaguagcaagugauccagguuuuacaaggaaggaaaaugugaaagaagcaugucugaguauaauuuuguuccugauaacaaauauauauauauauauauauauauauauauauauauauaacugugauucaaaaauauauaguaaaauuaccuuccaucaucccuagaaguuauucaccuucauuauaacuuuauaaccaguacauaacuagauguguguuuuauggcaagaaaaguuuauaaaauaaugacuuuugcuauggcauucuuuuaaaauaacacuaaugcauuuuaugaaccugguuuuucacuuaauccucuguuuuaugcacuuagagcuuaaaaguccugcaguaaauauuaucauccuuagcuuuccauauuuuuguucaggaagaaagaaaguucauucuacacuuaauuuuaaugucuucuugauucugggaacccauaauuuuuuucucuuuucuuacugaugggagaagccugcaccaucaugguuugcuacuuuuauaacuugugagcaaacagaauauuuaucucuagucucuuaaguagaguuuuaaauccacuugcacagcuuuuaaaauauucccaccugcccucuccaauuuguuuuuacuucuuuacauuuuguacauuugaaaccgaaauuugccuuauauuccauguguaaauaacagaaauaauuuuuuucugaauauuuuaauaaguguaauucaauucugguuaguuugcaacaccauugaacauaauauuacucacuucugcccacuuuuaaauacagacacuuucacuacucuuacagaacaguaaucuguucucucaucucacugacaguggaacaagaaaaaaauuuaagcuacaauaugagagaaguaaagugcauaacccaguucuauaauaguaucauugcuagaaagagcuugcaaagugcugugaauuuuuuuucucuagaaaguuuuccauuuacccuuuuauuuuauccauccauccauccauccaucccagagaauuuucucauggucucagugaauuuuuuuuauaguccuaaacaaaguuaaauaacaaaacuucugagguucuaacacuaugaucuugacaauccaagugaacaauuaucaguaaauauaacagaaaacucugccauuuacagcacuucacauuaucagauuauuaaaaugaucuaaaauuauucauuuaaaugcuagcagggaaauaaaugacucuaaauucccugcauuacucacaaauacuacaaaaaggaauguucccugguuucugugguuagaaaauguauagagcagaguauuucaucuaaaccuagagucuucuuuuuuuauuuggauuugccacuuauaacaugaaugauuuugaaauucccauagcagaaagcuuuucaucauugucucacuaagaaagacuugauucuagugccgaaaacugaagaacuccuuagggcauaaagucagagaacagcagcuuauuccagaccacuccucuaaauguuaaugaaacuuacauaaaucauacauaacauauacuaucccuuugugcuggaaaaugccauguuuuuaugguugugguuguacagcuaggauaauaggaaccaaagacauaaaacaguaauuaauauauuucagaagugaaguguuuuauuggauagaugcuaauuaagacugauagauggcagugauugaaauaagcauaagccauuuggucaacacaagugaaagaucagcuaucaucuugaaugcuuuaauuaaggaugcuuugcuuuuuguuucuucuucccuacucuucugaauauaugaaaaaacauggagaaaaaauaauaauaacugcuuuuugacagggaaacugauguguagugcaugccugauaugguuuggcuguguccucacucaaaucucaucuuaaauugcaguucccauaauccccaagucucaugggagggaccuggugggagguaauugaaucauaggagugguuacccucaugcugcuguucucaugauagugagugaauucucaugagaucugauaguuuuauaaggggcauuucccucuuugcuuggcacuucuccuucccgccaucaugggaagaagaacauguuuucuuccccuuccaccaggauuauaaguuucccaaggccuucccagccauguggaacuaugagucaauuaauccccuuuccuuuauaaauugcccagucuugggcaguucuuuauaacaauaugagaauggacuaauacaguaaauugguaccaguagaguggggcacugcuguaaagacacugaaaaauguggaagaaacuuuggaacuggguaacaggcagagguuggaacaguuuggaaggcucagaagacaggaagaugugggaaacuuuggaacuuccuagagacuuguugaauggcuuugaguaacaugcugauagugauauggacaaugaaguccaggcuuagcugaucucagauggagaugaggaacuuguugggaauuggaauaagggugacucuugcuguguuuuagcaaagagacugguggcauuugccccagcccuagagaucuguggaacuuugaccuugagagagaugauuuaggguaucugguggaagaaauuucuaagcagcaaagcauucaagaggugacuuggguguuguuaaaagcauucaguuuuauguagucacaaagacaugguuuggaauuggcacuuauguuuaaaagggaagagagcauaaaaguucagaaaauuugcagccugacaaugcaauacaaaaggaaaaccaauuuucugaggggaaauucaagccuccugcagaaauuugcauaaguaacaaggaggcaaauuuuaauugcugagacaauggggaaaaugucuccaggguaugucagaggccuucacagcagccccuccaucacaggcccagaggccuaggaagaaaaaaugguuuccugggcuggacccagggccuugcugcuuugugcagucucaagacuugcugaccuguguuucagcuguggcuuaaaggggccaacuuagagcucaggcuguugcuucagagggugcaagccccaagacuugguggcuuccacgugguguugggccugaagguucacagaagucaagaauugagguuugggaacauuggccuagauuacagaggauguguggaaaugcauggauguucaggcacauguuuucugcagugguugagcccucauugagaaccucugcuagggcaaugcagaagggaaaugugcgguaggagcccccccacaaagaguuccccaaugaggcugccuaguggagcugugagaaaaaggccaucguccucuagaccccagaaugguagauccacugacagcuugcaccaguugccuagaaaaacugcagacacucagugccagaccaugaaggcagcugggagcagagcuguacccugcaaaccacagggguggagcugcccaaggccaugggagcccaccucuugcaucagcaugaccuacuugugacacauggagucaaaagagaucauuucagagcauugauauuuggcugcccuaguggauuucggacuugcauggggccuguaauuuuguuuuggccaauuucuuccauuuugaacacguguauauacccaauggcuacaccuccauuguaucuaggaaguaacuagcuugcuuuugauuuuacaggcuuguaggcagaagggacuugccuuguuucagaugagacuuuggacuuggacuuuuggguuaaugcuggauaagacauuggggaacuguugggaagucaugauuguguuuugaaaugugagggcaugagauuugggaggggucagggcagaaugauaugguauggcuauaucccugcccaaaucucauuuugaauuauacuucccauaaucuucacauguccugggagggacccagugggagguaauugaaucaugggggcgguuaccccaaugcugcuguucucaugauaguaagugaguucucacaagauaucugauggcuuuauaagcggcuuuucccucuuugcuugucacuucuccuuccuggcaucaugugaagaaggauauguucgcuuccccuucuuccacaauuguaaguuucuugaggccuccccagcccugugaaacuuugagucaauuaaaccucugaucuuuauaaauuacccaaucucaggcgcuucuguauagcagcacaagaauggacuaauacaauacccuacagccugaggaggagguagauaggugcugaaaaguuggauugaccugauuccccaugaaauugcaucacacucugcaaacaaauacauuagugccuuugagggcucuagacccuggcucacaucagcuccaucuuuacgugauauuugcguuaaucacagaagcagaacacuauguuguacagauaagugcuacccacaguuaaagacucuaugccuagaaauaaacucugaaaaguuagaaacuaaauaucaacuccaucuaaagaaaugcuuauugucucuaaaaucaucuuaaaugcaaucuuaaaggaauguccccagaauacagaguaguaaaaacuaauguuuuuuucaugucuuguggcauagagaauaugaaucauugauauguuaguuucuaacuuuaauuuugcagcccccuuuauccauuugguuacauuuguuuaccuuuuguuguucuuaaauauuauauacugcuacagguauauuuuauagaaagauucuuccauuucugcggcuaagauuaaaauaccuuaaaugauuagccuuuaauaaaacuguauugaccagaugaaacaaaaggacuuauuuuuuaaaccaaacuaaugucugauucuaaugauacacaaguacuuguuauuccuguuauauacauaacauucacaaauaaggcaacaauaagguaagauaggcaaugaucuuuuaugaaauuauaugcuaauauauauaauuauguucuuaauauguaaaaacaugcaccaaauguuuuaaauaaauggaauacaaggauaagcaaacagcauuucauauuuucaaauucugauagcuaucagaucuugcauagaauuauuuugauugugcauugcauuauuucuuauuucaaugucuuagucaaagacuagaaaggacauuaaguauaaagcaaguaugauugaaguccucugauucauagaauguucuacccugagaguagaaaggcuaauaauucugcuaaaacaauaaaaaaggcaaaugcaucaaagagaagugcuuaggaaguucuugaaguuaguauuccuuguggcuagagaagcaaagaguaaaaagacauuguccuuuaaaacccuguccuuguugcccaaucauagagauagucaagcugucaaagaccaaagcauauccaaggcuggacauggaaauauucaugcugauuucaguaauagccuuuuaugaaauuaauugagagauuuacuuuuccagacacuuucaaacaagcuggacuguagucaauggguagcauugauauggcauagugguugguuuuaaaaaaacaaaccaggcugggcacgguggcucacccuuguaaucccagcacuuugggaggcuaaagugggcagaucaccugaguucaggaguucaagaccagccuggccaacauggugaaaccccgucucuacuaaaaauacaaaaauuagccagguuugguggcggaagccugauuuaggguaucugguggaagcuacuugggagcuuccagcuacuugggaggcugaggcaggagaaucacuugaacccgggagguggaaguugcagugagcugggaucacgccacugcacucgagccugggugacagagccagacuccaucucaaaaaaaacaaaaacaaaaaaaccugacuguagcccauugaauauucuuugagaagaagcaauuauaugauuguggcucauucauuguggcauuauggcaaagccauagcucaaaaaaaaauuccuuauuuacccauuuacuaaagauaacaccagguucugucuucuuagcaccaguuaaugauguucuaguuaauuuguaacuugcacaguaucuguucaugcuauugcugccaaacauauugcagaucaaggagccuguuaugcaacugugaauaagaaucuuaggccacuucacacuguuucaucuugucaauugggaguuuuguuugguucagcauguguguguguauguuuuuguuuuuguuuuuguuuugagacagggucuuacucugucacccagacuggaaugcagugacaagauaauggcuuacugcagccucaaccucccaggcucaagcaauccucugguugagccuacgaaguagcugguaccacagguguguaccaccaugccuggauauuuuuaaauuaguuuuguagagacagggguuuaucuauguugcccagacuggucucaaacuccuggccucauaugaucucuuguccucaguuccccaaaguguggggauuacaggagugagccaccaugccuggccuuaaauucugauggcuuuuaggcaaacaaguaauguacuauguauaucccuuuuucaaaauguauuaugaguucuguagcuuauaauugcuuccugugugcauauaugcuuuguggaggauuggagaaaacaucaguauaacaagcaguucacuuguuucucgaaaugcugugcuggugaauuagucacucuguucuacucuucagguuuuuugugugugugucugccauugaggaguauaaaacuuuuuucaaagucguuuacauuuggcuuuggcaaggguuuuaauuguucauuggagaguaucuguaaccugaaaauucuugagacacgguaaccacagaguuaauaugugacucacaaaaggcuggaaacugccuacuuuuuccauccugucccucucaucaguuuugcuuccacuuuauucugggaguuaauuuuuaucaaccuucacacagaaguacuauuuguuuguucauauaugcaagggaaauuauuuuuauuccuaaagcauuucucccucuuaaaauccuggauuagauuaagcaaauaucccguuuauguaaauaaaucauuuaauuaagcagaauagguaaggaugucagaaauaauaaaacagaugauuugucagaaauaaacuguagggcauaugauccuuugaagauaauugaaaauucacuauuuaaaaauaugaauuaaaaaauauauagaacuugaugaguuacaguuacauacauuacuaugcuauucguauuucggaaauugaaacucagaaacaaaagcagugcucuaguuugucauuccuuaucagugaaguguggaauaguggaaucuucauggggaauuucuguaggcacgaaaaaucuagaaaacaaaggcuguggaggaggcugccucagucauucuaauugaugucguacagcaggacuacucuuggguaacaucucuguugugcccaagguuauggagauuuucuugcagucauaggaagaagcucagguuaugaucaaccuggggagaaaugauuauacuccuuccuuagauagcagagaaguuugagguguacuagaagugugggguuauuuacacagugagcuaagaguagugauaagaaauuuuauguucaggacugcuuucuuauccuauugaacgucagucucaucccccuuagugacuuuauagcuugcuagcuaucacauuccauguuauuccccuuaugucuguuaaugucauuuccagugcuauccuucuagccuaucccuuuuuaaaaaaugugucuuauucucuguccuggcuccuggacacucauaucgcaauauaggaaagccuaauagguagaaauucaaaucacagaaaaguucagaauaaaugagcuuuauuuggguacaaaaggcaaaauagagauacugacuuuuuuuuuuuuuuuaacaaaaggucaaauugcuuccuuuaaagagcauccuccauucacaccucaguaccacugauuucuuuccaacacaguguuccuggagcauuuuuaaaucauugaguggguuuugccauaaagcuuacauuugccacuugccuuccacaggccagagcugcuuuuuuaagcaggaaaggaaaaggacacugccacuucauaugacagaaucaaguaacuuguaaauuggaaugcauuuuuuuuuugguucgcaauuuccccaaauuuuaaauaaaucagugugcuccuucccuuuacauaaaugauuuuugugagaaacaagaagcuguucuaagaauaacauucaaaauuucuuuaagaaaauucaaaccuugcuuccaaaacaggccuauggugagaucguaccaaccauuacaggauaagauuacaaagagaaaauuauuuuuauuccauucugaggggaugucuauuaaaguagcgcauaauuuccagagcaguucucuugagauuaacuuuuuuuuuuuaauggcaaaaugaagcaauguaacauaaugcaaaucacacuaccauuacaaaaaggaaauuaaaguugggagaaucugucaaaauauuaugaaaguugaggaguuaaaguuuauugcuuuauuuuuagaauuugcaaagguguuccacugcagaaaugccucugggcauuuguaaaaugggagggacaugaaaagagcagucccuacucaaauggcuguguguuaauugagcucuuugccccgccccccuucucuuuuauccugcucccuccuuacccugaaaucccuaguauuucuagauccacagccaguuugugucuuaaugggcuuugugauuucagaaguuuccuucgacauaagcucuucggcauacuaauuguuucucauggagaaacuauacuguguuucauuccaagcccuucuucacuuuacuguagaguuugcauuaaaguuucagaaauacaaucaagcucucucuacauuuagggaaaggaaauaaagcacuugccucaauuacauuugucaacaauuuccuuuucugaauaugcuaugacagaguuuaugauauuauagaauuauguuuccccuuuaaccuuucagucaaacuguugauaccaguuucuuuaaaaaauauauaauuagugcuaucauccaguuuuuuguuugcuucgccuauggcaucagagaggaaugaguuaauccauuugaaaaaauuguuuuaaguuaagcugaaguuuuuuuagccaccacuuuccuucucucccauguugauuacugaagccggauuauaauugauacauuaaauguaaaauauugaggcgauaauauauagaacguuuaugguuuuagcaguuggagguuucuggauugaauuugaaugcacaagcagaguuugagcuaccgugaccuuguuacuaccugcauuuguacaggaauccuucaugaucuagauugacaagcagugaaucucuacuuucaaguucaauaagccucucuuuuauuguuuuuuaaaauacauauuuaauuuuaaauuuuccuauagauaacagagacuccaauuaauuuuacaaguuauugcugcuuucugagauuauaauagaugugagcuguuauaagcuaaaaugagcccucauauuuaaguggauuuuguaaaugagagcccagcauuucugucauauucaguucuuauggauaaaaugaaagaucauacuuuugcacagaaauuaggucugcucuaggauaauagugcagugauucaguuccuucucaaguguucagacuuaauaauauuaccuaggacaguauauguaucuuuucaauggauagaccaauggguguauuuaagagaauuuuauaggucaaugaacguacauaagagaauacaacagacuuacuuauuuuuuauauaaauuuaaggccugggaacuucaaguacuuaaaauucaaagcucugucccuaguguuuuggaauuucucuuuacuaccuaaaauguugccuuugauguuuccuguuggccaaggcagagagugaaauguaauauaaagcuuuauaugaaaaauuguaauaauauguuuaaggacacauuuuugaugcuagaacuauguggaauugauuucuaaaagcauugggaauuucuuccuaaaacucggaguaaugcuuuuugaaauauuacccugauucaccaacaaaacagcaauuauaauagaauacauuguaaagauuuuuaauuuuccguuuguguucucguguccuuuggugguuaaguauuuaaaaucccaacucugaagugaaauugaaauguucuuaagaaaucuguuguuacaaagucuagggugggagagaauaauuacacauagcuuuuugauaaacaaucuaaauugugcuucaaaggacagauguggcuuuaauaaucugaagcauuugcauuuucagauuaaacuuugcuugauugcguuguacuugauauguauacuuaaaucuauauguuaaauguuauacuuugauauagcacaucuuguuugacuuuguuccuaugaucugacaagcuucauuauauaauaaccuaguuuaaauaaaucuuaaagacauaaaaguguuccugacaguaagaaaaaauuuaaggcacacaaaugauguaucgguuagauguuccagagagagucgaaguuuuuucauucaaaucuuugaacauguguuuugaauaaagcuguaaggcauuuuccaguaaccaguguuguauuacaaaaaugaguaaaguaaaacaaaaggaaaacauguuucaacauuuuauucaguuuugucacauauuguugcacauuuccuacuggaaguaaaugugacauuuguaaugcuaaguuuucaaaccuaaccuuuucuaugauauaaaaaaugacauagaauauugugcccuugugagacaagcacaaauaaugaacuacacucucagacuucagacaguuuccuaaauaguuugagugcaauaguuugauguaaguccaucauuauaguuucugaauuuucucuacugaauucuauccaggaauaagcaacgauaaacaggucacagaacacuugauccaauggccuaccauuguauaaaaucaaacagggaaauaauaucacucuaguuauacugauugccaggguggacaaagcaguuggauaaaauaauauuucagugcaaugaaaagcaagaaauuuacuuaaaaguaggaaaaucugugcucuauuacuaggcuuucacuguuuuauuuauuggaaauuaauuagcugacuuugaaaugcaaaaaaaaaucaagacagcuauuuggugauuuuguuuuuuuauaauaaacaacagcuaaguacuaacuacuaagagguaagaaugugaagcacugagcaugugcaagcaauuucaauauuuaaagugggaauuggggagagagauauuucacauuaagcuauaaacuacuuuguaggaagauggauguaauuuauuucaguguuauauuaguuauuuuauauuauauauuuuauuaaaauacuagcuuugaaacaaaucuaaaacauguacuuuauaagcugugguuaacacuacauuucuacuaaggaaaggugugcccucugaaauaaggaaaacugaaauuucauaugcaagcugggagcauucucuuucaaaauauuaauuuauuaaauuauuuuuaaauuuaaauuuguuuuaaaauuaaaaauuguugaauacuugagagcugaaaucaaugaaauacuugaaauaaccugcuccuuuagcaaaguaguuauuucuucaaugaggguuuccauguugaccggucauggauggauauuugguuucauacacucacugaguguggucagcagcugggcagacucccaugcaccacuccaugagguccccaaaucugaccucucagguuagguauauuuacaugaauucugucauuguugugucuaggaauuuagacagacagaauuuaugaggagaguggcaaaagacauugcauuuuauuucauucuuucucugaggauaaaauaaauaucucagaaaagggugaacauuucuuuucuucaguuuucaaauugcuuauacuaaauuuaauuuuuauguacaggcuuuguuuuuaggagagcuuauguucaguacaccuaagaggaaucguagucacggaauaaguuuccaccuaagcucugugacgugauucaugauucauucccuaccuugauagauuuaugaauacuucuaagugaaccuaucucagcagccaaauggaaguguuaauaucaugaaugcauuuauucaaacacuuuuucagcucucacaaaguuuuguuauaaagacgauuuuauuuccucucacagcaacauacagaaggagcagcuguuauugcccuuaguuuacagaugagaaaguugagacuuaaagccauuaagaauuuugugguagcaaagaaggauccuguauuugguaaauuuggguguaauuaugaguuuaauguaugccuuuuuggcaguauccuuucuggcuucaucaugcuauauccccauuguccacaacauugacuggugcuuaguaaggugcucaaggacgcaucaaaugaaugaacaaagacuagagacagaguugccuggccuuauucuuuaaauacccacacuauaggacugcaacaaaauacagagcccuagugauuagaagacuucaaaaguguguuuucuuuuuccaggugcaugccuuugauuucuugagaugaugaaaaaaaaaaaaaaaagagagagagagagagagaaaagaaaaacaacaaaaaccucuuuauuuuguaaaguuuuguuuguggaccuagaauugaauaaaagccaacauuuguccugcacucaugugucggauguccucuaagcaucuuacauucaugaauuugcuuaauuugcaccauucaaugagguagauaccauugucaucuccauuuuauacauuagaaagcuaauauaugggggagguuaacuggauugcccagggucacaaaacagcaagaguggauccaaguaacuacugcauuagacugcccuucgcuacacuauaaauucucagucuguugguuuaagcuaucguaugaagaugacuagucacaaugauuuuucugccccaguaacugauagauugucugcaaagaucucuucaccaucuuuccugggcacuggaguugcuugggagcuaucuuguuccuugagagccaguuguuaucacccaggguauuguugagacuuugagaguaagaucauauuuccucagaauaccuucauuaugaauuucauucauuucuggccauaagccuugcucuguugacacaagaaugauauacguuaaauuuugguuaguagcuaccuguuggaaaguagaaagaugaaagguguugaagauagguaaacaggaagcuuccacucauugguucuggguuugguuuguuuguacuuguguuguuuguucuuuuuuuaagguuggaauuuguuagauuuuacuuucguuauauuauuuuuauuugucuucaaaauaauucccaauuuuaaaaauuuaaggaaaguaaaauagaacuggauguauaggcaaucaaagacagccuuuaaucuuagcuugaaacaaaaauagucugauuuuuacuccuagaugagguuuuuagaaauuaguuucucaauguagaacucagaaagaaaacuucauaauauguuucaacuuaaaaggccuuuagaaaccaacuaaauugaagaaaucugaggcacagaaauauuaauugacuuaagagaugccacaaacauaguuaguucagguguucauuaguucaagaaaccuuuauggaaugccuaccauggggaaggaaauuuaguuguugcuggggacacaugggugaauaagacaguuuccacaagggauucagugucuuuagagggaaggcaucuaaguaaacagauaauuauaaugcaaacuauugauugcuucaacaaaagagguaauugauggucuaucuaucuaucauuugucuauuaccucugucaaauaucuaccuacuuguguggguauguauguauguauguauguauguauguauguauguaucugucuaucuaucuaucuaucuaucuaucuaucuaucuaucuaucuaucuauccuugucuauuuaucuuuccaucugucaucuaucuacccuuaaaacauacaaagcaguuagcacagugccugguacacagagaguucuuaauaaauaacauuuguaugaugacuauuauuaccuacaauucccagauuuuucauuauauuguaugacaugcagaggugauucugccagacuacuuguuaaccuuaucacugucauguuugugagacugugaaaccuugcgugaagcucucaggcaaaacuguuagugacuaugcuauuguggggccuuguaaauacuucuguagcuauaguuacuuggccauauuuuaauuauuuguaacauaguugagcuugaacugugagauaaauucauucuaauaugaggcauuguuucuuauucaugaguaugcccaaagauuagaauauaguaugugaucaauacaugguuggcuguugcuugaaugaaugcaugcuacaaagguuuuggcaaggaggaaaguuugguuagucguccaaacuacuucuuagacguuugauuaaagaaaagcaguucugagucuuaauugaaucgcauggucuugguuauaaggcuucacucuaagaaaaaaacaguuaaguuucuagaucaugucagugacugcuuuuaugauuucacuucagaucugaugccacuguaaucuaguugcaaaauuuugcccuaaaauuauuuuauuauuuuuguaaguauaauuuucaauacauuuauuaucugaaaauaaaaauaaaauauuuaucuauuauucagggguuuuauaaaucccaagauuauauaggaaaaaaacccugauuuuuuguuuuaacuccagagaaacuugauguuaggauucaaauaucaaucuuaaucugauauaugggcuuuucauuaaacuuuaaauaagcuaucagauuuuuaauguggggugugugugugugugugacuugauguacuggguaaacuaaaauacuaacauuucagaaaaagaaaacuuuuucagucugcaaucuggguaauaaauuuuacugagcaggugauuguguuacaggauggauuauuugaaacucauuuauuaauauacugaacauuuauugaacacuauguguaagucacuauuuuggcacuugagauauaucaguaacaaaaaagagagagauuccucccuaagcaaugucuuucugguaacuuaauaguaagccugaaaacaauuaaucuuuaaugagcaguuaauauuguccuugacaagaauucacuaguguguuaucgaaguauauuauuauauauguauuacauacauaauuucauauuacauauguaucauuuuaaacaauguuauuauguguugggccaaccuuuuggacaauuuuccuuuacuccacuggucuacaaaaaagacuuagauauccauuuguauaacucaacauucuggcaaaauccaagcuugagagacauguggauaacuucaguggucugaauuugauuauguucuacauaugggaaacaaucagaguaauguauagggauuucauaguguaacuaacuacauuaaaagaaaugagaacucugcacaccuaagcacauguucacaauuuaaaaauucaggcaggcaguuccacuuaaaagaucacuaaaucagcagucuaauagucuuuagggaucaucguuuuauuaucucacuaacuuucucauuuaacuuugucauucuacaaaccugaaaauuacucaauuuucucagccucaugugauucuggugauauccuuccuguuucaagaguggcucaaaacuuagguaaaugaggagcuaucuuagaaauaucaacaauuggaacuucagaaaauguaagauagugcacugcaagcugucuuuaaauaugacuugguuaaaaaagaaaagguaacaucauuauuauuauuauuauuauuauuugagacagagucuugcucuguugccugggcuggagugcaguggcgcgaucucugcucacugcaagcuccgccucccggguucacaccauucuucuguagcugggauuuacaggcaccugccuccaugccaagcuaauuuuuuuguauuuuuaguagagacgggguuucaccguguuagccaggauggucuugaucuccugaccucgugaucugccugccuuggccucccaaagugcugggauuacaggcaugagccaccacgccuggcuaagaaaagguaacuuuuacaaccuccaagacgugaacaaaauuuauuuuuuuuaguuaaaaguuauuguggauaguuauuuuggaaagacaaaauagcuauuuaaucauauaugcaaugagugauuuuuugaagucuugaucuuaagaauuucaaaauguacugcagaauauuaacuuggaugcaaauaaaugaaagcuaauuacaacaaauauuuucaguuuuguuuuccuauugaagcagaaagacacagaagaacacaauucugagccuucucuaugaacacggcaugccccagugguuuauucauggaauacaguagccugccaugcugauucuguguucuguguuaauacauuucccuggugcuggacgccauacuagcaggugcugccuacauguuugguaaacaaaucauuacacuuguucucagucacaucugcuugauuuucuuaaaaggggauuguuacauuuaaaguauagcaaaauuauucacagaaucauagcccauugagacuaaaagggccaucaguaggaugcauccaaaccugucuuuuuacaaaugagacccacagaagucgcccugaaugacaccacagcugcucgcaggaccuggacuuuguccauuugauuuaauuggucacuucaaauuguuauuaauuauaugauucaguauguuuaugucuauuaagaugauuaaaaggauggcauguccuuuaaacuugacuaaauacucacuuaagagagauuuagauucauauauaccauaccccauuuacaaaacaguuuuucugagcagcucaauggugccucuauuuugggaacaccauaaacaaucuaagaacacaaccuccugugagucauucuguuaucuaccaaaucguaucccucgggaaucccaucuuugacugcccgcuuccauuuccucacaugcagucauuggaagucaggauugaaaaggaacuuaaaagucauaugcaagugucaaaauuucucuugaauucgaccccccucccucauuuuggccuuuucauugucccugcuuagucaucagaaccucauagacuucuuaaagggacugcaauuuuuacuucuccaauuuauauuccacacuuccugcagaugucuacaccuaacacacagacagaauauccaacucaaaacucauuaauuucucuccucacuuaaagcaguuaauaccagcuuucuugcugugccagucagcacaccugcccacccaccuaggugcccaucuuacuguuccuccagcucugccaaucacuaaauucaucuugucaccauuuccaccuuuguaaauguugaauuggguccagcguuaguggucguuuaggauuuuguuuuuguuuugcuuuuuuaaccuuuaaaguaaagcuaccuauauuuuuuaauuuauuauuuuuuauuguggugaaauacacaucacauaaaauguaccauuuuaauuuugaaguguacaacucagugguaugaaauacauuccuaauguugugcaaccaucaccaccauccaucuccagaacucugaucuucuaaaacugaaacucugaacccauuaaacaauaacuccccauucccuccucccuucagcaccugaaaaccacccuucuucucuaucucuaugauuuugacuacucuaacuaccucauauaaguggaauccuauauacuugucuuucugugacugccuuauuucacuuaacauaaugauguccucaaggucauccauguuguagcguauguuggauauuuuuucauuuuuaaggcuguauaauauucuauuguauguauauaccauauuuugcuuauucaucuuuggacagacaacgcuuccuauacuuuuucuaaucagucuaaauuaaccacuucuuuuuaucaaaacuguuuuuggugcacaccacacuuucuuucguuguggcucugauaggauaauuauauuuuaugcauucuuuuuucuaaaccacaucauuugaauggagcauuuuguaccucacuugacuauaaacaaaaaauguugucuaauuuguucccugcccuguccuuagcucauaggcccucaggaagcaguuauuaaaugagcaaauuaguuuucucauuaguggaagcuggauugcacagauuugaacaacacaauucuugaaaauauauauuucuauauauuuuauaauuaggauuuugcuaagucauucucuuuagcaaauuucuuaauaaauuuugaaccccagauggucuaaaauggugaggauuuuaucauaucaaaaaaagaagaagcaugccuauacauguuccuuuauguuuuugggggggaguaaaauagaaaagccauauauuuucuuaguauuucuuuauguauuucuuuaugguuugcuuguacauaaauauacugagaaauaguccagaaauuuuuccaauguacaagucuuaaggugaucuuugccaaagugaguaguugguacaagauguuaaauucacuuaauuucuaaaguauauuuauucuguuacuuaauccuuggguccuauaauaguaacauuauaucauguaaaaucgauauuauauauagaagauauaucuuaaaaguuagcaauauuuuauauguuaauuuuuuaguguacaauucagguugcaggucagaguaagaauugaggaaaaaaagcaaugucaaaucugaaucaucaagaaagaaaggggcuaaaaauuccaaagcaguagggaacacccagagaauuuaaagcaaauaauucagggucacguaacauagaauaggauguauacagagguucuugacacguugcguaauuuaccuaauuuuuacuucuccacuuuauauuccacacuucguugcacaggauaccuaauagaaaaaaacugcaauuauuuauaaaaauacuuuaucuauauuuuguauguuguauaagaaaguauuuucuucuuuuagaaagaagccauggccaggcaccguggcucacaccuaucacaccuguaaucccagcacuuugggaggccuaggcgggcggaucaugaggucaggagaucgagaccauccuggcuaacacggugaaacccugucucuacuaaaaauacaaaaaauuagcugggcauaguggcgggcgccuguagucccagcuacuugggaggcugaggcaggagaauggugugaacccaggagguggagcuugcagugagcugagaucacaccacugcacuccagccugggcgacagagcaagacuccacaagacucugucucaaaaaaaaaaaaaaaaagaaagaaagaaagaaagaaaaagaaaaaagccauauggcauagaaaaaaaaaauucugucuuuggaggaaaaaggaaaaaagucccagguuugaagccaguuguggccucuuacuagguauauuauugagucuuucagcucuguuucaaaaucuagaaaaugaguucaguauuaccuguuuaaauuugugaauaacgcauugauguacacccuggauucccuaaaacugucuuaacugcgugaguccaguggacucagugcaugagucuaaauccuuagacuucuaucagaccuucuccccuagcaguuucauuugcucuuuaaauacaaacauuggacacucaugcagaaccacagaaaucauguagacaaacuagaaauuaucgugcacucacaaauuauagcuuccauuauuagguaauacaugcuaaacccuagcaaacauuaaguacgugaacuccuauuacuaaauaguaaucacucaaguaaacuggacaaaaugucuuacggagguacacaucucaugugaaauuaaaccauguugcaggcagugcuacaaccugagauuuuacacaguuauuuacauuucuuuugccuuuguggcaauaugugccuguuaagauaggcuauuagagaacugagcaaugagaacacuuacaccuuaaaguacaaggaagguaaugugacaauaucagcagauauuuugcauuauuuaguuaguaaugaauccucaaacucuuugaaaacacaaaggaacuugggcagcaagugaggguguuuaauuuaaucagaauaucacagaaguuuauaaaaagaaaaacaaaauccacaugguaucuggaagccuaaggcuuacagagaccucacauauaucucugucaacaaucuaguaaugaauuacuaugaaaaauuugaggaaugggaauacauuuuaaaaguuuacagaguuuuaaaaugaaaccuuuguaccaugaaaaauuuacauuucaugcauuguaacaauuuuuggaaagcaggaucuuuuaauguacuuauauucuguuauauagagcucuuuguugaaagagcucuauauuucaaaauaauucuaugaauuucaugaaaaugacauaauaaaauuuaacucagcaggcuuccaaccaauagaguguuauaggauuuacaaauaauucaauccaucauauauagugauaauaauaucacuguuggcuacaucagauugagauuaaucaagcaucaguaucuuuggcucagaggaaaaaaauuaaguaauagagcauucuaucauugcaguagugugaaugcugaugaaagaaauagugguucaaauucucuuguggaauuaaauaugucaaaacaacuuauacauaguggagcuuauuuugcuuaaaagccaaaaaacuugaaaagcuuuaaaagacaaacaaucauagcauggaaguacaguaguacaaguaggauaauucaaaacauuaccagaaaacuauuugaauuuucuuaggcuagccuauuugaauggcuguauccagggugauacucaaaauacgguauugaauagccagcauggaggacacugauggccccaacaagacauacugugagguaugucucaggcuagcauaaaugugcacauacacuguaaaauugugggguguagggagguuaaaaaguagauaaguagaccccacuacccuauaauuuccagggcaccaucauagaguugccgaccuggggaugaaacucaggcauuuaucuacuuuuugaaagcagccaaguggagacuaauaaauaggaguguggagaccacuagauuaaacaaccuauuucagcuucacugaaguugaaugaccacaugaauacauuuccuuacaaguaaaguuuucucucauccaaaggcuucaagugugucaccgugggcaagaccaaauguauacaccacaacaaaauuuuaucugugucaacagcaauuuguacauuuuauauacucuaauucauccaaaucaauugccugauuacaguuuggguacuuuagaaguggauagucuuauaacuggugcugcaguagaugcaugacucuuugaagguguuucggaaaccauguucauuuucaugaguuucucuaguaguuauugcugauagauuuaaguggcuuucccaggaugucaagacaacaauguguuucacauuuugagcuuguuuucaucuuuaucugagacaugugaugaacugucugaaggcagguggagaacagguacacugagauaucuacacauacauaugcaaacacacacauacucacauguacacacucgugcaaaugcauacacuucuguuagcacauugagacauggauucacuauuguggacagaauuuuguuugcaugauuguguacauauguuugucaguaaacgcucagcugacucuauccaacuuuagguuuaaaaauauuggagaugggcugggcgcgguggcucacaccuguaaucccagcacuuugggaggccgaggagggcagaucacaaggucagaaguucaagaccagcccggccaagauggugaaaccccgucucuacuaaaaauacaaaagguagcuggaugugguggugggcaucuguaaucccagcuacucuggaggcugaggcagagaauugcuugaacccaggaggcggagguugcagugagccgagaucgcgccacuguacuccauccugggcaacagagugagaacccaucucaaaaaaaaaaaaauugaaaguggaggacaagcaaaauuauuuuauuacuauacuguuucacaaaugcucacugagcuuuuuugauuuugcucuguuugauauuagccuagguuaguuaaaaaucuguuuccacauugauauaucuagagcguuauuaauggugaugcgacauuuuauaugucaggcucuugaaaugauuuagguaaaagagacauucguuuucucaguuucaacuaaaaugauaaauucuuauguuacaucugugcucgaggaaacaccacuaaugucaucucauuuauauaaauacuugucaggugacugccuaauuuuacaggcaucugagucuuauccaagcaucccaaggcugcgguacuuggaaguuccuuuguauuucaguuaauggcaucaaacaagccuuugccccgcucuacaacaaagcaguuugaacguuaucacaucaaagagaaagaugccauugucugcaaacugucuuauaucugucagaauaaaucaauuaugggacagaauuaauuugacauaccauuucuuucaaacaagagacccccccauuuccuucucagaaauguaaauauauaauacauaauauauuuuuuuuuguuuggugaaaagauaccaguaaaaugauaacaucuggcuguagcaaaacgcugccagcuaaggaaugguuuccucucugcgggucugaccagagucugauguugugcagaugugcagccaggcuugacuguaaaaguuauaaacauugucauaacauuguucgacuucucuaguauuuccugucuucugcuuagcacuuuauuacuaagucuggccagccgccaagugaaaugcagggaguuagggccucuggcuugaaauuuaaaacaaguccagaauucauuggguuuaauuugauaugcgaacucugauaacucacacuuguuaaaauaaagccgcuuaccauucaaguuagauuuacacagcuuugagagaacauaggagaagaaggggaaaacacauuuuucaaaacuuuaauauuggccuuuagcgcuuaaguuuuagaaguggggguuggggagggaguaggagucggaguggggaacagcugauucagaagcuggacagcuuacagcaaacuuguguucauuuccuguauuagaugcaauucccugggcagagaaugggccuuucuuucaacacuucugagcacguucuuucucuuggcucauuuucagauuaggaaggccacaugaggcucauugccuauacaucauaacaaaauggugaggugaaaacaaacgaacgauaccccaccaggcugauuuuucugcaaaggguaucuugugccaggguugaacagaacgucauugaagcaccagcauaaagacauguuaacccaauuuuuccuguaauguauacaugauugauuggcaauuuuuggaccacaggcugugguuaggauuacaucaaucaggaagcaguaacucuugagggacuucccuuaaaugaucuaguguuuauuggcgaaagggguugcauuuuuugcagucuguuucuuucauguguucaucaguuccauuccuguuugaaauuugguaucagugcaugagauaagucacuuuucuuccuuuuauauccccuucugucauuuaaaaugcaagaugaugaaccuagcacaaugucugguacguagaaaauacucauugaaaaaaaaaagagagaaugaauguugaaugaaugaggaaugaguagugaauaagaauacauuuguguguauauagccacauuuggauuuuccgauauucagaagugguaggaacacagcaugccacacauuuagcuauagggcgccauucuuuuaaguagagcacugcacaucuaauauagcaaucaacaugaauauacagguuuuaccuucuuugcauuauuauauuaugucacgucaucuuuguaaauaacauuaaaaguaaagaugugaagaagaauaggcaaggggaagaauuugccgaaugcuaggaguccuuguucacucuaaccacccuuuuguacacuuuugggguaacaggaaaaauuuuaucuguaauauguguaauaugucaucagaauucugauggcucucuuuguuguucuguggguuuucguaauggucucaaacauauauaacuuguuauguucccaaaaggaugcauuauggaucuaugaaauuuuuguaaggugugaacacuaaaacgcugucccaaggcucugcuguuaauuuguuuuuauugaggaagaggcaagaaugaggcacauguguguggaaccacuuuucacugcugggguuuuuuucauguauaugugguguucagggauguaugggugucacaugaguuacaguuccuaaaucuggggaagaaagaaguuccugacgcagaccuucccaggccacaagauucuaaauuuauaaaaaggagagguagaaaagaaaaccauguggacuguuacucccaguucaggguuaaaaguuuuuuuuuuuuaaaaaaagagucagcgcauuagcuagugauuucguuuaagugguccucacaaaaucauuggcgcuuuauuguauuaucuaauuuuuggaaauggaauguaaggcauuugaaaguuaaauagcgugaagaaugaaaagcauguucaaagcauuuaagauggucggugaggccugugccauucagagcagcuccugcggacacagaaggacucugaguauggacugucuaaucucauuggguuuggaauucacuuucuggcuccauaucacgaucagaacagauguuucccaggcugcauaggugggugcaagaaauaaauuucagaaauaacuuacuuaaauuuuuaaucagguuuuuguaagaaaacucuggaauaguacuucuccuaauucuccguuacacacagccucauggcucugcacaggaugugacuguguguaguugcaucacguuccuauauacucuaauuuguuuaugcaagaaauucccucacuuuuuuccucuuccaaguauuuuccucuguguguguaugucuguguguguguguguguguguguguguguguguuaaaucacauauuacuuuggcaucuccaagagaaggcaacaugcauuuuaaaguguuaugugugaagcucaaaguauuuccuguuauuugggaaugcuucugaccauuauuucucuuccagcagucugaugggaacccagcauuaauuauguaugccauuauuggacugaucagguuaaauagcuaguugguguuuaccaaucucauuugaauauuaaacaggcagauaagaaaaccucaccuuaauauuaugcucuucaucucuguagauuguuacaaaaggaauauguugcagagaauauggagaagaaaucaugaaauuuugguguggggccaacagaccucuagcuagcugcuggauuaguaagaaagcagcuuucugcugucagaaucaacauuacucagacaguugcagaagcucugaagccuuuggauuuguuugcaaugagagauuuguuguggauuuuuaacaaggcuccugugugugugccaugcuuaguaaauauuggccuucaggguauuuuucagucacgcugaauggacuguuaguuuccccaaacugcaaagugcagaaaauccauuucccugauuuuguugccauugagauugcaucauagguuuugcacagcaaaagcaaaauaaaaucuagcaaaaaucuuuuuuuuuagagaacuggaaaagugaucaggaaaaagaaagauaucugugauugcauauacaaauggaccuagaauagagaaguucuuaauaguuaaguuguaacuuaaaauuauuucagcuaaaguaacugaaauauuuuccuuucuuuauaacagaggaaauuagucauauuguaauaauugugacuaauauaaucaaauaaugaccuuuucaaauauuauaauagguuagauccuucuuuuaaaucaacaaauauuauuuuuaaaaaggaaauucauuagaaaguagaauauaugugguuccaaguguuuuuccuacagcaaaggggucuguauugacaguuacguugaaucaggauugcuugacauuauuaacaauuaauauuuaaaacucacuuucaaaagaugaucgacgaaguuuuauauuuggccucuaagaaggaguuucaggagacauuaugauuuugucaagggcaaacuaauaacaucaaauauccaggagucagaguuuuguuauaguuguuuaauggugaugguccgaaaaauaaaguugucuaguagaauuaguaugcuuauacuuuuuaaguuauuuuagaaaauggucaguuccuauagaacauacuugaaaugagugaccagccucucaaaguugugauaaagugagagaugaaugcauuucaagugcauugucuaucucggaauuagagacaccuauuugaggauggaguuugggaacccuucuguggccugcguuuuugaccaaaggccuaaagcaugaaagaauagccggaaagagagcucuuuuccauauguuguccauuuggcugucagcacucguucugacagaaaagaacagagucuugagugacugcuagucucucuuaaaguaugguaaugaggcuaauuaggagagaugagagcugaacuacauuugugaaggcaauuauccauauagcuuuugugccaugcuguaucuuuguaagauuccucuucucgaauuuugucauuucucaaacaucacaagaauaaugaaaaugucuaaaacaauacgagcaauguggucaguagaaaagaauaaauuacuaaugaaauucugugaaccugaugucuguuugcagucuuccugaacaaagauuuggaggauggcuaagauaauacucacaaguguuguuguuguuguuuaguuuacaaaaaugaaaauuauuugcacuuuauuauauugaaucuauauaucuucuuugguaugugaacaggauuuugcaugguccuuuuauguuagucaucauggcaagucaguaauuuaguauaauugaaaggaaaagacaucagaggcuuacuaagcaagcauaaaauguauucucuuuuaugugauuuagaaaguugagacauuuucauuucuauuuucaaagguuuaaugcacuuuaacuuucacaacaguuaugaaaguaaaagaauggaccuagaucucuguacagugauuucauaguaggugacacugaacauaaguuuuggguuuuuuuaaguauuuaaucacaaaaguuaacaguuaaaauacuuguauuuuuuaaucugcugaauuauuuuugaaugguauugcugacauuucauauuauauauauauaaaaauaugacauucuaaaagcaucaaacucuuucuaaaguguaacugaaguuuuuuccuccaaaaagaaacuaggcugauuuaauucaauaggaauaccaacuggauuugguugguaauuguuuguacucacauuuacaucuggacauaauguuuuauuguuuuuaagucuauuauaacuuuuauaucuuauaucuuuugcucaaaagcucauuagccuauaagcuucuaaaacacauaaaggagauaauuuuuauuuuuguuuuguaggauuaaagaaaaaaucaaauuaagugacacauagguggaaaaucugucugaauugcuuaacaguguucuuacauaugaaauuuuauuacuuuuaaauacauucaguagcaaauuugagcaacuccgcuuugucucuuguuucaaucacaugacuaagcuccuuuggagcaaggauagggcaaagguauagucaguagcuuugauaaagaagauguagcagaacccagaaggccauaguacagcuggagcuaaaagacuggaagugacucucaaacuugagcaugucugagacucacuacaggagacccugcuaaaaauggcuaaaaauacagguuccuggaacuuauaacuauagugauucugauucaccgggucuuggaguagggcaaaagaaacauauuuguaaacaaguacuccuggguuauucugaugaggguggcauaugggucacccucaccuuugaaaaacaguauuguagaccaggaaaugugucaucccaaauaucaucauauuagaacaaggcuaagcacugaaaacugcuaaggagacucaacuagaaacauaaaaagacgucagaauagagcagaaaggaagucugaauuggugacuccaauugaauaaugcccaauguauaagucagucugucagauuuuguaauccccauaacuuuucuggguucaugauuguuaucuauaaauucuuuagcucuaacauucgaggauucuagaauagccauggauagagcgagaaugcaugguagacuguaaucaggaagaugugccuaucagggauggaaaaauacaagugaucagaaaccaggccaagaguggagaacuaagaauuuuagaggaacaacaagcaggaaacuaaauugaugcaagauucuugcuccuaacugaagcagccuucugccucaggcccaggucacuuuuggugguuguuuugaaacaggaaccaaucucaauacuagacaagguccugcagguggaagcagguaauuggaagcagcuggugcaggugaaaagugugagaucaggggaagaaacaguuuuuggguugguuuuuuuuuuuuugucugacaggaaaaaaaaauauuuuuuugaugguggaagcgaagaguaauaaauagaaguaauacauacacagcacauuccuuuuuauguagaugauguuucaaaaagcuugaaaacacuuaucugaguguuuuaaauguuucugcuggaaacauccuuacauuuugaaugaacucuacaaagaaacacuuugcaaagucaaaacaaacagcaguccauauagccguaccugccuuaucaugaaaucuaaaugugugcaagccaaaauggugcauuucacaguccuuuuauccaaacucagacuuaaaaagugaucaguguucgaaagggggaaaaaagaguuauacaggaaagaauugaauuuacugggaaaaaaacuucauaauaaauauauucaucauauauuuaaguauacuucuauaaauguguccugcagaaauuuugacgggcguguuacauuuuauguuaaaacccuuaugcauugauauuuauagguaaguuuuuuuacauugcugugacaguacaacaauaagguauuaccuuaguaauuuuucguugccuacucuaucucaccuucugcgauuuuagccuuuuauuaaagccaugucuugaaagaaaaugaaagaaaauugucuucaaguuagugugccuguuuuucuuaaauuuauauauugagucauuuaauucuucucauuuuguuagugaacaaaguuuuuuuaggcaauuaagagucauaguuuccugccucuccgaauuugcgaucucauacaguaacaaacacuuguuuuaccucauugacucuuuuguuuccucaagugaaagaggaauugggguauaauuuaguuuuaacaucucuggaccaacuuaaaaaggaauguaacucaagauguaugguaagaauagugaaauucuucaacagaacucacuaaagaaagguuuuggggauguugcagaaaaugauaaguaggaagacagcauaaaagguuuagcugacgagguaggcuuggaaagcauaguagacauaaagcaaguugccugaagcuucuuaagaagaagcccuggaaacaaaauuguagcauauaaaguuucauggaacguggagucuugagcugagcugugaaguuuacacagguuucugacaguugagaggaggggagagaagaauguaugaagugcacugagcugggaguguaugaggucuguuugagggaacuuagaauaaacuaguuugacugggaggguucagagaagggugauggguaauugaggaaucuagguuaugaagagccuuaugaauguggcacaaaggauuuuggaauuuauccacugaguugugaaaagaugaaaguuauaaacgaagacaugauauaauuagguugucuucagaaauuuaaccuagaaaugauaucauugguggauuggaaaacaaagacacaagugcaaggagcuauccccucauagaaggaaaaccucaauacuagaaacaaucuacaggacuuggugacuaauuggauaugguggaggaaguuggugccaauuucaggaugguggagucacacugaaugaugaaaaggggaagaaaaucaucuuuguuggaaaauaccauuuaaaaaaauuguugaguuuugagaugaugagacacaauucauuuuauuaauugaggacugaugauuugaaagacauacuggggagacucccccaaaaaagggugcucuuugcccucuagaagcucauagguuagugggagauauagucaaguuuauaaacauuguagaaaaagguauacuuugaaaauguuagaacuaccaauaaaaugaaaugaacagauugaagacagacagagauaucuugaggagcuaaaagaaguacuuugaccuggaccuaaaaagauggauaggaagaacguacaucaguuggauucacucuucauuuauuuauuuaacgaaaauguauugagcaccuguucuauuguauguaccauguuggacaccagacaugaugguaagaaaucacauuccuuaucagagcaccuguucuauuguauguaccauguuggacaccagacaugaugguaagaaaucacauuccuuaucagagcaccuguucuauuguauguaccauguuggacaccagacaugaugguaagaaaucacauuccuuauaaaaacuggcaaguacacagucuuuguagcuggcaugugaucccauguagagggaucaaagggguaaggaugggggaccuuaguggaagauaagaugcuaaugauaaacuacauggcgaaggagugagagcccuagguugcuuuucucuaaauaauggggaucuuuaaauguuuggggagaggugagaucuucauuuuagaucuauauugaauacauuguaaaucuauguuuuuagaaaggugacaaaauacucaaguugaaguauuuguuuauagauauauuagacacugagauacauuuuauaugcucauccaaauguuggugucagccagucacaggaggugugggauugcugaguuugaguuugaggaaaggauggauuucugaaauggaacgaucauaaccaauauuuauugaguacuuaauguuauccaaucacugaauuaauuccuuuaguccucaccccagccugcuagguggaugucauuauuauaugcuuauacagaugaagacauugcauugaggagagucuaaucaaccugcccaaggucacauggcuaguuagugucauaggcaggauuugaacccagaccagcaggcuccacuaccuccagacuaccaaggcaguaaagacagaaaggcuuaggauaauuaauaucaaaggacuugaagguuauuuuagcaaaauuaaugcugaugagaaccgagcagauugugcaaaugucaaggccaagagguuuguggagugaggaauacaccuucuaaaggaggcagucacaggcaccucagcuaugucuugccaugugagaaaaugaaccuaguaauaugagacauuauaacugucaacaaaaccuagaaaguauagauuuuuaugucaaaucacccacuucuuuucuuuucaaggagacagucucacucugucacccaggcuggagugcaguggcaugaugucagcucacugcagccuuugccuucuggguucaagcgauuguccugccucagccucccaaguagcugggacuacaggaauaugccaccacguccagcuauuuuuuuuuccuuuuucuuuuuuuuugagauggagucucgcucugucacacaggcuggagugcaguggcaagaucucggcucgcugcaagcuccgccucccaaguucacgccauucuccugccucagccucucuggcagcugggacuacaggcgcccgccaccacguccggcuaauuuuuuuuguauuuuuuuuaguagagauggguuuucaccguguuagccaggaugaucucgaucuccugacgucgugauccacccgccccagucucccaaagugcugggauuaccggcgugagccaccgcgccuggccuuuuuuuuuuaguagagacaggguuucaccauguuggucaggcuggucucaaacuccugacuucaaaugauccgcccgccucagcaucccaaagugcuggaauuacaggcgugagccccugcgcccagucaaaucacccaauuuuuaaauguugauaacuuaaauucucauuuugcacuaugcuguguaaccccuuccuucccccaaacacacacaugcacacacacauacacacacacacacacacacacacacacacgcaccauacuuggaugcuugcuacccagauauggaccucuguucgccagcaagaagaaaguauguauguacauuauauauguauuagugcagcccccuauuuauugccauagacagaauuagagaauuuuccaaaguaguaucaaccucacugcaguuuccaauuuuaggugacaauucaugcuuaccuuucuuccauauuccugcaagcaaaaauagaaaauuaaauguauuuuuuccuucagaaaaucaguggguaaaaguguuuguuguggcccacacugugucauguacuuagagaaguuggcuguuucuauaauaccagcgaaucuauauaugacauucaaaguccauucuccaaggacuccuaaauaucuacaugcacuacaucauguagacuaaauaaugaacuuuacaacaauaauuuuuacucaguuuuacccagaaaagcuaaaguaucagggauccaacauucuuaagcuuugugaaccauggugagaaaccccuguauuugugaagaaguuuuguaauaauaaaaaacuauaaaguuaugcuggugcuucaaagggaauaacaucaaaaacuuguggagaaaagccagaggcuaccaucccaccuccaaccugcacacacacacacacacacacacacacucucucucucucucucucucucucucucucucacucucaauugggagaccuaucaugguagaauaaagucugguucaccaaaaaagagggauaaugaggccauuuuucauuauuuucccaguggauucuaaaauaguuaccucauaaaauaaauaguuuaaguuuccacauuacuuuuugccuuuaaucugugccugcgaugcaaauaaaugaguggagauuuuuauacucccaaagguuuauguagaggcaaauauauuacaaaaugaacaccuaaacuaagcaugauuucuuacuaaaacagcaucuuacagaaugcugugguugacggaagggagacacuuuaggaaaaggaaucuacaaaaagauuuaauuuuauacucauuguucaaguauaugcuacucuucccgaucuugucuucucuagauuaaauuuaaauggaaaacuuucagaacugaacugagccuagccaaguacagaaauauguauuucguaugugagcuccuauggaaaggaugcaccaaaacuguuuuugaugugaguagaguaagguguuaagagcgccguaaguuuuauaaaauuaaaaacccaugugcuaaaacuagaaauaguuuauuguccuuguuuaagaggcaacugaauuaaccuaguuaucuggcuaauaaacauaaauaguccaccuuagugaagcucuaauuacagccucugaaccuuucgguguauuuacaacuuaaaacaucugagugauucugccuuuugaaagcuaugugaaguuagaaaggcggccuaauuaaaacaaaucuugaauaaaccacuucauggagauagaaguuugaugguuggauauaucaaaaauuguuaccagauguuguucagaggccuuaacaguuuaaagaucaugagguuuuuuuuuagcaaagcaaaaauauucuaauugaaguugucagcaggagugagacuaauaugccuguauuugauuaaauaauaguuuauuuaacauucaguguggcccaaaauuggccaaaagucggaaaacauuuuagccagcagacuucaaaagaaaaacgcaacaaaaugacaguacuaucuagguaacuuucaggcauugugguuugauaaugucaguuuucauccugcuucccauucuucaugucuuacuguauauacucugcaaaugccuuugaaucuuuauucuguaauguauuuuguauuuuauaaaaagaaaggagagcaacacaaacuuauuauaagacuuauugcugaaaccuuggcaaggaaacaccaggacauuuuccauuauagaaauguaaacaucuauauuuuuaggaguuagauauuuuacagaggcugcuguccuuucacugggacaugaggauauuagcuguaucaaaaagaagaauguaagacccacaugguccuguuacaacuuacaggcaccuuuuccugaugacaugagaggagcacauaacuacuuccuucccauucaguguacagcugugugcugcucucagaugaaaugcaagaauucccuuugaagaacagggaggcuugucucagccagucggucuuccuauuggcgugagccucucucuccuuacauuuucuacuucucaggcaugcaccuagccauuaacucccgaaugauguggcaauaccuugguucuuccagaauaaguuuuucagacuuuucuuggacuugguguacguaaaaauuuaagaaaucgcccacauagaugacuaggaaauaaaugcauuuuaaaaaaugaauuuucaucauugugaccaauucccaagcuagcguuugcuuuccguaguacacagaggucuggauuuuuaaacuaaauugcagcaaacucuguggcaauuaugagaggacaacugcacuagagggccauuaaucauuuaaacauucaaauaaaacucaauguuucuuuuuagaucuaaagugcagcccauaacacaauugaaauaacauuaauagaagaagggaaugaaaagacagaaaacagcuguugcugucucugcaaugugccaugggcucuaaucagagagugagacacuguauacaguaaaggagaggauucuuguugauucaauucauuuucuaccauccugagcuuucucgguuuaaaggaaguuagggugauguucuugcaugucauaacacugcauuucuggauauucagcagaagggacaaacggcuggaagguuuaguuuuacagcuguuccagaacaguauuuaaaaguugcuuguuagcugcaaagugcuaauaauaauguaaacaggguacaaaauguccccuguggcuaaugaggaaaaacugugcucuuuaaauguaacuuuuucacuauuaaaauaaauuuuaguuuuaccagugauuuacuuuaaaaauaaacuuuguaaaaaccugaagaacauuacauaguuaaccacauuuguccuagaggauaguauggaaaauaacuuacagccugguugaaaaacuaaugacuucauaaugacuuugcuuuauuugucucugccauguccacuagcucaaugucuguccauguaauccucuuuuaaaucccuugacuuuguaacaugauuuuuacuuccaugucaguuucacaagcucuaacuguuauccuuuuagcaucacuguaaacgacagugcagagaucauaccgccccuuuucuaaagcagguguaaauaaaugaaagaaagaaucaauuagcuuguucuagucaaaaaauagucccagguaggaccacacuagaguguaggucucuaaacucccagccccacugcacuucucacugugcuaugccaggaagugaaaaucacagcaaaucacuaucuuguaagaauuaccgccacuaccccaugucccagggauagaacaggugaguagacuccacacugguuuauagaaaaaugcaugacugaagccagcaagguccucgucaucuaugauccucaggugcuuuauuuucgcagccuagcaaaaggaauaaaucuaaugcuugcuuuacugugaauuuacaauuuuccuuagaauuucaguguauagugacuggaacuuaggcagucuguaaaugauaaauggaaaaagaaugaaacaaagcagaaaaggggaauggaacaagggagggagagggagaaggaaggcaggaggggcagggagagggagggaggcagaaaauguaaaucucaaagccgaugagguuacuauagaccaucuggagaaagaugaauuauucuuuaaauccuagaucuagaagagauauuagagaucauuuguuguuuaugcucucugauuucccccucccuguaucuaaauauauaaagaaagaaggaggaaacuagguuacugaacaccaaccaugugacuggcagagguagaggcauucuaugugcuucauauucaugacccuucaucaugauugaccaguugcucuucuuuuauuuuccucugaagcagaaccuagaaaaugacuuuauuagagcaccuaucaggucuuugcuuauguggcuucccugauaauugcugagcaacuugagaccuugggucaugucuuuuaccauugugugccuaguuaugccuuuuacagguagagcauccaacauggugcugggcccagggcagauacucaaugaauggcauuuaaaaugaaugaaagaauacaugaauuacagguaaauaucacaggguugucucauuuagugugccauggccuugaugcuuaugcaguccugugccuauaaaacuauaugguacuagguuuacaugcuuuagggaguaagugaaccuugcaguuuccuauuuuuuuaaauuugacucuuguguauguguugaugguauugacuugcuuucauuuaaauguagaaaaaaaaugccauguuuugguauuuuagccuuaauaaccucauaaaacacauaugagauucgcuugcuagauuauaagaugccuuugguuuauagaggaaaauaaaacuccuggcuuuucuuuucuggagaaagaauauagaaaguagucucacgaucucuaugacuccgaccuguaucccagacaaaccaaaacaggaguacaccaacuccuuaaggaugugaagacagcaagaguugacauuaauaguaaauuuaauauuuacaauaaauaugagauagggcuagacauaguacuggaaaugguaccuuuccccugcccccccaauccuauuuagcuacuucauauaaaagauggcaaaaacuuccuucuuguucguguagacauucagccuuucuagaagacaaggaugacacuuuugucaauuauuuauuuuuugacguaugugccaaugggaacaauuauuagccuauuaaauacuuuuugauauuugacccaggauaguaaauacaugcauucagaaaagaauccaaugcuaccuuugucaucauugugacaacugaagagcucuaguggccuuucaaguacagauaaacuuucaggaggauucuccuaugagcuggccacaagggcuuuuauugugaaccuuccagcauauccuguaugcucauugugaacuaaggaaauggcagugauggcaucucaaauaguggaccauggcacccgucauggggguaucccugcuuuuugugcccauuaaagguuugccaaguucuucuaaacagacucuucagcaguauagugaccauuauacuacuuccucauaguguggcuuuuguaaaaaacuaaaagaaaauguccuggauugauuuugucaaaacaguuacaugagaaguguagauaaugauggacucuuucaaggauuauucaaaccaaaguaaauacuagauggcacggauggacuacucaaauguggucagcaguacuauccaaugcucuacuuauaaaagacuccucuuuuggacagauaacuuguagaagacugaaaagaaauauguauacgucuguaucuaugaaauguauugacuuuuuuuuuauuuuuuacugcuuuacuucugguaccauuccuuuauuuugucuuaagaaucuacacuccuucauuuuuaguucaucuaguucaggugaagcugauuuugcccuagauucaaagccaaauugugugccuuacauucuuguuacucaaacugggagcuuacuagacaugccagaucugagauccuaucccagaucaauaaauaaaaaucugcauuuugacaagaucccaggguaauuuguaacacagaugagaguuugagaaacuuagccaagugcagugguacacgcccauaguccagcuacucaggaagcugaggcaggaggaucucuugagaccaggaguucaaggcuagccugggcagcacagaagacuccugucucuaaaacaauaauaauaaguuuuagaaacugcuguacaccagagccagugugggaauucuauucaccuggccaugguggggcagggacaugacccaaguuugcccaacaagacccuauuugaggacauugguuugaccucucaagaaagugcacuuaguauuuuccacgugacuuguuuaaaagagcauaaaauacuagauauguggccauuuuaccauccgggccugucugacugagacuggggucuguguagaggaagcauacuccagaggaagaaaaauggugcucucaggguaucacuugaaucccggccaaaauaugccuaaagucagaguuuuucccagauuuucaguugcaugagucagaagauuuccuucauagucauacaaugugaguuguauuuucugccacacacaacugaagaaaaauaaaagauagaguuaugaguaaugauuaaaggcuuauuugagucucaccaccuauuugcaugggcuccuuagcugaaugugugugugugugugugugugugugugugugugugugugugugugauuucucauuuguuguagcauuuagaaguauaagaaucaaaaaaaauccuaguaucgagacaugucugcuuucuugcaucguucucuuaauugcuucauguauauuuaccuuacuuccccucaaaauuauaaacacuucaaaggcacuggacuuuucuuccaugaggcgauaauuuaaaguaauaagacguuuauaaauaaacauaccagaacuuauaucaagugaguguagauuuucaaaaccaccaccugaggaagcugcuaauuuauucugguuuugcugacuuuggaaagaacauuguaguaacucucuagaauaaugaucagcacuaguuucuaagcccugagaucacaccagugcuuuguuaguuacaucugauuuuuacuuaaagugacacuacagggaaucaauugaacccagucagaucacuucaauucccaugaaccagcccaccgugaguccccuauggauccugccagccccgaguaccccaccucuucccugaggaccucgugggaacugcugccauccagcaguaaagggauagcaugugccucauggggagucuuuagaauccucuuccuucacugcagccagcacugguucugauuucgaucagucacucaugccauauuaaugguuauguauuucauuaucacccuugggugcuaccaagguuguucugccaccuuauucaucaacauuacucugauuaaguuugccucuuuccagaaaugcgauugacauccaggaaaguagaucuucuauuacugugagaacuucaguagcuagcuagauagauaggucaauaaauugauugauggagaauauaauaacuauuuugaauauaaaccacugagaagcuuuagaaguagaaacauaaguauaaacucggaggccuugucaucuuuguuuaauagaaacugauuagcacuuguauuaaaugcuguuaauagaucaauaauuuauaauaaauaaguaaauaagagcacauuucuuauguucuucgauguguuauagugaugaaagguuuuggauuuugugggaagcagacucuuuuccuaagagagaagaggaggcagaguuuauaaguaagguaguaaaucccuaaaggauaaaacucuuccuuauugauuaaauaucaggcauuuggguuauaaguuuauuccuuuccugucugcuaccuuuaaaagccaagaacauuucgacagguuauaagcauucaaagaaauagaggggcagagaaugcuaugcauuuguugcuacggaaaaucuaaaucaacuuagaaggcagcuaaaagaaaccaauguuuauggcuaggaccaaaaugcauuuuaacuguaauuccaagggcgaaucacaccaauauugccaaguuaaaaaugacuauuucucuaauaaaaggaauuccaaucauuuaaaccaugaacucaauuauauuuucugaauauugauuuuaaucaauuuuaugaaccuuaagugauaaagguaacuuuuuauaaaauguaaggauauugcuguuguuacaguaauuugguaugaaugaugcuguuagacuauuaaaguaaaaccucuuugcuaauauucagggauuauguuacaauaacauauugcauagcacaauaaaguuaauagcauggaucaacuuccagaagucucucuguuuuaaaugaauauuguuuucagaauguauuuguuuugaaauaugaauuucagaucuauaaauauaaggccaaguauuuuaauaauuguuauuauaucucagacuaccaauagauguuacauucuacguaaaauauuugucuaacuuuuguauuaagucaaaccauuuguaaucaccuauguaaaauacauguuuauguauauacauacacaccaagguagucugaauggauauccugggcuaauuaucaugcagcguauggccuuuugcauauucacuuauuaacagcaguagaaagcuuagugugauacaauaaucauuuuuaaauaauccuaaaucuacucaggugaaaagauucugacagcaggcgcuuuaaacagcugcccugagcaaaauagacacugcuuucuuuuaaaguugaaaaggagaaagguaacaauuaucccagagacacuggaaacaaaguugucugauuuuuccccggcaaaugccuccaccucuuguaaaaagaacaguguauuugagauguuggaaaaugguggacccaucagaagcagucaucagauaaacagauaauuaauguauuaagaguguaauugaaauuaacaauggcuuucauauguacguuuaguacugugcuacaauuuauuacuugucugaaguacuuucuugcauuauaagucaagaagccuuguggagccaaaguaggauaauaacaauuaaacauaacuaccucuacaagauuaaacuugauacugaauugaguagcgguagaaaucaugacuuaaacauuuguuuucucccuuuguacuucauuuauaaauucaguacugcuuuuaccauuaagagagaauucugaauaaaaccauaauucagauuaaaucaaacuaaauauuauuuaguugcaauacuaaauauuaucuauuuaucuaaagauauuuuuaggauauauuaaaauucccaauaugccugcaaguuuuuguguucuguaagaaacuuagagaauuuuucccuugaaauugacuaucuuaauccugauuuauguuuuuuuucaaaaguaaaaaccuggaaagggccuuacuaacaggccgaacauuuugcaguuuccaauggguaaauaauggcauccacucugugauugggaguuuaaaaaucagaacauucaaauauucugaucccgauugcuuucccauuugaauaaucguaccucuuuauauuaacaaacuuuauggugauauuuucaaauucuuucuauaucacuucuuaacuggccacaaauguuuguaauacuugagugucuucucugaguuucaaaaugacuugcucagauaggaacucacauuauuuuuccauuucugauuccucccuucccccacuuuuaccaaagaauacacaugcguuaguaaauucagccuauuuucaucauuaagaaaaaaaaaaagucaaguucaagaaagaauagcacagcuguucacaaugucauaucuuauaaaacaaaucuauuaggaaggucaaauccugaaagaggucaaguuaaugagauaaguggaguaauuuggucauuuucugaaauuuguaaacuuacacaaaucuauuuuuuuauccugcacuacauuuuuauccugcacuagauugacuaacuaaaccucugcuaauggugauuuucuacuucuuuaaaaguuauuacuuuuauauagcaggcacacuuuucuguaccuaaauguuuuuaaugugaauugaguucaauguuaguuugauacuaaucaguccauucuguuuauuuuugaauuacugcuuucauuuggaaugcauuuaaaaaauaaauuuaaaaaaauacaaauaugaauaaaaauuauaugucuguauucacacacacauuugguguauguguguauaucuacacaaguuaauuaaauaaaauuguggacuuuuaaauaaaauuauagauaaaauaaauuguaaacaauugguggaaagaggauggccuauguaaaaucuagccaccuuacauuucuuucaaagaguacaaacauuuugaagcacguaguaacugcacguguuuuaaaauuaugcauaaauaaauucuucguuuaauccuacugcuggguccuugaagugucauugauuuacugauucugccauuauauuuuuauauuuauuuuauuuacagaaaaaauuaucuaagucagauauaacuccuuaucuugggagagaaguaugacuuccauuuuuuucaaguugacauuuuaaaagauaagagcauuagccucugaauuuuuuaaauauauuaaacuagaggaccuugaagcuacuuuuuuugaaaagcuaaggaauauauguguauaugccuauacauauuauaaauguauguuuguguguguauuaacuauaaaugcaugcauauauauuuauaaaguagccaauguuagucaaauuccaaauggaauaaaauuuauggauauaaaugugcagcuaccacccaaaauuugcucaaaauuagcaaaguuucuaugucugggucuguauaaacccaagugagucaacuuuauuuauaaucuaggaaucaaauaucuauuuuuauauuuugugcguguaaucuauguggcuacacuauaugaaagaagaaagcuaccugcagcuagaaauaaguaauaaaacaugcaugagggaaugugaucuacaauguguuccuuuauguucuagaaaggacccugauuuccuuccucaaauuucaacuuaguuugugugugagaaauauguaucuuuaaaauggaggaagucaccaccagaguuauguaauguaauccuuaaagaucuuuuagaaugcagucaaaaggagagaauaggaaagaaagagaggagagauguauucauauauuuuuaaaugugucauugauguaauaaacucuuuaaaagacaguuucuuauauaagggaguuuuagggucaccauuaauacauuuucucauguuguaaaaauaaauaugaggcgcuuuguauaaguuuugugcauaugcacauuaacauagauauugaguuauacacuuguauauaagugccaaaaguguauucaguuuucaauaucuuuaaaaucuaaugucuauugaauuauucaaucucuucugaaauuaagagagaaagaaaaaauuuaaugaucucugaaugccucauauaugucaaacaugacauuccauagucucacauacaucauuauguuuauguuaacugaguauguaugugaauugagagaacuccaacauaguaauaaaaauaaguuggcaauaaaaauuaaucauaaguuaucagugucuuauuuuccuccuacuaaaguaaauaauuauaaggcugacauuuacagcauucuccuagguacucuauugcuucauuuuuuuuucaguuuuuuaauauaaaauuaacauauaaccaauuauauuuauucuccacuauguaagaaacucauggaauuucuugacaacauuguugguguuuuaaucccacuuauaaaauaugauauugcuuuaaugaaaauaaagacaacuagugaugucucacuacaugguagugcugaaaaugauuccauucauuuacgugaguguauguauguauauauguuuguauguacauguauauacauaaccaacguaugccauuucuacacauuuugcaaauugcucauuagcucagacaagcagggacuguuccuuuccucuccucuccugggccuaaacauggcccagaauuuauuaauuuucuuuugcauuucacaaaagugaaacuguuuucaaucuaaguucuaguuucuguaacaauggcuguccuucauauuucaugaauaaagguaugcuuaaagcauaaugcuuguauguguacacacacacacacacacacacuccaaaguggcaguagcaucucuucugcuagaggucaauucaauuaagcuaucacuaauuaaaugcccacuauaugcaaagcacugauaauauaaagauuaaaggaaaaaguagguccuucuucaagagccuccuuuccccugugugacuugcacaugaaaauaauuggaauccagcagucugucuccuauaccuauacagagaaaguaggacuauuuugugauuuaagacaauucaagauaugaaaagccgaggcaaaacuaacauucgaaugcuccaacaguuaaguuuguaccuugucacaaaguuccucuuaugaugaagaguaguuuugauacauuugggguaaauuuguaaaugugaaauagcaaaggguaagucacaacuaagcauuuuuguuugcuuuucauuuuuuguauguguuuuaaauuucagcuacacuaugaauccuuuuucaaaauaucuuuaagagcuugguaauuuuuuucuuuuccuuuaaaaaaucuauauuacuucacaauagggagaaaugacauuucuuuaacacagaucacuuuaaaaaauaauuguggguaauuucuugcuauaauuuauuuacgucuuuugccgagauugugugaccaauucaguguguucaucuagaggaaaaauaaugccaacagaaaaagaauauaaacauaaggcaggggaaaauaaaguuguugaaaaguuaguguuauauuuucagagcccuucucaugaaauaaaaucucacucaccaggaguuuugugucucaaguugggcugccaggucucgguuuugguuuccugauauucugcucgauguacaaaaugucaaagugagaaacagcuuuaacuguuccuuuugguacggaugacugaggggcacucuccagaaugcuugaugcgaugagguaguucuuacuuugguaugcgauauagugugauuaauaaacuccagaucacagagagagccgggugcgaguaaggcucguaugagugcaguuuccuacccaagacaauguauuaccuugagcuaaucuggugguacugaagagagaauuuuuacguauguauacauaacaaagacaaucacugcuuucuucuugagcagcugcagccagucccacuaauggacgugcaaaagcaaaaacuggcagcauaagguauguguucguuuuuacagaugguacugcagacaaguugguaauugaaaaggaagucguguacgugagcuauuugacggggcagggaguagggacagccuauuauaggacuuuccuguguaauugacugggugaguuauugaagagguaguuuucccgugaaagauuucaguuauuacaaaauuacaucauuauuguuaaggaaauucauaauuccacuucgucuuuuaaaaaucauguuauuaaaacuuuagaaaucagcucaguuucccugccugcacaguaccucuaucaugaaauuaucugcucauggucgguuucaccaauaguggucacagagcucuuauuuaaagacaaaucuuucauuugaauaaugacauaacauuaagugcuuguuuuaaucauuggaaagguguccguaaauaccuaugauuuuacccguccugaggacauacaaaauugaauuaaaugagagagaauauuuuuaaugauuuauagugucaaaaauaaaugaaauucagguucauuuuuuuuuagucucccacugccccauuccccguguuucuaaaagucagacagaauugcguggucccagagguauucccgagauagucugugaaguauuuaauccaaauugcauauuuggugucaggcucuuuuuguggacacauucauaguuugucauuaacucuuuuaacuguuuugaaccucuguauauuuaacucauguauucccguauguuuuuguuguuuacauuaaaauaagcagugguugccaucuuucugcugagcagacucaaggcugcguuuuaacaucugacuuguacugaauacucucaauuggauagccuauaaaaaauguuuagaguuaggaguauuuuugucauuacucuucugugaugaaaugcaaaaguauaucacauaugagaaguauaauaguaagcuucauagauagaugaagaacaugaaguuuuauauauaauagugggggaguuuuuaagcagacauuauuuaaaauauuuuuauauuaucugauucuugaggaauuugguaaaauaaccucaccuuucagaacugccaguaauuuaucuugaauaaaaaugauaccaaauaucacaaaaggucucugccuuggaacauacacauauauaaaagaaaucuaguaaauuguuaccugaacauguguguuuacagagcaugucaaaaccccagcaccauuuuucuugccccaacucuagccaagucuucugcaaaagcaaagagagacuuucauucacagcuaaccucccauguagcaggcgcuaugagaggcuaagucaguggugucaccaacuucugcuuuuaagcagcggccuguuucacauacuuuuuuuauuuuuuuugacacagcaggaucaaaacacauguacugcaccccuccccccuccccagcacugcccccuccaucagccaagugcucuguuccucuggcuaugacugugucugucgaccucaaaacagcucguugccauaucugaugaaggaugacucauuucuuucugguaccucaaaacuugcauaauuucaaucagcuguuauugggugguuugaagagauaagcguucuuuaaggccaggauaugguguaauauuuuugguaaaaauuccccaaucuccucuuuaguaauaaggccugaaacaugguucacuguggcuuugaagugagggcaaccuggguuuauaucuuagcccuacuauucagcaguugcaaauugcuucuaagccucaguuuucucaucuauaaaguggagggaauaauaauaauaaugauaauaauacuugccucuuaggaucauucugaggauaucagauaaugagacuaggccuaucauauguuauccugcaaacauaugugcaaugaugauuauuuaaaaagggacaaagauagucaaacaagaguauucuauuaaauaguugauucaaaaauucuuuuuuauuuaauuaauuuucuauuuaucuauuuuagagacagugucucgcucuguugcccaggcuggaguacagugacaugauuauagcucacuacagucuagaaccccugggcucaaaccauccucucuccucagccuccagaguagcucagauuauagaugcauaccaccacacccaacuaauuuuuuuuuuaacuuuuuguagagacacguucuugcuguguuugccuugguugaucucaagcuccuagccucaagcaauccucccaccuugaccucccaaagcacugggauuacaggcaugagcuaccacgccuggccaaaaaugcuuuuuagaauaugauccugucauauugccuagacuuagagaccagaauguguucuuugaugcuagauaagucaaagaacuauugucaguuuuguacuucaucaauaaaaggagaguaauaguaauuaguaauucaccguaaaucugaacugggauaauauguguuaggaguucuuaaccuugggaucuggaucagucggcacucaaauccacaggaaaucuuuggauacauuuugugagggacaugcuuuugaccauguuaaaguuauuuguaaauauuuuacacuuuauuuuuuucuggagagugucauacauuucaccaaaagauuguaugauccccaagagugugagaaaccaucgaggaaccacugaauuguauauagcugccucgaggguggcaacacuucauaaaccaguuauuauguuagauacuaugaaaagaauuauugauuuuuuuucuguuuuuucccaaaauaaccauuauauauuauaaaggcagcccuaaaaagguguaauacaugaaauauuaauaacuguaucugacucucuaauuaaaugccuagaagcugagacuuuuggcuuuuaggacuuuucuagaaaggucuucaucgcugauauuuuuauuuuuagaauaugaaccuaucccagaauaaaucugcuuauuaaauauauuauauaaauaaaauaugcaacaaauuuauuagaagaaucaacucuugugcugucacacugaaguuuaagaggugcuaaaauuguuuaacugugccuccaaaaggccuuuuaguauuuuuuuccuuccagugucagauuuuggcacuggcauagaagaaaguccccauagagcuacuuuccagccauuguuguagcugaaggaagggugaaaacacauacaggauggcaaaaauagaagcucugagagacuugaguaguucuuuuaacaauaaugacuuucacguggaaugaaaaaaaagacagugcagacauaaauuuucaaccauauuuuuagcuguccaaaugcauauuugcuguaaaggcagaacauuauuacagaaacagcgugguuagaacuccagaaaucuggguuuuuccaauucugauucuauuauguaauuucauuaugacacaggguguuugguuugcuccuuuaccaaauacaggguuagcuaccaaauaugggguuaguuaaagaagggagaugggguccucagaucuguguaauagguuuuauaucugugugauaaauuucuaaaaccuugagauguaaagaaucuguaugaauaaagagugggauauacauggggaaauagugauuuucugcucuuucacucugagaaucaccaguuacaucucagaagagauggagcuaauguguuuagcacagcagcauuaccugauauaucggguagcucccuauguggcgacauugucagugggauaagucuuaggugcauucauaucucagugcaagguaugauuacuggaguauguauugccucauguccuggaacaaaaacuguucuauugcucuuagccagagaugccaguuuaguuuacacuggucuccauuaucauugcugauguguugaggaagugaauuuaauaagcaggguaaacagguuuuguuuccaagcucuauggugauuauaagaugggugcuuggcugaaccugauagagucccuucaguuuuuuggcaagaaaucugagggcaaagaggacuguuuuaaagcaggcaaagacaugcaguacagcccauuucaacggauucuucacaauuuuauuugaaacaaaaguuggccaggauauugguaaacuauugcuuucuguuggcagagugcuuucccuggucuuguucaauuguuggccagccugugcuccugguaagagucuggcuauuaaucuaaagguguuuauugcaaaccaccaucuauuuuuaaguuguuuuagcuccugaauucaguauauuccauagggucuacugguguguagucaacagcugguuaauucuauuuuggaggggaagaggggagggacauggccuucgaugucuccuaguggcgcaugauagagauaagaauaaaauaauauucaacacuuauugaauuauggaauaucaacaauuauugaauaucaacuacauaucugacagucaugaacacauuaagucaugucaacucuauugguaauuaauagaacaaugugauugauaggacauuauuacuaaugugaaaauaagcaaguauuaauuuguuucugaagugacuuaaacuguuacacguuuuuacaaaggagcacaggaaguaaccccucugauuauuagguaacuuuuagccucuaaaugagauuuaugaaugggcaauacuuugguaucuucaggaaaguuuccacguaauucacaugauuucagcugucaauguucaugaacaauuucuguuuguguugcuuuagcuccauaauuaguauguuuuuagaagauuccacuggaaaaucugcaagauuacagaccauguuugucucacgcugugacccuggcuuguagcacagugccaggcacaugguggacacgcaauaauuacucccagaacuuaauugacuuaauuuaccacugaaauuguauuacugugaaaucguaccagaagcuuugcucauaaccaucuaugcauuucgcuuacaugaauguugcaaagacuuuuugauauaaucagauaaacacagaaaauauuuaaagaguugaaaauauuugagguauauucauacuaacauuauauaaaucagauuucagauugauucgauuuaaaauggcuaagauauaaaaccauaaaaaaugugaguaaauauucugccuaucagggcuuguuauguaauuacaugguuucaguaugguucuuauucauagaaaauuauuguaaaagaucauuucuucacaaauuccuucaccaauggaaaccuuuaauaucuugaagaugaauauccaugucuguaaauguuaagccacuuuaauaaaucauucaaucaaauuuacuucauauuaaucagaugaaaucaguuccuuuucaaaauuuggagauuuggaaaccuuaaaauuuuuauauuuggcuggucuucaaauaauaaaauaaaauaaggaauaaaaacagccgacccaauuuaaaauuuaaaaaaaaaugucuuaagucauaucuggguuuccuaacauguaugccaaggcucagcuauuuaucaauguuauauagcugacugaagauuuaagucucccaaaagcaaaacuuaaauuggaaacuuagagaaaauuucaacuauuguuacccgcauguugguguuagccgugaaccuaaagacaaaagguguuguguuuuguuuguuuguuuguuuguuuuaaauacuuagucauuauacuuauugguuuacucuaaaggggaggaaaaaauuacacuggauuuaaaggguauucauauuaaaaguuagguaugucauuuucuauaucuauuuggaugauuguucagauccaucaccuacauugcugcugugaaaaucaguauuguggcuauaauauuugaaauaccgaaagggaucaagugcucaaaagacaggccaguuaucacugaaaagcauuugccaggcaaucacuggcuucgaaacuccuugcaguuaacuguuuguaccauuauucauccuuuuucacauaggaaauuaccagccaacggaaauggccuggagacaacacaaaugcaaccuaaauuguacugcucaaagcauuaaaagaaaagcaaacaaucauuuucucgaauuguugauuccagaauuuuuucuguagcaauuuuuaguugagcugccucauguagcuuuggguuuucagccaauccuccuucacucuugcccucuguucaaaccacguagauguggaaggugaacuuagagaaguucaggggcagagauugcagcuacucuuugcggcuuuacaugugugagugagcagucuucccucagucugagaggagagaaaguuuugugcuauauaugccccucaggaaugccaauugguguuaucggcuagcuacuuauuccuauccuuuuucccucccagcacugaucuuauccauaugacccauaauucuucccucucaggcacgaggugauggagguacaaauuauugucucuuaagacagcuugugggaaaaggagaaauuuauuauuuaaacauaaacagacacagauagaaccaucagcaauuugugacuguaauguuaaagauaaaagagagcugcccccagcacuuagcaaguaccuggcaucagcuccuucucaaaaauacauguggggcugggugcgguggcucacaccuguaaucccagcacuuugggaggcagaggccgguggaucaccugaggucaggaguuggagaccaggcuggucaacguggugaaacccgaccccacuaaaaauacaagaauuagccaggcaugguggcgggcgucuguaaucccagcuacucuggaagcugagacaagagaaucacuugaacccgggaggcggagguggcagugggccgagaucgcgccacugcccuccagccugggcaacagagcaacgcuccaucucaaaaaaaaaaaaaaaguguggaaaguaggaguggacaaugaauuuucuugaaugugucuucuauaucaucaaccaucucugcccaacuccagauuaauuugucagccugaauggacgacauuuaaaagggauuuuaagaaaacaaacacuacuuuuuuuccuaaaauauuuuuuuuuucuaaaaauaacgauagaaauagcaggcaggauuauuuucaacuuucuuaauguuuagccuaacagagcacuguccuaggugcuuauuccuuagaauguucagugacgauuaggaaacaggauuucuguccuuaauaggcuuacugcaaaggagagugacaaaguauuuuaaaacugccaugcaggauaaaguaugaaugaaauaagaucguuagugcuuuucuuuuucuuuaaguuaaagccaagcuuuguuuuugaaaauagggcacaggaggcuucuacucugcguuccuuugguaacaggcugcuucccuguccuugauugggcuaaggauguugauaacuucaaaggaaaucccuuacuguguccugccagguuacauuguacacagugugaccaggucagggcucgcaucuguaugguguuuuagaaagaugugguucuguagugacacagcucaggacacuacccacuucucccaccuucucugcuacuuccagaaauuuuaauugcaccaaaaauaagguucgacuaggcuuaccaaaguacuaaauuuguuuagaugggagguaacuucaugugugaaagaauuucucaccuaccucccacucuccacccccaugcaagcuugcuccuauugaauucuaggugcgaacaccuagauauuucacucugacucaacuuuccauucucauauuugauaagauugguaugaaagaaacacauugaacaauauccaaccauaugcuuuaagcaucucucaaauauucaauaacaagauucaagggcugaaaacuaacaaaauauuuuucucauacaaaagaaaucacaguugaauccucuuggcaaauaggauuugagcacuuacuacaucccuggcaccguuuuaauugcaucuauuaaucuacauaagaaucacaguagcggggcaugguggcuuaugccuguaaucccagcacuuugggaggccgaggcgggcagaucacuugagauugggaguuugagaccagccugaccaacacagagaaaccccaucucuacuaaaaaauagaaaauuagccggucaugguggcgcaugccuguaaucccagcuacucgggaggcugaggcaggagaauugcuugaacccgggagguggagguugcagugagccaagaucgugugccauugcacuccagccugggugagugagacucugucucaaaaaaaaaaaaaaaagaaucacaguagcucacacuguaaagaucagagaacuuuaagcauugaaagauuaagugacuugcccaguguuguaccuggcaaaugacagagacagguuuugaauaucaguguucuggcaccuaaaucugauuauuaaccuccaagcucuacugacucugaauaaguguauucaaaguacuccugauauauuuaaaaugugauaugguuuaccuaaaauauagcaaacuauauuggagucuaagugcuccuuuuaaagcaagcuaugcuuuuggaaacuagugcuguaauuucaggauuuucccucuaacuaaugaaaggcauuuucuuugcaagagaauuaagcaccaaauugugcaaggguugaaacacucacugaaaucaggauuacacccacuuuggcauggugugucaagcacccagggcauaaggaaagaacagcaggcuggagugaaugguuacacauucacauuugagccucagccauauauguggguuaauuuccaaauggacauuuacauugcccuuguguggaccaaguugguguuuauuugcaaacauguuauuuagaucuaggaaaaugacaggauagccccaggaaaguuucacaauuauaacuuaacuaggcucccagcuuacuuugcacaaagggaguccccaaaauguuugauaaacacaacuucuaauaguucauugauuuugggggaagcagcaguccacuuuugcaguaggccuucacugggacuugcagacugacacccaacauuugcuauugcaauguuauugagacuuagaaacucaugauacauuccugguccagagucggguggggggaaguagaaaaaggggagccagagauuaucuuuggaaaucuaguuuuuauuacaucaccuaaaguagcacaaccugcuacacuaaugaaaucguguucuugguuuaaaagggcaauuguuagccugacuuugugcucacuaaaaacauucccccaaucuuguuaaguuauugcucucauuucagauuuuuauggcugugcagcuuaccagcccucauuucuuuacguuucauucauuuuccuuguauugaugauuaauggaggaugucgaauguuagagugagcaggcaucagcaauugcaagaucauaauuaguuuagcugacgagagccucugauagcacuugcaucuggauggaaaaauuacccuauagggaacuggcugcucaccaggucuuuuuagugauacauugugaaacacccgaugaaucaaaugcccuuucaaugccaagaaaguguuccagucuugaagccaaaauuaugucugcagaaagcuuuccauuugaaauguaucagaguacaauuauaaccauuguauuuucuuggcagggauaccacucuucuacaguauggacuugaguuaaauaaauugccuaaauuuuaugaaucccugaaauuuugacuuauggcacauguaauauuuaauuuauaauaaaauuagguuccagcaagacuuuuuccacuccuuaucuaacacgcauauuuuaucauuaaaggcuuugcuuccuagagaaaggagagcugaacugcaauucaggcugucuuuuuuuuucuuuuuuuuuuucagcaagagaauuccauuuccugccuguuaguauuugugccuacaaacacagccugacuuuuguuuaagugagaaguuuaauggaaucauuacuugauagcaagaauggaacaagcaauacuaaucaucuaguuuuaaauauucuuagguuauuuuuaaccuguugauuacaaaacucaggccacuagaaucaauuuguauuuggaaacccuugugauuuccaagucuaagucaaauaaaauaaauaaauagccauugaagggucuauguugccuaacuuaagugggcaccucauaaggguucucauuaguaauacuguacuuuuaauuggcugaaguuucuacaaacccucucacguuugaggaauagaggaaucuuucagauuuuacaauugcaaacgaaagaccagaauugagugucuuauauucucguaauacuuacguuacaugaaugacauacaaaaacacacaaaucaaguuuaauuuuaaaugauuuacauuuauuccaaacuugacuauauuuuaaagcucagguagcaugugcuccuccuuuccaaaguguauuaaacauauugccauguucugucuuuuugacguauguuuugacacuuuuaaaagguauauuuuaggguucagcauuuaggagccaucauuaaagccauaaaacccaaaguucaaaaaguuaaagcuguuucugugaaaagccuuugguguuccacacaccucauccaucacuguaggguuaauuauaaugaaaaucaguggugccuauuaaacacaauugaaccugaccucauuaugggcagugugguuuuauacugucauuguugcuaguuuaaagacaaaacuccuggguugauuuggucuaacuccacugaucaugugacucaccucugaccuugguuuuuuuccccuguuucagaggcguagaggcuccgguguuuuuugugccaauugccugaccacaaagaccucucucuggcgaaagaaugcaaauggcggauauguaugcaacgcguguggccucuaccagaagcuucacucgguaagaacuuguuccacucuuucaggaaaagcuuuauaaagcaguguuggccuggucuguggugugauaagucccauucccuggcuugcagugccugcccccgcaggguuguuuuaauacagucacuuugagugcacaugugauuuauggugaagggggcuuagaugugauggggagauagguuugaggucauuaguaaugcauuaugcuucuuuugauauaaaagaggaaaaugauugauuucugggaacuucacagcagauaguugaacuaaugguuaucagaauucaaugaaauuauuuuagguaaaaaggagaaaauuuuuagaaguuucagaaauaugcaaaacguuuuaaaaaaugaaaaaggacucggucauguucaguauaaaauauaagucagggaaagaauucguguuuucuaguuuaccuucggaauucacaaguguuaucuugaccgcuuuaggggcuggaggggcacauucggaaggacaguucugaacugaauuaggaucagagaauaucacaugaaucuccccagggccuucaguggguauuucaaugagguaucugaaguucugaauagcacacacaccaggguagaguaaggugcaaagauacuuugucuuuuaagaucuccagcuggcuuuggcucacggagguucuuugaauuacuuuuccucaaauuuuaguuagaauucuguaauaaaauuaaaacucacaaauccuccaucugaauauggauuugacuuacugaaggauuuuuuuuuuuaguuuagcaaguucaucugcugacaagagcugacuuuaaaauaggcaucccccauuuaguaaacaaaaauuuauuucccugugccuuuuucauuucguuuggcguuuuaccauagcucuuagcacaagccagugaauacauuauggcuacagggaauacacuuuuagacaaaauguucucauauauggaccauuagaagcacucuuuaaaaaaugcaugcugcuaacacuacuaauuggcaguaaacuguaaaaaccuuaguuauuagcauguagcaaguagaaagauuccaccccccaccacauaccaacuuauuuuuuuuaaccuucaccauuuaagcauagcaauaaguuucuauuuaaugggaacugacauuaaugauuuuaauugaagucuggccaaucauagggcaaaaauuaauuaaaauacugcucugccagauuaugggaacuuaaccacugagauauaaacuaaacuauuuucuaaaaauuauuuuaauauucaucucuccagagguaagauguuuucaguuuucagguuuuuuaaaaaaccauacauugaaauacauaaagguuauguucacauuuugugucaaaaacugacacaaaaguuaugacaguuuaaaaaaggaauuuaugcaaauuucagguucuuuacaguguauagauuaaauaaugcauauguuuauaaugcuaauaugaacucuuuguaaaccuggauauucugagcaaaagaaaugcacauggcauaacuaagcuauguugcauuuucuuucuuaaacuaacaaugaauugucaauaacaacuguguuaucuuucuucacuuggaaguauguuuguaacaacagaaauguuccaaaaaggauuuauaguuguacuuauuuaagauacaagagguacucccuuucauucaaguguaucacuucuaggaauaauuuacaaauuacacuuauauuuauguuuuuuuaaauuuauauuauauuuauauuauuauaacauguuuaugaauauuuauguuuauauuuaaaauuuuauaauuuauaaaauuauacauuauauacacauaauguauaauuuauaaaguuaaauuuauaaauuauauuuauagucauguuuuauguggaaauuauuuucugauuucaguaaucuuuuagaaaaaucagacuuuagcccauuuaaagauuacccuaaauuuuuaaccuauaaauacgcauuaauuuaucaaacugauuccuuugauuuuauacaucaaagagcuccaacugcaaguaaaguuuuuauuauagucuuauccauggauuuaagucauauuauauaaauaccuguugaacauguccauaaauaccaaucauguaacguuuaagcuaaacaaaauacuuaagcugaaugaaaguuagcacuuacuuuaaguaaagaguagaaugacagaucagauauuuaaaccaaagcuacacaugaauuuagauuuucaacacaaaacuaaugcuucacuauuaacaaguaaaaucuuagaucacaaauauaaaauauuauuaaugagagagaaguagaaaugagaagaaaaaaaaaaucccucucuauugcuuugaugaccugauaucuuuccucacaauucugucaguuuaucuuugauuauuuaugcucugauauuaauauuuuauauccacauuugcaauuauuuagaagcacgcauguauuuguugcuuagguuuccauaacaaaauaccauaaacugagcagcuuuaaacagccgacauuuauguuuucacauucugaaggcuagaaaucugagaucagguuccagcauaguuggauucugaggagggcugucuuccuuacuaagccaccuucuaucugugcccucacauaguggagagagaucucuuucucuuccucuucucauaaggccacagccccauuggauuagggccccacccuuaacaaccucauuuaacuuuaauuuccuacuaaggacccugucuccagacacagucacacugugguuuagggcuucaacauauaaacuuauucugucuguagcaauguguaauuuuuccacuguuaacaauauguaucuccuguguuacucuuauaugcuggcauuuuagugcacaacucaaaaauugaaaaaaaauuucagaaaaaucacaucucuucaagugacuuucuacaccguuucaucacuaaaugaugcaaucucaaaaucuguugcaucuggaaagguuauuuucaaguagauuaaaguuuucaguccccccugcaaagauggacaugauuuaauuaggcuaaaauagugcacuuugguuacuuccucugauccugcuuagggcaaaaggaggagauuuaguaaaucuacagcagaaagccuaucccugcuuugaacuuaagcaugguuuauauuugugaggaauuuuuaaugcauuuuaauguauuuuuuaauguuuuccuuuuauguauuguauguguucucugcagacucccaggccuuuaaacaucauuaaacaaaacaacggugagcagauuauuaggaggagaacaagaaagcgccuuaacccagaggcacuucaggcugagcagcucaacaaacagcagaggggcagcaaugaggagcaagucaauggaagcccguuagagaggaggucagaagaucaucuaacugaaagucaccagagagaaauuccacuccccagccuaaguaaauacgaagcccaggguucauugacuaaaagccauucugcucagcagccaguccuggucagccaaacucuggauauucacaaaaggaugcaaccuuugcacauucagauaaaaaguccucaggaaaguacuggagauccaggaaauaguucauccguaucugaagggaaaggaaguucugagagaggcaguccuauagaaaaguacaugagaccugcgaaacacccaaauuauucaccaccaggcagcccuauugaaaaguaccaguacccacuuuuuggacuucccuuuguacauaaugacuuccagagugaagcugauuggcugcgguucuggaguaaauauaagcucuccguuccugggaauccgcacuacuugagucacgugccuggccuaccaaauccuugccaaaacuaugugccuuaucccaccuucaaucugccuccucauuuuucagcuguuggaucagacaaugacauuccucuagauuuggcgaucaagcauuccagaccugggccaacugcaaacggugccuccaaggagaaaacgaaggcaccaccaaauguaaaaaaugaaggucccuugaauguaguaaaaacagagaaaguugauagaaguacucaagaugaacuuucaacaaaaugugugcacuguggcauugucuuucuggaugaagugauguaugcuuugcauaugaguugccauggugacaguggaccuuuccagugcagcauaugccagcaucuuugcacggacaaauaugacuucacaacacauauccagaggggccugcauaggaacaaugcacaaguggaaaaaaauggaaaaccuaaagaguaaaaccuuagcacuuagcacaauuaaauagaaauagguuuucuugaugggaauucaauagcuuguaaugucuuaugaagaccuauuaaaaaaauacuucauagagccugccuuauccaacaugaaauucccuucuuuuguuauucuuucuuuugaugaguagguuaccaagauuaaaaagugagauaaauggucaaugagaaagaauggaagaugguaaacaaucacuuuuuaaaaccuguuaagucaaaaccaucuuggcuaauauguacuggggaaauaauccauaagagauaucaccagacuagaauuaauauauuuauaaagaaagagaccaaaacugucuagaauuugaaaggguuuacauauuauuauacuaaagcaguacuggacuggccauuggaccauuuguuccaaaacccauaaauuguugccuaaauuuauaaugaucaugaaacccuaggcagaggaggagaaauugaagguccagggcaaugaaagaaaaauggcgcccucucaauuuagucuucucucauuggccauguuucagauuuugaccuagaaaugcgagcugugguuaggcuugguuagagugcagcaagcaacaugacagaugguggcacgcuguuuuuacccagcccugccuguacauacacaugcacacccucucugauauuuuuguccuuuagauguucaaauacucaguaguccuuuuguuugcgguuuagauucauuuuguccacacauguacccauuuuaaaaaacaauguccucgaugcuucuguagugauuucauuuuagccagguauuucuuucuugugugugaugaaccaguauggauuugcuuuucuaagccuccuguugguuacuaaucucacuuggcacauuauaacuaaaggaauccccucaauucaaaagcauagauggauacaaaugucagaccguggguuuaauuuguuuagaacacauggcauuucuucacaagguaaccugcuguauuuauuuauuuucuuuugguuaaauauaauuuccaaacuuuguggucaggcagcgucuaagguuacguuaccacagacugacaguugguauauguaccagccaaucccuucauuaaauguauacagauuuaguuaaguagcauuaaauaggauucuuagaaguauguccucauagaacuuuuaauacuuaaggcuuuguaaaaacuauccaugaagggaaagcuccucagcauaacugcucagggaaauagggcuaaauaacugaacauuaaauaauugguuaaaggugcuguuagucgagccucaaugcuugcuacaaggauguauguacaaggacugacuuuaauaauuugcauuauauugucccaaccaguaguuuauuuuuugccacggagauguagaagauauuacaagcuacuggaugcacugucagauuaacuuauuucauuaaagaaguugggagaacaaauaggaaaaaaaaaacuuauuuuucuaguaaauauuaauguauuacauuucaaauaauggugccugacauauugaauaauuauuuucuacaguguacguaugcaacaaagauauuccaucaugcauuagagucaguucuggcucugccuagcuguuuacauuugcaaauguagcaaacaagguaaugaagcaacuauuucuauugcaguagauauccuuuugugugugugugugugcauuaaaguuguaaacgguaacaugaaacaaaugaaaguucuugcuauaaugguauggaaaacaagaaggaaaugaaaauauuuuuaugccuacuuaggaaaaaaaggguagcacuuauucauuccaaguacuuuuuuuuuuuuaauuuuuaagcucuuaacucacauuguuaugcuuaagaugauaaacauauauccucuuuuuauugcuuugucuauguuucauaugaaacauuucagaaauuauuuugauaaguguugcuggaaucugcaacgcugauuuuuuuuugcauucuguagucgcauuugcacuccauuuuuacauuaauucgcaguugcuuuguaucauuguuuuguuuggguuuuguuucuuuuucacagugccgggucuucguuucuuaaaguuggauggcagguagaguucaaccaguucgugacuguuguagcgaaugaaguuaaaaaaaugucuuucugauguuguguugucauuuucauuuuugcauuuuuuuguuugcauauuaaaaaaagagaaaagagaaagcaagagacagaaaucaggacuaaguccucugcuucaguuucauuguuaacgggccuuauucugaucucaccugucgcguagcucuaauauucacauaaacugaaauaaagaaguggaaugaggagcuuugacauucaaauuaugugauguaauuuaucuuccuuaggaauuuugauggaugcaucucaaaauguauagccagacuugagaggugacaauuaaagaucuaaaaaagagaggagauucccccaaacaacaauauuuaauuuucuuaguaaaaagaauaacagaaugcaucguggcaauccuuaagcaacauuaucuauguggacugcuuaaaucagcaaaacaccagaaguuugguuaacuugggcaauaugacaaguauuacuuuuugggcaaaacuacucauuaagcaauuucucuagugugucggacacaaauagguucuuuauuuuuggcauguaugccuuuuuauuuucauucaauuuuuuuuuuuucucagacagacauaguaguaucgacuagcauuggaaaauacauaucacuauucuuggaauauuuauggucagucuacuuuuuaguaaaauauuuuuggauagcguugacacgauagaucuuauuccauacuucuuuauuauugauaauuuuauuuucauuuuuugcuuucauuauuauacauauuuugguggagaagagguugggcuuuuuugaaagagacaaaaauuuauuauaacacuaaacacuccuuuuuugacauauuaaagccuuuauuccaucucucaagauauauuauaaaauuuauuuuuuuaauuuaagauuucugaauuauuuuaucuuaaauugugauuuuaaacgagcuauuaugguacggaacuuuuuuuaaugaggaauuucaugaugauuuaggaauuuucucucuuggaaaaggcuuccccugugaugaaaaugaugugccagcuaaaauugugugccauuuaaaaacugaaaauauuuuaaaauuauuugucuauauucuaaauugagcuuuggaucaaacuuuaggccaggaccagcucaugcguucucauucuuccuuuucucacucuuucucucaucacucaccucuguauucauucuguuguuugggauagaaaaaucauaaagagccaacccaucucagaacguuguggauugagagagacacuacaugacuccaaguauaugagaaaaggacagagcucuaauugauaacucuguaguucaaaaggaaaagaguaugcccaauucucucuacaugacauauugagauuuuuuuuaaucaacuuuuaagauagugauguucuguucuaaacuguucuguuuuagugaagguagauuuuuauaaaacaagcauggggauucuuuucuaagguaauauuaaugagaagggaaaaaaguaucuuuaacagcucuuuguugaagccugugguagcacauuauguuuauaauugcacaugugcacauaaucuauuaugauccaaugcaaauacagcuccaaaaauauuaaauguauauauauuuuaaaaugccugaggaaauacauuuuucuuaauaaacugaagagucucaguauggcuauuaaaauaauuauuagccuccuguuguguggcugcaaaacaucacaaagugaccggucuugagaccugugaacugcugcccuguuuaguaaauaaaauuaaugcauuucuagagggggaauaucugccauccagugguggaaauguggaguaaagaagcugguggucugcuucugugcuguaugccagccuuuugccuuaaguugagaggaggucaacuuuagcuacugucuuugguuugagagccauggcaaaaaaaaaaaaagaaaaaaagaucaagucgucuuuggugagccaguaaggugaaagcuugcugacuguccaaggcacaagagaaaauugaggaauugaaaugcaaccugaguaucaaacuaaauauucuaaucaaagguagguacuguuagguggaauucuaucagcaggcaacugcaaaugagaagaagauagaaggacgcccgucgggacuuuggagggcauuguuauuuucccaaagaaagacggccaagggcagaggcauggauucuuugcagagcacuuccuuuugguuuuucaguacuguuucauagacagugggcucacauguuccugauagugcugcaguugcuuagaaagcaucccaguuaauugcaguaauuagaacuucuggaauaugcuagggcagaaguaugucaaguaugucacaugaagaaaaugugaaauucaagaguaauccacacgugagaaacuagacaauguacauucauguguucucuugaaaggaaagggagagcuguaagcuucacucuguccuacaccggagaaaagcaggaauaacuuuaccguggaaauaauguuuagcuuuuaucagagaaaauuguccuucuagagcauagagucccaaaacucaauucugguuuuccccuguuuuuuuuuuuuuuuuuuuucccaacauauaaacugcagcauaucacuuuuucuuuuugugccucagguuccucaccuguaaaauugaaaaauauauguauuaauaauauuauuaauaauaauaaugguaauguaguacuuguuuguaaagcacuuugagauccuugguugaaaggcaccauaggagugccaaguauuauuauguggccaaggggguuauuuaaacugucaguucccaaaggccaggaaagguuggggucauuuuucuuaaagacgagcuguaaauaucaacuaggcagccaauaguguugacuaugaagaugcaaaacuauuacuaggcugauaaaaucauaguuucuuaauggcuaccaauaaggcaaauaucacaauaauaaacgccaaauuccuuagggcggacuauuugacaaccacauggaaaacuuugggggaggcaugaggggggaacaucucaaaaugccaauguaaaauuuaacuuacagcaauauucaccagcagaaaaugucuuucauauggaaugauuucauguugcuaagaaaaagaauucaauuuguaguccugauuugaauacuagaauguuggcuauaauaguucuguucuuacaacacaugaaauuuuuucguuuuauuuuauuuuguuuucauagugcauguucauuucuacucacaaacauguucuugguguauuucuuaugcaaacaaucuucaggcagcaaagaugucuguuacaucuaaacuugaauaauaaaguuuuaccaccaguuacacauaacggcguugguaugguuuauauggauucacuuucauccuucuagcaauaggaaauacagaucauuguaauauauauauauauauauauauauauauauauauauauauauauauauauauauacaggcucugcugaauugaaauggugaaaucaaaucaccauucuaaaaaauuauuacuuauauugauaaagccuggacucucucaacuuguugugcuuugauuuuuuuucuuaaacaaacacucucucacugauauauuuuguguaaaaagauauauacuacuuucuccagagagauaacauaaaaauguguuuauuucaaaaacauucaguugaguaucaaauauugagugucgaguauuggguaaugauuauguuacgauguguaaaaacuccugcuuaugaaguuuaacuuugaauucgguauacucaugugaacaugaugcaauuccuaaucaaucaucucaaaaaguuuaaauuaauauaucaaauaucuuauuug

SEQ ID NO: 17769 - RNA, 5166 nt, Homo sapiens
aucugagcuuuggaaaccagcgacuucaaacugcaguagccccuggagucagcagggucaaguucagccgccggggaggaggaaaaacaaauccccauuugccaaaaaaagaaguuucaggccggugcccccucccccucgcagccccacucccccucgcugucucuuucuggcugauuuuaauucucuccuaccgggcgcagcggaggagcuggaggugguuggacccgaggggccgccgccgccgccgccacugcaaguuuucugggggcucgugacaagcggggcgcagacuaggcaccagcaugcagaguaguaaguugggcgaacucgggagggucgggagggucucagagacgggccuccguauggucuccaaagugggaaaacagcacaggacugccuuuggcuuugaagaguuugcaaaugcaggcuucaaacuuuuuucccuuaaaggcccagcugggcucuggagaaggcgggugucgcaucccuuggugcacccgccucagagcggcucaggacagcuuggccgagcggucugugcccuguccguaccauguggcagggccuugcagcccgggcgcuuccguaggggcugaggaaggggcagacuuccucugcgaugcgguugaugcgccaugugucgcgcgggucaggggacacuggccggugauuaaaugccugacagcggugggacauccaagcggacagacgcuuugccuucugucugguuccuguuugggaucuagagaaacgcaucuuugaaaggccaaggcaaacaucgcugucccuccaaauaacuccaggauuauaggaccccaggaauaauuugagggugaggcggcggugggagcuguuugaaguguaaagcuguuuuuguggcugggaaagcuuuuucguuaguaccugucugagauggugguguuucccccuuuccccagggaagucagcaacuguuuuauggccccaggacucuaaagcaauuuaaguuagagggugagaaggacugguggguuucagagggaaucuuggacuuauuaaauuuuaggaccggcuuuacuucccucuaucuuuuuaggccucauauuugaugcuuugaaaguuuuuugaguaagccauugaucuuaaugaugaaucuaaauuaugauagaauauucauucuuaugccauuuuggaaaaucacggcuagaguuuaagcgagguaagugaagugagaagcucagcggaggaguuaaaucugagacaaguuaggccuauucauugaacuuuuguagauucauugaacuuuuguaaacacaccaggugaacaggaaaggaaagggucugggagagauaauaaguacaaaagaaaaauacagauagggccugagacaaaauuacaaagaaaugauaacucugggccugguuguuggcuaaaacuugauuguucaaagcaaaaauaaaauaggaaccuuccaacaauucuucaaaguccuccagcucugaagcuaaaaccuauggaucuugcuggcaucauguuacuuuccugcugguuuuagaaaaaguugaucauuuagaaaaggcugccagaguuaaaaaugcaagggacagcagaggaaagucaugcgggcagccaguucuugacguggacaaaaugagaaugaaaguuucugaacucacuguugugaaguuuuacaugccgcucauuugcuuagaaggcucucucagauauuccaccaguuaacguauaaaagcaaacaggaucuaaaaucgugugggcuuuuuuuuuuuucuuuccccaaguaugccaggguugugaauaaauacaggguuuguaugggaagaugaagcguuuccuguaaguucugaugcugacaggacagucuggaaaugauaccaacauuuugaggauuuuuuuuuuuuaccuuuaagugaaaguuuauuaaugauaugcuuaaucuuaacaagucaaacauauucuuagaguuucucucuccuuggauuucauaacuuccuuuuaaagcuacaccuuuggauaaaaacaucucuagauucaguucaauauacagggcuaguaacaugcuaaaguuugacgauuauuucuggauguuaauaaugugaaaauaaaacuccugaggggcaaauagagccuuaauaccaacauuauaacuugauuucucugaaugugaggccuucugaagcuucauuaguacucuguuggcgaaguauuauuuaccacuggcgagcugauguuuauggcuuccugauauguauguuauauguuaggauauauauguguagacugcuuuuccauacauaauaccuaagucuaacacuuuucaaauaagugguggaaaguagcaaguuacuaacacaaaguuugucacuccuuugaauucuagaugcuguaagggucugugcuacuauuuagguuuuguccuuugucucuuaaagguaacguuaaagguaaggagaaaaaugucauaauagcugugaagucugagcugaauuuagaacuuagcauuucgaugacuaauauuuuaaaugauuuuauaaaauuuucugcauacguguuugaaaaccaguuuaggaucggaaucagugugcuaauccgaaauaaguuacacauacuacuaccauauuuucaguauuauuuaagucaccuaccacuccugaguuuauucugauuuacaucauauagaucucuuccuauaaggaaauauucauucauaaggaagaccuuuaaaacagggaaaugcaugcaucuguagaaaagcagcuuuuacgauucuaguauuucagugacgguucuauuaucacuacuauuauuagauguauauguguauguguguacagacauacaacccacaauaugugauuaaugauguguacauuuuuauuaagaaagcaaccaaagacuguagauuuuuauaaacgcuugucuuaccuucuuuguuguaaauaaacauuacugaaaguuuccagaggacuugcagcaaauuguuuuugaacuagaacuuuauuccaaauuugaaauuggaauaaaugcugauaacugaccuuuaaacauuuuucauaacaugaauauuuuagaauaauuauauuuuaacuucaguucuucuuuugauagcaacaauaauguaacaacacuaugcuauuacguguacaacaacacagacuuuaagaaaguuaugggcaggugucuauaauugauuuaaaggaaagauuauuuuuguaauaagugaugaacuuaaaaugacuggcuuacauuaaaacauauucuuauuaagauuucucugguguguaaaaugaagccauucauucaacaggcugacaacuuuccacuugguauuugccuuuccuuaauuuaguuuccgcaggacagcuagugugguagucugcaucuguuuuuagcaggcauagaaaacuauaaacucagacaguucugucccaaauauugcagcucacaaguuacaaucaauuugauaaaaacccgcaaguuuuaugggcucguauuuuguuguucauccuugcuaggucaagcuuucagguaauagguuucuuuuucucccucuuuugcugaugauaacugcuaauaccauugauaacuaauucugagucuuguuuacucauuuaucauccuuauuuaccauuuguugaaguuuugggaaauuaaugacagcauacguagacuugcguuuacuuugauggcuuaucugugaaaaugacauuuaucuuuuguuauuauacagaaauaaguaaauucuuuguuaccauaauaguuaugauuuauggaauuuuugagucccccuuagauauagcauaaagauggucuucuagccuuugccaaguagacauuuaaucuaauuguuuaagagugcuugucauguauagaaaagacuaacauacuuugcaauuauuuacauuaaaaauuauguagagguuuguuuuaguguaauuuuaaaaauaauuugucucccaaaagcuguaaccaguggauuaaaguaaauaagcuaaaauaccaaaucuuguuuuauaccauuguucuauagcaaacagugcugcagaggauguaacuacuuuuuaaaauuuauccuccgauguaaguagggccaaagucauuuguuuguauaaaauauucuauuaauuauauaugaccuuuauaaauaauaucuucgauuuuauuauuaugaucacuuuuugagcuaucacagugcucaguuguucuccuauuccugagaacugaauuuggccuuuaguuugguuuucugauggacacaauaauguagaacuugacuuugguuagaaagagaucuuugagcuucaggaaucucugaaggugcaguaggaucuacaggugaaaaccauuugaauuguuaagcauuaguuaggugaagaaacucuacuggucccugcagcauauagcagcuauuaucguagcggucuacuuuuugcuaucccaguuuuuuuuuuuuuuuuuuuuuuccuuuuccaagagcacaaauccaaauagcaaaaaugaaggugaaauuaucuauguacuucaaauuuggagcaucauuugaaaucauuuucugauucuaagcuauaacugaaauacaaauauaacauuaagacaccccaaagaagacauuaaggauacacuugucguucuuaaguguguuucacuaaaaauaauaacaaaaaacuuuuaauuuuuaaaauguuucuagcuuuuaaaaaccugcaguaaauacuuuacaaguggcuagacaccuucccuggugguuuaguuuauacaagcaggaaacuuucucuccuacucuuucucucucucuuucuuguuuucuuuaaaccaacugacguaaugccaaacuuugcuuuaaaagaacagacagaaguaauugguagcuuuuaacuuuuaauaauguucuggauugguuuuaguggccaaaaugccauuuaaaaaaaaaaaaaaguucaaguaagaacgggcuuguggccugaggaagaaaggcucuguugaugcaguuauuuuuauucuuguuuuucaaucuguuauuaaaaaucuuuccugcugagcacugcuggauuucuccaauugcucuuugugauggcuggugcauuucagguuaccguaacuuaaacaguuuuuggguuuuggggaaaguggguauuugcguugcauuauuucuuucuuauuug

SEQ ID NO: 17770 - RNA, 39294 nt, Homo sapiens
aauauacucaguagaucaauccauagaaaaguagucaccaggggcuacagggaggaggaaaugggaagggacugcuuaauggguagaggguucccuuuugggguaaugaacaugugcuggaacuagaugcuggugacuguaacacaaaguuguaaauguauuaagcgccccugaauuguacaauuuaaaacaguuaaaauggugaucuuuauacuauguguuuuguacuguaauaaaaaagauagauuaugaaagggaaggaauuagagagggaaaacauggacauuucuuucagaacuuuugcuguaagggggaguugauaaauggugcaguggauauggagcaaagggaaagguuuuaaaauauugaagauaggugcauuuuauaauuauuaaguagaugcuguagaaugaaugaauaaaugagguauggcuaccaaacaggcauagggagugucagaguucaccucaggaugaauagaugaagacugacauugaaucuuuagagccauaacagauaucaugacccacuuuuuccacugacacucauggccucacuaugcuaaagaaaugaauuauggcacuaggaaagcaauauaaaauauagaugaccauagaaaauaaccgaugcauugcuuagaaaagcaauuagauuucaccccgauuugucuuccccuagugaguuaguggauaaacucacucaugugugcuaauagcugguuguaugaaugagaaaucguauuccuauugauacauuguuggugaauauaucagaugaauaacucauagaacuggaugguugcauauaaauaugcacugauaaacuccaaaugcggauugaaaauauucuaugaaucauuagaaaucugcuuauugaagauucccauuauuaaauuauuaaaauuaguauucauaucuccaucuaauuaucuuacuuuucuaaauccuuuuuuuauggaaauacaaagguaaagagagauauauacaaagguagaaagaggauuaaaaugacccuccauauauguaucacccaaguucaacaacuaucaacccacagccaaucuuguuuugaacuacauccacuccuuuuucuacuucuuggggauuauuuugaaguaaaucccagauaauguaccauuuuaccuguaacuauguuaguauguaucuuuuaagcauaaggccauucuuuaaaaacaaaaccaccaugccauuuucauauaaaaaauaaauaauaauugcuaaauaucaucccuuuuaaccugaccuuccacuaucuaguugacaaagaguucauccagugcaaaaacuuauauucugcaacuuaaaauucuaucagugguugaaguaacacugacauaaauugaauccaguuaauuucagacaagaagugcacaguucauaagaaaaaaguuuuauaacagaugcaacuuagccaaugaggagugauugauucuggaacauucagagaaaaaggcuauaguuaccuauacucaauaguguaucaaagaggaaaggugcuagcuagaaaauucuauccacccaccacauauccugaucauuuuauugagauguucaacaacugcccuguauggacuugacauggucaaagagagaugcuuuuugguuuuaagggcagcaucuuggagagagauaauagagaguuuuccaggauucauuaaauuuaucaaagacuaaccauuucagauaaaaugaaaugcugccuuuagaggaaaugcauacugucaggaagccaaaagucuccagauguuagggaacugcaaguuuugagauuaaacacguaaauucaguuuuucaacugugaagguacugacucugaaaauaaaagacauuagauaaacuggccauacaaauauugauuuacagauccugauucucuuccccauaguuuauguuuuuaagaggaauggaaugugugauuagacuuggaagaacacauuuugugggagacuuaccagagugaucaaaauaaaagaauaauaagggaggaagagcauuuggaagugaaguuuauaggagggaaaauucucucaaaaaaguuauaaaauaguacucugugaaagacaacugauaugacauagaagguugaacuacucgccaggagagaucagacauuaacuuuugugcccccuguauuucaucuuucuuugaaccagguaagugcuuguaucagugaggauuagaguaagcuacauauaacaggaaaaaaaaucaagacaggacuuuauuucucauuuacauaaaauaagucuggagguagccaguugcggguuuaugagacagcuuuacaaaguuguuauguacucagauuuguccauaucacugauuuacuauccuuagcuuauccuuugucuucauugcccaaaaugcugcuggagcaccagccauuuuaucuauauuccaagcagcaaaauaaagaaugagaagaaagguugcuccauuuuguagauauauucuaguaaugcccacauaaaauuugaguaaaacauauucucuuggccacaccuauaugcaagagacacuggaaaauguaaucauuuagcugggugccaugugcaaaacuaaaaaaaaaacaaagauguugggaaacaauucucagcuuuugccauagaacucagcauagaauaaagaucgauucagaaaagagagaauaaguacauuucaggaggaaaaaaauaguaaauauguugaggcaaaugagugugugauuagagcugggcaugguggcucacaccuacaaucccagcaccuugggaggcagagguaggaggguugcuugagcucaggaguuugagaccagccugggcaacguggugagaccuugucucuacgaaaaauuagccaggcaugguggugcaugccuguagucccagcuacuugggaggcugagacaagaggaucacucgagacaggaggucgaggcuagaguaagcugugauugcuacugcacuccagccugggcaaaagagugaugcucuuuaaccauuauuuacugagaucacauaacaugcuaaacacuaugcuagaugcuuuauauacaucauugcaugacauaaacaacacagcacugaggugguagauacaauuaaccugauuuuacaaauaagaaaacucagccuuagagagguugggcaacuugcugaagguuacacagcuacuagauagaagagccaugaugcaaaccaaguucuacuugauuccaaagucuauuuuucaaaaauccucuucaucuacgaggguuagagaacaauacaaaauaaaaauaaagaaauuaauauaaaauaaauaaaagaaaauaaaaauaaauuaaacaugauuuaaaauuaaaucaaagaaaaauccucagugugguccccauaguggcagccuuggaauuaccugaagcuguuaaaaaagcagacuccccagccccaccccaaacuacuaaauuuuaaccugauuuagccaagaccccaagguaaauagcccauuauaaguggagaaauaucacucucuaccacccuaccauaaauauaucagaucucacugauaauaaaaccccaaauuuagucuuagguacuaaguugcagugugaguuucuauaauaacacuaauuccucauaugucauuaacaaauaggggaaugauuuccaaacggcauggaaguuaccuuuguaacuuuguguuucccagcacauuaauuuuuugaucccaucaaguucauguaaaacacauuaacacagcugagcaucuagccacagagaacaaaggacugcacauagugcccauucacuucaaguuagcuuuuggcucacuuuaucuccauguugugucuuuggacugcuuacugcagcaagcacuuaaucucugcauuugacucuuuucucauaacucaguaacuucuaccuuuuguuacacccuucucuccaagcacuuucaccuucuuugugguaaaaguacuauauuugcuauauuauuuccuugauugguggcaauuuaacauauauuuaauaauuuuuauuaggauuguuagcacuuuuguuaguugcauugguuuuaagaaaucuaucucaacccuauuuuuccugaguuuucccaauaauuuuuccaagcaauuucacagaaucaaaggaacaauguauauuguauuaaaacaaaaaugucugcauucuggaauggcgaggggauuucagaauaaacacuaaccuucugcuuuuagaaagcaacuauuauuuuuucuuucuguuuuuggagcugggggucugcuauguugcccaggcuggacuugaacuccugggcucaagccauccuccugaguaguugggacuacaggugcacacuaccuauccagcuagcacucauuauucucaaagaugcggcacaauuguggaagauaugaugggcuuuaaaauagaggaaaugcaucaaaauacucacugagaaaaauucccagcuagaguuaaaaaugcucccaguauugaaauauuagcauaaugaaauuuucugagagaaguccaagugauuaacauaagaccuugacccagcuucugccucugaggcuuccccucaucuccacuucgguccuugauaaacucacauuuccaucuggcccagagacuacccccuauuaucccugggcccacuccuggccccuggugauuuuccacugcugauacauaccugcgugagcagacccuuagcccagccauaauagggaugcuugcagccgcuuucuggaguccugccucaaaccccaaaccucagcucaaacguuaaaacucaaaccucagcuucugcuugaaguugaggaugugacugugaaugaaaccuauguuuucuaaggcuuacaaaacucuuucucucgguuucucucucucuuucuuuuucucucucucucacacacaugcacacacuauuaucacuaauuuaauuaauaucuagugaauuaggaauuguuucaaauaaugacauuuuguccuuaauuccccuacaucucauauaauguuuaugucugauuaugacauuucuuccuugaauuuuguccuuaaaaugcauucccuuuuugaccaaaaccccuuguaaggauacuguuggcacuagaaggaaagccagaaucuacaguuuuuaaagucacuuucaguccauuuuucuuugcuuagcccaaaaccuuaaaaaggcuauucacucuuucugaacuuuucuuugaucaucauauuuuauacuuugauuuuuauuuaaauaaaaauuuuuaaaaaccuggugcaccacauguuuaauacccauccucccgaacauugaaauaucuauuuucuugucuuauucuucucuucaccuaauuccuccuacuuacuauaauaauaauaauacuuuuuuuuuuugagacucgagucucccucugucgccaggcuggagugcaugaccucagcucacugcaaccucugccucccagguucaagcaauucuccugccucagccucccuaguagcugggacuacaggcaugugccacgacucccagcuaauuuuuguauuuuuaguagagacgggguuucaccauguuggccaggauggucucgcucucuugaccuugugauccacccaccucggccucccaaagugcugggauucuauaauuauuuuaauguuauagagaauccuguuuuaaaaguuugccaguucagaggagcaagucuacaacaguauauguaaaucuuaaacaaaucugcuacuguaaguuuuaucaucuuuuucuauaacaguauauuuucucucuuuuuuugccauaacaguuuuuaucucacaaaaaaaacucucaguuguguguguggggggggugucaucauaaaauaacgugauauagacagaacgcagcuguuuuuauagauauacucaagacaguggcaacacccaguuucucagugauuuccccaaaucauacaagucaucaacugacuaaucagaaaaggaaagcauaccauuugcaacugaagaaagacaaaaucuguaacugaaaucuguccucucaugguuuuagucaaacaaauucacaauuacuaauuuugacaaaugcacauucaucagauaaguauuuccagggagaagagauacugcagcuaacuccugcaauaagaaauuuaacuugacauuuuaauacaaggagguggauggguauguugauaagaggagacuccaagccagaauaaaacauacaacuuguucaaagaaucaaauccagccauuuaggggauuaggacuguaugugaagaaacuauauuaaaaucuacaaaugggaaggcgggcucagaguugggagcucugaguaagaauaaauaguucaagagaaaagaaauguaguacuuugggagguaacuugggguaggagaacagcauguaagagaaagauggagagagacagagaagagagagagaagacagagagagagaggagagagaagacagagagagagagagaauaauuuucaaauauaaacauaaaacaggauauagucagaauggggcagaguaucccgguguuuacugauguucuuauaaauugaauaucugauaaauauuucccauaccuugcuugauaucuuauuauucagaaagcagauaaaacuagaguaauaccugccauuuauuaauuacucaguuccaagcacuauacuaagcacuuuguguaugugauccuauugaauuauuucaaacaucaugacaaguauuacccucauuuuauuaauaaagaaaucaaagcucagacauuaauuguacauguuaaaacagcugggagguagaagagaagaauuugaacccaaagcccauguucauaaccaucccccaaaaguagaaaaauaaaugucuuaagaaaaagguaagccuguugauuuaaauauuagaaucagacuugcugcuagaaaugaggaaaagagaauuguuuuuauucaaauacagaugaaaaauauaugguuccaugaacaaaaacucuaaaagcuaauguaauauaagagagacaagaaguggcaaugcauauucaccuggccauaguuugaagcugggauugauuuaaacugaaauuuaauaugaacgacaacgucuucaccaugcaacaugguugugugauucuuaaccugacaggagacuuuucccacaugauuaguuuugaggucauuuagcagcugauacaccgaaauuauuuugaagugaagaauuaaauuguucacuggcagaaaucuaauuucuguugcaaggaguuuaauuguuaaugagcuuguauuuuuuuuuuuuuugagaugaugcaacaacugccacuguugaguuugcuuaaagccacaccagcaggaaggauuuaagugcuuugagcaucuaaucuauauuggucgagggaaagcaugcuuaaaauguuaaaagugcuuguacuccuucacuccccagcuugggauuuuaacaacuauccuuaaugccaauuucuuaaagucuccauuaaaaacaaaccaaaagaacauaaaauauuuggcuaacuacaacagaaauucacuugauaaagcuuugagcuguggccaguauggccacuuagcuaauggacuccagccagugagacgaaccuugccccaacccaaaaacaguggacccacagugaguggagcacaagacuguccacuuucuuauccaucuccuauaucagcauaagaaggguaaaagugagguguucugugugucauuaaaauccuggaaguguccagaaguagugguugcugacaaugaggaguauauggacuuaaaugucugcuuuuccuguguguuuuacuuuaaaaugaaaauacauucagaaacuggacacaaaauuucuuuuuaaaauacguuuuuauuauuauggauucauaauaguuguacacaauuauaagguacgucugacauuucaauacaagcauacaauguguaacaaaccaugguaauugggguauccaucaccucaaguauuuaucauuucuuuguguuagaaacauuccaauuccacucuuuuaguuauuuugaaauauauaguaaguuauuaacuauaguuucccuauugugcuaccaaacacuagacuuuauuccuucuuucuaauuguauuuuuguaccaaaucugagggggcagauuuuguacucaucugcccccuccccacuaccuuucccaggcucugguaaccaucauucuaccuucuaucucaaugaguucuuuuuuuuuuuuuuaagcucccacauauuagugugaacauucacacuaaugucuuucugugccugguuuauuucacuuaaugucuuccaguucuauccauguugcagcaaaugaaaggacuuuuuuucuuuuuuauggcugaaaaauauuaucuuguguauguguaccacauuuucuuuacccaucuauccacugauggacacuuacguugauaccauaucuugacaauugugaaucuugcugcaauaaaugugagagggcagauaccacucugauguacugauuuccuuuuuuuuuggggggggguauuuacucaggagugggauugcuggcucauaugguggcucuauauuuagguuuuuaaggaaucucuauacuguucuucacagugcuguacuaacauacauuccuaccaacaguguacgaguguuucucuuucuccacaucuuuaucagcauucauuauugccuguauuuuggauaaaagccauuucaacugggaugagauuauaccucauccuaguuuugauaugcauuucucugaugauuagugauguuaagcauuuuuucauaucccuguuggccauuuguaugucuuuuuugagaaauaaccauucaggucuuuugcucaauuuuaauuggauuauuuuccuauuauauuguuugagcuccuuauauauuauggcuauuaauucugugauagaugaguaguuugcaaguauuuucccccacuugauggguugucucuucacuuuguuguuugcuuugcagaagguucuuagcuuggcaugaucccauuuguccauuuuugcuuugcuugccuaugcuuuuaaggucuuacuaagaaauauuugguucuggagcauuucccuaacguuuucuucuaguaguuucaauaguuucaaaucuuagauuccagucuucaagccauuuuguuuugauuuuuuuaauauggcaaaagauagugaucuguuucauucuucuacauauaguuaucuaguuuuuccagaacaauuuuuggaagagaccauccuuuucccaacguauguucuuggcagcuuugucagaaauuaguugacuguauauguauugauuuauuuauagguccucuauucuguuccguuagucuaugugucuguuuuuaugccagcaccaugcuguuuuguuuacuaucacuuuguaguauaauuugaagucagguaaugugaugccuccagcuuuauucuuuugcucaggauugcuuuggcuauucuuggucuuauugugguuccauauaaauuuuaggauuuuuuuccucuuucugugaagaaugucauugauauuuugauagggauuacauugaaucuguagauugcucuggguaguauggaaauuuuaacaauauugauucuuccaauccaugaacauggaauauauuuccauuuuuguguguccucuucaauuucuuucaucacuggaaagaucucuacaauaaaaacaaaaguaaauuucuucgugguacaaguaagucuuuuaagauaagaaauuuuaagauuccucccaagcaauacugaaaauuuccaaaaggcaguuauuaucucuguuauauuaaucauuauauccagagcccaacguguagcaaacagaagacccucuauaauauagguugacugaauaaaugaaccucuauauuuuauggaauuaguuugagguuuuuauguuacuuucaucccuauagagccauaaaaugaauuuuuuggugggggcacacaaaauugcaccacgacagcuuuuuucuuuaaaacaagcacaagaauaaagcuaaacgcaaauauucaccgcacuggaaagcacugcgcgugcgcuaucuuacgcuauuggcuaacaccgcaacucucaaagacccucgcaagagaaucaccuuugcgcuugcucaguuguggacuccacaaacagagggcggguuccaaagaaaaggaaauagucauugcgccugcgccgcuccuucuggggggaggggggggcuugggcuggcugcgcaggcgcacagguaccauuuugaccguaaacauccugccgauuugaaccgaggauuugggcggcaggaagagccgcggcguaacggcagccaucuuguuuguuugagugaaucggaaaggaggcgccggcuguggcggcggcgggagcugcucggaagcuacaccucgcaagggcuccccccuuuccccacccccucccccgacccuuuuccccuccccgggccacccagcccgcccaacucccagcggagagcaagguaagagacucggccgaccccuucuuuuccuccagcucccuccccccacccuuuccccgccgcucugccgucggggagccggacuccugggggcgggagggcgagggagaaggcagcccucgccgcgcccacgcgugcugccacccucccggcgcccaagcggcggcgccacccgcccagcccccuucgccccgggcccgcccucggcccggacccaugcagcuugggcccgcaucaucgcuuguucgguaacaaaugauucugauccauucugagaucuacaaaggcuguuacccugcagguccaucucacgucccccaggaggccggggaaacccugggcugcggagggaggggaggagguuugaacgagcccgcucuggggaccgggccgccuacuccgcggguaaaaauggcugucugggaggaggcgguggcgggcccggcgcccgcggugccagccccgggagcagcaaccuuccgccgaacucgggugcggggcucaagaaagugcggagcugguggggcugggcgggguggggcggggggucggcgggugccccucggccagugacugcugcugcccucccguuuuaaaaagauaauuuuuacguugggaaugcugaauauuucacagacgcguggaaaaagagacggagggaaguugcuucuuuuuccaaggauauuugcauaauugguuuuccccugaacuuuucugaucauucuuuaaagugauuaaggauaucggguguuguagagacgcucugggggagguguguguuucugauaaaugcuugaugcccuuuucgucgcugaaaaaggcuuuuugcgaaugauccgcuuugauaguguggggugacacugucggguugugcugccagacuuagcggccuucuucaaauuuguaagagggaaacccugggggauuuacuuggucacucugauuuguuagugucuucagcgugaaaaaaaaaacagcguuugugcgaagaguuucugggaaaggcuuguguuuaucggcuucuuuuugcaagggaaaguuaaucuuuguugucauuauacugguuagaagaguaauugguuuucaggcaaaaauuucuauuuucuuaaauuggguguaaaugccagcgggcagugcgagucuauagaauuuuggagacaggcaggagaagguuucucaaaucgugaagucauuaaauaccuuuguuaaugucggaggcaacuaauuauuuuuggaaaggcauugaugaggacauacgccauaucugaucuucaaauaaguuaacaguuuguauaguugaggugacagcagugcauaacuaauagacauagugcuuuuuuuuauacacaagucagaauuacaaaagaauuucuggugaauuauuuugugaaacauacaaauucuaagaaacgcuuuuacaguuugguacagaauggaaauuuucuaauucuugagaaauaagguuguguuuuuaguuuaaaugucaaaccagaguuguuaggcaugauuauacuggcugguuaauguuuugcugcaagauugucuucagaguuacuuuucgcaucagcaguggcacuauguuaggugugcccuuguauuuaauuuucauaaucuuuuuugaugaauauuaucccaguuuauaguugagaaguaacuuauucaccguuacaaaacaacugagcaaagagggagcuuaauuugaaccuacgacugucugauuguaaaacucuuggucaaaggauguuagaaccaaaacagaggagauuucuagugugcaggguuagaaauaucuucagagauccuucccccuacuccccugaagagguagcuccguucugaucugaguuagguauugacguuuucaaagguuagguaaaccaccagauuucaaccuuucagguuuucauaguagggaaacugaacugcauaaagguuaggcagcuuaacugcuaguuaaugacaauagcaggauuaugucuuuacuucugagauaguaguuuuuacuuugaauaggugguguacauuuaugucccgaguuaaaauauguguguguguguguguguguguguguauguauauauauauaucaaacaguacaaaaagguaggccucacuugcccugcauaccuacuuuccagagguaaccaguaucaccaguuucauguguacgccacagguauuuuaagcuuauucaagaacucguaaauauauagagaaagagcauucuuuuuuaaaacuccaacuuuuuugcacuuaaccuggagauuuuccauguuaguacaaauguuguauucuuguuuaaaguuguacuguacaauugucccuugauauuaaaggggaauugguuccagaaccaaaaccacgaaugcucaagucgcuuauaugaaauaguguaguauuugcauauaaccuacuaacaucccauauacuucaaaucaucuccauuuaugauauuacaauguaaaugcuauguuaauaguuaauauaguuguuauaguuuuuuauuaguaguauuuuuuauuauuguguuuuuuugucccccccuccaacaauuuuugauccuggguugguuuaguccauggaugcaagaagccauggauaaggaggaccgacuauauuccguuguuuggguuuauuaauuuuucauaucacuuauugauggccaaguagguuauuucgaauguucuguucugcucuggcaaggcagcauaguguuguaguuagaaguguggauucugaaguucaaguuccacuuccauuaaauacuagugacauuuacuuaucuucaucuguuuucuccaucucuaaaaugggccaguaauuuacuucuguaggacagucaugaagagguuggauacauaaaacacguagugcuuaguaaguuuucuuaggauuuuuucguguuugguuuuuugguuuugucuuuaguaauaugcaucuccaaguauaucuuuuguauugauuacugaaagugcaaguucuggcuagaaaguguaagugaaauuuuuauaaaauguugucauauuguccuucagagaggacaguaccaauuuacacaaccgcaguccugccaugcuuucuaaugagugaaauauugguaaugacugauacuauccuagaagcaugagccucaguuugauucuuugaaacagucuuaaauugccauuuuuuguauucuugaauauguucuaaaauagcaaucuuucugcuguuucacaucagacuuuaauuuuuuagggucaauugaaaaaaacugcuugccgcuuuagaaaaaaaugauucucaaaucaugaaaugcuaaguugugcucugguaucaaaugcagauuuucugcacaggguuuucauaaaggauuuagcagaauauagaaucuucaaaaucuaaacagauuaaucgacuuuuuuaaagauuggaugaaguuugguauuaucaaggaaaaaaaaauaggcuuaaaaggcaauuauaauuacacuuucuccuuauucagauauacaccaggagucgauccaccacugcuccuuuggcuuccuuuaguuauuagagugauuuccucuugcuaauuguuucccacauuaauuuuagcaucacucugccuuccuuagccccauccuaugccaaacaggcuucuguuuaggaaucucugccucugcauagcugggauauuuuaggcacggugcucugaccagcagcugaagugcuggccaggagcuacugacaccuguugaaaaaugccaguaguuuuaauuuuuaaaacgucuaaaauuuuuuacauaugccaauuaugagaucacuugguggaucuuacuuacuuauucauuaagcacauauuuaguaauugucaugccacagauaguauucuagaagcuuaauauuaaggaguuuuuuguuuaggauacaguugcuugcuuccauaguggaacuuggggcuuguccuguacaacagcgauuauauuucucagaacaugcugcuauguuggauuucuguaaaguucucuagauuuuauuuauaacauaguaggagcagcuuaaguuuugugauaacauuuuaaggcuugaaguaggcacugauuugaaacauaggaggcucucuuccgguaugggaagcauguuuuaaucuauaaaauaacaaauggcaaauaaagcaccuuugagguguuauuuaaugcucguaccuuaagaauauuuugucugaguucuuaguauagaauauaguauuucuucauucuuuaauuucuuuuuuuuaaaaaauaaacacggggucuugcuauauugaccaggguggucuggaacuccugcccucaagcauuccucuuaccuuggccucccaaagggcugggauggcaggcgugagccaccaccgcuagccaauuucuuccuuccuuaacuccaaauuugggaggaagaguuuacaacauuagacaguugacaaagccugguuuuuuuucuuuugaggaaaaguuuuuuuaguaugaauuaauaauccuuugggaacauuagauucagagaaugagaauuucaagacucuuuacucuuaagugauggaaauggagauaaagcaaaccugacugcaguagucuugcaccacagccccccacccuccaaaauauuuuugacauguaagaaaucuguugcuugugauacgcguaacuaaaauauauuuucucuacaucaugggaaagaauuggcacauuuuuaauugaaaguacaguaagcaaaauucuuuaagauuuacagacugugaaaaaaugaaaaauaauuacucuguaucuuuuagagaaaagcuaauucaagagauuuuagucccaccugcaguguaagagauccagcuucucugugucuuucagcauuugauguugccacuauuuuuuaauuuagcucuuauauuaaguguguggugauaauguuuuuggccuuaauuuguauuucucaaaugccuaggauaauugaacaucucauguucuuauuugucaucaguaaaccucuucugugaaauuucucuucuuuggcucacuuuuuuuuuucuuuuuauacagagucuugcugugucacccaggcuagaaugcagugucgcgaucucagcucgcugcaaccuccacagccuggguucaagcaauccuccugccucagccaccugaguagcugggauuacgggcacaugccaccacacguagcaguuucuguguuuuuuaguagagacaggguuuugccaaauuguccugacuggucuugaacuccuggccucaagugaucugccugucuuggccugccaaagugcuggguuuacaggcaugagccagccugccuggccucuuuugcuuacuuucuaauuggaguuuuuuuuucuucuuaccccugaaguuuuaagaauucuuuacauauucuauaucugaguucuagucagaugugugguuuacaaauauuuuuuccccagucuauagcuugucuuugcauuucuuucguagagcaaaaguuuaauuugauaaaggcgaguuuauugagcaagaacuuuuccuucauggguuguguuuuugaugugucaaaauuuuuaccaagcuuuagguacugaagguuccccucugccauuuuuuaaaaguuuugucuauuuugaauuuuuauauaaugugugagauuuagguggaggguuuuuuccuugccuuuuuuguuuuguggggggugugugcgugcgugcgugcauguuuucuggucuucagaucguauuuaaucacuccagcaccauuuguugaaaaauguaucauuucuccauuagauagcuuuugcaucuuuguaaaaaaaaaaaaaaauuaguugaacuuaguugugcgggcuauuucuggguucucaguucuguuacauugacuguguuuccucugcuaauaccaaucuugaguauuauagcuauauaguaagucuugaaaucaaauagacuaauuuuucucacuauuuuucaaaauaguuuuagcuuuuuuaguuuauuugcuuuucuauauaaauuugauaaucuugccuauaaauauaaaaaaacucauuuugauaauuguauuaaagauucuuuaaaaacuaaacauauacuuaacaauacuugucagcagucacauucgggacaguuguccuagagaaaugaaaacuuaauguucaccaaaagucuguacaugaauauuuauagcagguuuauuuguaauagccaaaaacuggaagcaacuaaauguccuucuauaggugaauguccaagcauauggugguauaugaaucucacggaaugcuguccaacaguaaaagggaauauacuauugauaaacguaacaacuuggaucacagaagcauugugcuagauccaaaaagccauuucaagaagucacauaccauaugauucauuuauauaauuuucucaaaacaacaaaauuaaguccaguguggugacucaaugccuguaguuccaacuacuugagaggcugagggaggaggauugcuugagccuaggaguucaaggcugcagugagcugugaucacaucacugcacuucagccugggagacagaaugagaccccaucucuuaaaagaaaaaaagugacaaaauuagaaauguagaacaggugguguuugucaagacuuagaaauggcagagagagagggaugaaugugaugaguuuuguagugauggaauagcuguguaucuuuuugcaguggugauuauacacaucugcauaugugacaaaaugguauaaaagucuguagacacauugaaucaaugucagugcccugguuuugauacuauauuguaguuauuuaagaugucaccauugggagaaacuagguuuaaaaaaguacaugggaccugcuaucuaugacucccugugacucuauuucaaauuaaaauuuuauguauuguacaugcacuugauuuuauuucuguaaagcaaggcauauaucauuuucuagucguggacauuuuagaaaaaaaucagaacaauagauuuguuuuaaaucuggaaauucauucucugaaguagauuucuuuuaaauccgugaaagaggggaauuaaaugauauaaaggaaauauccugcaguuaauguacucuucugaacugggguuuucaagcggccuuucuuaauacauuagagugcugaaggaaaguagaaugucaguaacauauuugugauuccaagacuuucagucauaagauaaaucugcuguaccauugucccugauuuaauauuuaaauuauaaguagauaaaugcuuuguaaguucuuaaguuaagaaaacuauauauauaauucuuuaccuuuuuugaacuucgauuuuucuaaacuacccaccuguaaaauggggccagcccaucugcuuagcuuugcuugguggaauaugaaaugcuuaguacaguacuuuucguguaguagcaauuuuacagauaauuuaucccagaaucgcgauuuuuaauggcauucuaaaaauggaaauuuccacagauuuuuaucugugccugaguaucuuucuucauagauuuucuuuucuugccaugaaaaauauauucucuagcucuuggccaguaaacagacuauuucuacugucaaucaagauagaaaugaaacaaggcaugaaagcaauuugacucuugucccuuuuacuuucagcucuuaguauuuuggggucuauuuuuuuuuccucucucaaaauuaaaacaauagauuuguuuuaaaucuguuguuuuuaaaauacauauuaaacauuuacucaagcauuuuauaguuuucauauuaaagagagaagaaaaauuuuaaauuucuuaugucuugauaaguauuuaaauugucagaugauguuuacauuaacuuuuuuuuccccucuuagguuuucuucuguuuucauagccagccagaacaauguucuacgcacauuuuguucucaguaaaagagggccucuggccaaaauuuggcuagcggcccauugggauaagaagcuaaccaaagcccauguguucgaguguaauuuagagagcagcguggagaguaucaucucaccaaagguauguuugauguugacauuuuuauucacuuuguugauuguuuauugauaugugaaauagaacuucuaaaacaguuuuuuuagguaggggcauuggagugcaaggaaaauccuuagaaauguuucuuuauuaugugaaguccuuaucaccucuagauagacuugauaugauuacagauuagauuuuaaaaaaaaucucuaagugcauauauuuugauuugccuauuuuuaauggcaaauaagcaucagucagggcaaugcccaaauauuguuuacugaucuguuccucagaggagcuuuuauuugagacccugucucaaaaaaaaaaaaaaccgacguggaagugcuguaaaugcguauuacuuaguauaauaagccaaucuaaaaaggcuacauauuauaugauugcagcuauaggacacucuggaaaagccaaaacuauacaaaugagacaguaaaaagaugguagguuggggagagaauggaggguugaguaggcagagcacagacuauucuuuuuagagcaguaaaacuguuuugcaugauaguauaauaguuaaaugccauuuacauuuguacaaacuaauaaaauguauaacaccacgugugaacccugauguaaacuacggacuuuugguaaugauguguuaauauaaguuuaucgauuuuaauaaaugaaacaccgaugggaggugucaauuguggggaagauuaucugugugugaggaaggggguguuuauaagaaaucugugccuuuucguaaguuuugcucuauuuccuggaugcagccuucuaacaaucauuguguuaguuuuuauguauauacacaaagaaaacuuguguacauguacacaggaaagccuagaaggcauaccaaaagauuauuacagauuucuguagaugguaggauuacagguuguuuuauuuucuuuuuaaagacuagccauuuaguaaacauuucuuguuaaauguuuguucacgcccuuaaguguuucuuaagauuuauuuuuaggauuauaauugauaggccaagugauggacauguuuuugagauuugugauaugcacuaacaguuuguucuggugagaucauaccaguuugcacugcuggucaaauuguaugagaacauugguauuuucaauuuuuuuuauagguaugcuuacugggauaaguuaauggaaaacguagaaaucguacuccuuucuggaaaguauauguguggcuaaucuuuaacauccguaagcaaauauugaguggcuuaaaaggauaacagauuuuuuucaugauauguaccgaguacuuugugccacuuuagggacacuacaaacgaguaugagacaaucugauaauugaacauauacacgaacagccacaaaggaaagcagacaguucaggaauaauguaaaagauuguaauguguuuaugagagaaagugauuucucuucaaauuuuuuaaaccauuucuaacugagcuuuuaucuauuugguaacaggauguaaagauauuuccacagagugaacgggccugaaauuucuaauguuugcuuuggugugcaguucuuguugugaaaaugucaguuuaguuguuuagcauaagugucacacguggcucauuugcaacugcaagcuugcauacuuuuucucuucucucuuccacucccccacuggaagaaccacuggcccuauuugcagagcuuucccagaauauguagccuggaaucuuuauuauauuuauguuuacacuuuaacacacacuagcucaaaaacauaugccauaccucauuuuaccuacuccuaggcuaaacucugaaccagacuaauccagaaagaaagcuuuugcccaaacaccacuuuuugaaaguugcuaguucuagauaagauaauagcagagguuuuuuuucccuccuuuguucuuaggugaagguucaaucaauauuaauuuuaaauuuuauaacaccacauaaaaauagauucuguuuuuccauuaggagcaacauuuuacuuugaauuuuuuuaaaauuagggauucauugucugauaaauucugaauuugaucacaaauuugguauaauuuuggaugucuaaaaauguauggccauauacaucaucauuuaugcuguaagucacauaaaaugcucauaaauacagaaccugagagucauaaguaggguccuagagugcuguagaaaauacacauaaaauuuaaaauacaacauuuucuuuuacaaauaacaauauacuaaucauaauuuaaacauuaagcaaauguuuaaaagcuuuuuuuguuaccuuagaacuuguugugcuuuauggcgugguuugggaaaguaucuggggauguuugaguucauauugccuuguucuuucaguaaauuuuccuuauggcuagaggaauuuugaauacuuguguuuagauggagucuuaucucauuguuuuaucaacuacugcuuuuccacauacuguaucccauguuaauguugaucaagaucugccucgaaaaaagguugggaguauauuuucuggugaaaaaaagcuauggauacuauuguucuuuaucaauuaguaugcuuuccaaacuuuuuuuuuuaaaucgguaugcuuuccaauuaauggaaacuuaguuaaaaaguagcuuaaacaauaagggaaauaacaggcuuaauuaacuaaaauuuuggaaacagggagaucugagauugguccagcagcuugauuaugucauccaagaacucuccauccuuaguguguuagcuuccuguccucauacuuuagcauugugguuuacagggugacugcaugaagcaccaagcaagcccuaccuauucacaaagcaggaaagagggaaggaagagaggcguuguucuuuugggggggaaaucuuucucagaaacucucuggcauacuucaccuauuacucaauuggcugaacuguguuucaugcccacugaagaacagguauuagcagagaggaaugagacaucugucaaugugggggacauuugcuucucaaacaaaaucagaauugacuuagcaagaaacaauggcccuggauuggcaaccaaaaguguuacgugcuccuuaaugugcuaaugacacaauucauggaaugguuuagugcuugcuuccuagcuuccuucauguuuguguuaauucgugaauuuccagucacucugucuuuucaggauauucgauauucagggaauuuauagguaaggacagagaaauguaugugauuauaaggcaacuuuaaaggaaaaagauaaaaagaagacuaugaauggcacgaaaugcagguuuuggaauaugauuaauguuuuauucauaggugaaaauggcauuacggacaucaggacaucucuuacugggaguaguucgaaucuaucacaggaaagccaaauaccuucuugcagacuguaaugaagcauucauuaagauaaagauggcuuuucggccagguauuguuaaacuuguuugguuuuuguuguuguuguuuacuuuggaguuucucauguuuuuuguguuacuguagcuaaacacauuuucuaaaucuacaugcuuuguuuuaauugaaauacgaggaacccuucaaagauagagcaaggcuuggggaggcagugcuucaagggaggaaaccuacuugcgucuguucucccugugaaguaauggagcucacccccauuuguucuuccuuuggagcugccuuuuuaauacuuuuuucagcagcuuacauagacuugagucaucaagagguuaaaauguuggaaacuaauuguuaugugaugauuuuuuaaaauauagcucagaaaagacaauuuuaggauuuuaaacuuuuuuuccuaaguaaauauucuucguaguuuuuuguuauuuuguuuuagguaaugauugguuauaaaacuggagucugccaaccacaccaccaucuaagaagauaauuaauauuuaaauucacauaucuuucuauaauuuuuaaaagcauugaugaaauuuuuauucuaauuaaaauaauguguauuuuauuaagaaaugccuuaaacaguuucuacugaggauacauucuaguacuucaguuuaugucaguaugugaacaguaaaaugucugagaucuaagauuuuauuuaaaaguaaaauauuuagaaaaagacuacaauacuuaaauuaacaugugaccaauaagcacauuuuaucuaaauaacaugcuuuuuuuugucuuucaaaguaaggcauauuuauuauagacaacuugaaaaauauaggaaaaagauaaagaaaauuaaaauuguguaauucuuucuccaaaauaaccagcuccuuuuaacauuuaagguacucuucugcaguuauucuuuuucccccucauaaauaucauguuuaauuaggaaacuauuacuaguuauuuguugauauguccguuuaaacauuuaugagcuuaaugcauaauuagugcuuugacuuuuuccuaaagcaaggaauacaauuuaugagcauggaaaaagagaaguacuugugcuucaagguauuuugcauauguuaucaaccuuucuaugagaauauaaacuuaggaaguuauaccuacuuaucucccucugaucccuagauaauuuauggguagcuagauauuuaagcuuagcauuucuuuucuaggugugguugaccugccugaggaaaaucgggaagcagcuuauaaugccauuacuuuaccugaagaauuucaugacuuugaucagccacugccugacuuagaguaugugucuucuuuuaaaaaaaauuguugacuuggucugcaauaagcaguaguauuagcuuccaaauguauaguuuuccuuggaauguuuuacauuaacagcuaaaaugcauauauauauuuauauaggauaguauauaaauauggaacauaaaaccuagaaaguuguucuucuguaagaaaaucauguggaugucagcuuuaacacagcuaagaugugagaguuuugacaagcuuaggccaaagcuuacguaaacugaaacagauacgcuuguuauauaaugauagcagggaauguaaacuguugcuucaugauauuuuucagaguuauauauuaaagucagcuacuggauuggccaggcuauacucagagccauaauucuguucugguuuguuuuuauuuuuguuuuaaaugaacauacgagauaacuuuuuaugaagagcaacaaagggucauugucaugacacacauuugagaggagagaguuacacagagauggcuguuauagcagaguacuguaguuauguuucccuuuucucaagcccuuacgauccagcuaucaugccaugauguuggaacgugacuguagcuuuccaagugacuuauuagcauaacugacaaccaagaaacucuacaccauuacagauuucucugcuuuuugaaaugaucuguggcuucuaauuagaguaaguuaugaccuauuuuguuacugcauguguguugauuaguucuaggcucuaucuagcuauuuuacuuuuuucucucuuuuugacauuuuauuugaaaauuuuuuauuauggaaauuuuuaaacauagcuaauaacuagagaaauuaggauuaugaaccuuauaugucaguuauucagcuuuuuaaguuacaaguauauugccagucuuauuacaucuguuuccccagcuuaccucacaacccccaccagauuauuuuaaaucaaguaacaauaaucuuauuucaucuguaauaguucgauauuugucucuuagagguaaagaauuuuuaaagccuccaugacccaucacaccuuuaaaaaaauuaucaguuauuccuuaauauagacauaccuuggagauacuguggguuugguuccaccacaguaaagcaaguuacacaaauuuuuggguuucacagugccuauaaaaguuauguucacacuguacuguagucuauuaagugugcaguaauagcauuauguuuaaaaaagcagugagcuuaucuuaaaaauacugcaaaaaaaugcuagugaucaucugagccuucagcaaguugcaguuuuuuugcugguggaggauuugccuccauguugauggcugcugacugauacagguggugguugcugaaguuugagguaacugcggcaauuucuuaaaauaagacaacagugaaguuugcugcaucaauugacucuuucaugggagauuucuuuguagcguacaaugcuacccgauagcguuuuacccgcaguagaacuucuuucaaaauuagagcuaaucgucugaaacccuaccacugcuuuaucaaccaaguuuauggaauauucuaaacccuuuguaguuguuucagcaauauucacaguaucuucacuaggaguagauuccaucucaagaaaccacuuucuuugcucauccauaagaaguaacuccucauuuguuaaaguuuuauuccaagauugcaucaauuuaguuacaccuucaggcuccacuucuaauucuaguucucuugcuuuuuccaccauaucugcaguuacugccuccacugaagucuugaaccccucaaagucaugcaucaggguuaauguuaauuucuuccaaacuuucugucuauaccacugaaacuuucuccauaugaacaauaagguaguuuuguuuucuuauucauguucacuagaguagcauuuuucauuuccuucaagaacuuuuccuuugcauucaaaacuuggcuguuuggugcaagaggccuagcuuuuagccuaaaucagcuuaggcaugccuucuucaccaagcuuauucauuucuagcuuuugauuuaaagugagauacaugugacucuucauuuuacuugaacaaauaguagccauuguaggguuauuaauuggccuuauuucaauguaguugugucucaaggaacagggaggcccaagaagagggagaaacauugcgggggugggggagggcaggagcagucagaacacacagaacauuucuugauuaaguuugcccauauuauuugggcauccuuuguggcacuccaaaauaauuaaaauacuagcaucaaagaucacugggccagguauagugguucacaccuaugaucccagugcuuugggaggcuuaggugggagaaucacuugaggccagggguuugagacuagccugggcaauauaguaagaucccgcccccccaugucuacuaaaaaauaaggaaaaaaauuuuaaagaucacuaaucaagaucaccauaacaaauauaauaaugaaaaauuuuuaaauagcaugagaauuaccaaaaugugacacagaggcaugaaguaagcuugugcuguuggaaaauggcaccaacagacuugcuuaaggcacuguuaccacaaaccuuugguuuguuaaaaacucagcaucugcgaaacucaguaaaacaaagugcaguaaaacaagguaugccuauaugauagccagucagcauucaaauguccccaguugacaugucggcuuuuuuuuuuuuuuuuuucucccaguucgaguugaggcuaaacaaagucuacaaacugcaucugguugauauagcuuaugggucuccugagaaucuauuacagcuuugccgccuccuauuuuuuuuuuccuugccaucuauuuuuuguacagacuuggucaguuguuuugagguauuaauguucuggauauggcugauaguguuuagauugguguuuagcauuacauacuuuuuauuuuuuauuuaguauuuuuaaacuauaugagagauuauucuuuauuagagaaagaaacugagucucagggaagucagggaacuuuagaguuuacaccgccuguaaguugcaggguccuaaugaaaacccaugccuaucuagcccaugauuucuaauuuuuuccucuguacuugauuuagugacuucugcauauuacauuguauuugcugauuauugaugcuuuucaaauuuaaauacaaguuaauuuccaaaucacuuacauucuuggauuguacuggaaugugugaaaguauuaaauauuaaggcuucuaaaacuugguggguuauacauauauauuuuuuuaauuuuucuuauagagagaauugggauuuguuuuucuuauacauagacuugaaacuaaaauguauuugaccuucuuuuaaagugacaucgauguggcccagcaguucagcuugaaucagaguagaguggaagagauaaccaugagagaagaaguugggaacaucaguauuuuacaagaaaaugauuuugguaaaagagaaacaaauuauuagccauuaauuauaauguuauauuguguugcuaauagcaauuucaaaagaaaaccagacuauagacagaaagacuuaaaauuucauguaaugcauuuucaucaagaaaagaauuuggcuuucuaccaguagauuaagcauuauuuucauacuuggagcuaauuguuuaccuacuucucucccuauaugcaaucauagaaccuauauauugauuucugcgaggagucccaacauugaaguggugaucacguuuaaaccaaccauuuuggaacaguuaguuucccuguuauacuugcuauucaaaaacagguauucaaaacuaguuagcaaggcauauuguuuuuuaagaggcggggucucugcuguguuauccaugcuggagugccguggcucuucacaggcuggauuauagcacacuacagccucgaacucuuggauucaagugauccucccacuucagccucaaguagcugggacuacaggcacaugccacugugcccagaaccagauucuuuucuugaugaaacacauuauaacgggaaaguuucagcugugacuguuaauguaacuuaacauacauacauauuuagaguuuaucaaacauauuuuaggaucauuuaaaucuagaucuaaguuugaauuugcuagucaugccccaguguuguaacuguguguaauugagucauuuuaaaaaauucagaugcuaaagaauuaaaguuuaaacuagauauuuuaacauuugaaguaagacuucaguaagcaaaugugacauaauuagaauaaaucauuagcaguuuucuuuuaucacagugcuauuucuaaucuuucuaaacuaaugacaaauuaaaauuuguuuaggugauuuuggaauggaugaucgugagauaaugagagaaggcagugcuuuugaggaugacgacauguuaguaagcacuacuacuucuaaccuccuauuagagucugaacagagcaccagcaaucugaaugagaaaauuaaccauuuagaauaugaagaucaauauaaggaugauaauuuuggagaaggaaaugaugguggaauauuagguaugugggaaugaugguuauuccagcauaaacagaauuucuuuauuaaguuguaaaguuuuggaaacaguugcuaauucugagucuugaacagcuuuuagauauauaugagugaauugugaucaguugguucaauaggacauuucgguaaaacuagccucuuaaaauguuguaacaaaaccuaaauaugcuuaucucagaaugcuaaauuuuauuaguacuuaaaacuguucuguuuguguuugauagcuguguuaaguaaaauauuuuuuaaaauagauaaauaaacuagaaaauacaaaugaagaaugagaauuuuuuuuuauauaccaaguguuuuauacuuuuauaaacuaccuggaggagaaacagauaaaaguugaguauacguuuaaauuuuaucccuuuuaacauaauuuuguuuuuccauugauuggcuguugugguuuggcauuucuuuuucaaauuauaacuaacuuacauucccuauuucagaugacaaacuuauuaguaauaaugauggcgguaucuuugaugaucccccugcccucucugaggcaggggugauguugccagagcagccugcacaugacgauauggaugaggaugauaauguaucaaguaagcauuucauguucagugauucuggggaugauuguauggcauccagaaagauacuuaccauagaagaugacaaacuaaaaguuguaguuuuuagugaauuauaaauaucuuuaaguacagugcuuaugauuacugguucugauucuauguuuaaucuugcaccccuccccauuuuuuuggccaauuggguucaagucuggcggggcuuucccauuaacuagaaaaauauuuuuucuuaguaauaacaggauuucuuuccauuucaugaagagauuuuucuccuccccauuugugggauauauguuauauaccaaagcuuuuugugacuuuuuuuuuuuuuuuuuuuuuuuacagugggugggccugauaguccugauucaguggaucccguugaaccaaugccaaccaugacugaucaaacaacacuuguuccaaaugaggaagaagcauuugcauuggagccuauugauauaacugguaagcauaugaaccuuuagauuuauacagcauacaacauaagguccuauuucugguuuuugccugucuacugaucugcuacuguuguauuagauaacuaggcuucuugcuuuuuucuguuuuuuuggccugucuacugaucugcuacuguugcuuuaguuaacuagcuucuugcuuuuaugucacagucaucugucauagagucuuucuucuauccaauuauaauuuugaguauuuuguagaaugucugugcaaguugcugugaaauacaaaaguauagaacaagcuuucugauaaugcauaucuuagucuccugggguucccagaaaguuagcagcuuacuuguguaacaacuggaaaacauuggaaagcuuuuuucaauaaaguacaauucuaaaugcugugcaguuggucuacgagcuggaaaaaacuaaaaguauucuuuuuaaaaaaaaaacaaaacuagaggcuggugugguggcucacacuuguaauccaguacuuugggaggcccaagcaggaaaaccacuugaggccaggaguuugagaccagcuugggcaguaaauauaguaagaccugucucuucaagaagaaauuuuuuuaaaaauuuuaugcacucuuagaauuugccuuuuuccacacauucugaaaaaagaaauuuuuuuaaauuuaaaaacuggaaaugucaaaauuucuagaauaaucuuuuucuuguaguuuuuuuaaguaacauugcaagacacauuauuuaauuugaggaaggcugcuucugaaugacagacaauuugagauaauggggauauaaaaccuaacaauuucuagaugguuuaugaggacaguaggauagaauacuugaaauugauuacaguguaauuuagacauaguuuuuaccuuuaaguagagcaagauuacccuuuuggguuucccauugaugagggaaaugggcaauuaaguaaaauauauacuguauuagauggugagauuagagagagacucucacuguguaacaucuuuuuguauuuuuuuuuuaaguguugaaccaaaaaccuuugggguaugucugacagggugaaaucuugaggauuuuauuuaaccccaugcgcuuuucugcauuuuaaaaaagugaggcaauacaaccuacuuguaaguuguaaggauuagaaaugacucuuaaaaugucuaggauggaguuaacaggucuaucugacugggcuugggcuuguuucauucuaucaagcagcuuccacaacugccauaugugaauuacaacuuuucuaauaaaaauaacaguauuuacaaucauuaaagaaaacucaaucugugaguuugagugaugggcccuguuucaaaugagaaaaugagcccaacucugaagagugugauauguucauuguuuacaguauaaaacuacauaggcaaaaauguguuggcccuugcgucauuuugcuuauuuugugcuaaaagucuauacauacucauucagcaaauuuuuguugaaugcccguuguguuccagccucucuucugaauggugguuggaaaacaugaguuaaaacguucuauccucaugaaguuuaacuucucugcuagagucuguguguagaaaagcaggggaauauagucaguccagaucuuguagcuguguguuccaugcuggccucucaggaaaaugaucuuauuuuuuauuaucauuccaguuaaagaaacaaaagccaagaggaagaggaagcuaauuguugacagugucaaagaguuggauagcaagacaauuagagcccaacuuagugauuauucagauauuguuacuacuuuggaucuggcaccgcccaccaagaaauugaugauguggaaagagacaggaggaguagaaaaacuguuuucuuuaccugcucagccuuuguggaauaacagacuacugaagguaauauaguuugcagaauuuuuacuucauauacauuuugagcaucuaaaaaaaaaagauucuaaaaccuuugaaucauuuuugaucaaguauuuugcaacuguauggcacauuuucuuuuuucucccuuaaaucacaguguacugggcauaacuucaucugaaauauauggauaagugagaccugcauuucuaaaagauguaaaaugaauuuuccuuacauuaaaaagccacugacguguuuaauaauacuucucucuguaauaaauuauuaguuauaucgucuuaguguguuuuacaucugaauucuugaaauguuuucugaaugaaacaugagugguucuccuuuuuccacaguaaagaauucuggcuucaggagguuuuuuguuguuuuguuuuuuuguuuguuuguuuguuuuuccauuuauaggcucuuuucugcucacauuccacaguauuccaaaauaagacucacaggugucuggugaaugaagcagugcuguuaggcuacuauucugucugaaguugagauaugcacagaaccuauugauuuuaccguguauuuagaauauaguaauauauucuaaaucuaaaguaucccagagcaacaacauugugcucuuuauuguaagcccuaucauauaauuauuuuuaagaagguccuuaaacuauuuauucuuugacucaguaauuucauuauuagaaauuuuuccuaaggaaguaauucaaaguguggaaaagcuaucucugugaaaauguugauuacauuguucuuuacaguuuaaaaagagagaagccugaaauuuuaaaaguagaggaaugguucaaaaugaaauauuauguagccauuaaaaguaguuuaaaugagaccagaagcagucgcucaugccuguaaucccagcacuuugggaggcugaggcgaguggaucacuugaggucaggaguuugagaccagcuuggcuaacaugguaaaaucccgucuguacuaauaauauaaaaauuagccguguguggugguacacaccuguaaucccagcuacucaggaggcugaggcacaagaaucacuugaaccgggggcgcggagguugcaaugagcugagauugugccacugcacuccagccugggcgacagagugagacuccaucucaaaaaaaaaauaguuuaaaugauagcuaauaagguuaccauauguaagggaagaaaacacaauuuaaagcuauuuuguaugagaccaguuaggaugaguuuuaauugaugaauaugaaaauaaacugcaggcagauaaauagaaaagcccuuaagguugugagauaauggauacaguuuuuuuaguuuaucuaaaaugucugcaguuauaauuugaaaacucauuuaaaaucauuuucagauggaaugaaaugugaauaugauaaaagccaugcuaaauuauacacuuauauuuauuagaacauaccuuuggaagauagaaaucaguggugacuuuuuaauuagauuuauuuuauaauugaaauuuuucuuuuuuuuuuuuuuaauagcucuuuacacgcugucuuacaccgcuuguaccagaagaccuuagaaaaaggaggaaaggaggagaggcagauaauuuggaugaauuccucaaagaauuugaaaauccagagguuccuagagaggaccagcaacagcagcaucagcagcgugauguuaucgguuuguucuguuggaauaguuccuugaugaaguucacaugaguauuuggcuuaaaauuuaccuuuauacugucagagugaaagaaaugaggaaucaaagauauacucaaauguuugggcagggaaaugcauuggaucugauugccuuauuuaaguaugaagccuccugucuuuccagaguuuuaagguucagaacuggcaggguagauagucugcuaaagaauuguccuacauuguacugaggguaggacuuguccuuuuaagauccccuuuccccuuuacguauauugcuaaaaauugaguaaaucuuuauggagcuaaaauuuuaucuggccuucuucauuaaagaaagcauuauguaugucuuaguguacuaguuuaaaaaauaaaugguucuauaauacuguucaaaacuguaugaccuauguuuucucuucauaugaccaauugcagaugagcccauuauugaagagccaagccgccuccaggagucagugauggaggccagcagaacaaacauagaugagucagcuaugccuccaccaccaccucagggaguuaagcgaaaagcuggacaaauugacccagagccugugaugccuguaaguaagcaaaucuauccauuaagucauuugaagguauucauacagucaguagcaagugguauuuagggaggccuuuuaaaguaucuugguuuugacagaaaaugguaaggaaugaguccagaggaagaagagcaacaggauauagacaguccacucggagugagagaauauguucugggagucggugcagucuuuccugacucuuuuugaauaguauugcuuuagagugcuccagagugagcauccuugacucugaaguugguucugauuuauuauuuggcaaacauuccugcacaccuucaguacuaggcaguuuuaggucaucuuauuaaguaaucagaauaaacuucaaauaccugagaaaauguaaagcaguaucugucugcuucauucaaacuuugacuaccauugaguucagcuaggauaggaaagcuaagcaaguaugaaggaggaaauaguaggguuugguuuagggcuuuccaaucuuaaguccauagaauaaaugaauuugugcaaagggaggcuuuuagauaaccuuaggcuucuuguucagccuccaucaagaauacucugccaauuuuaagaacuaguuuucugugcccucuggugguaagaguugucaauaagagcauuuuucuguaugagcucaggaauaggaacacaguaaugaguaggugacuuucauaaccacccuccuucugguaauucuuuaguuucuuuuaaagacuuugguuuuaauguucuuaacucuuucuguaaagccugagagaagauauaggaaguggacccagaaaagcaauguccucacuccuauuauuugcugccgugagacauucaagacucucagagagaaagcuuaugauuuauaaguuacaauauaauaaccuuacagaagcuuuaguaguuaaaaagcauuugacuccuaaaaaguaaguaugaaaaugaaacaugguuuaggauaagcagucaguuucuuuuguaagcuacuucaauguaguuuuauaaaaaaucaaaaaagauauauacuguaauaaauuuuuccuuguggggaaguauagagauauaaucucaguauuucuuuuugacuagaaaacuucagccacuguguauuuucauauuuaaaauaagcuacuuuaaaagcauauaucuuaaauugucuuauuuguauugcuuuaagccucagcagguagagcagauggaaauaccaccuguagagcuucccccagaagaaccuccaaauaucugucagcuaauaccagaguuagaacuucugccagaaaaagagaaggagaaagagaaggaaaaagaagaugaugaagaggaagagguaaacuaauuaauaauuuucauuccagauuuagcaaaaaccuccaaccagcuuuauuuuucauauuggggcuaacuuaauugaugcugagcaucagaguuauuuaaaaauguuagaauauaagcaaaauuuuaccauauucuucgugguauugaucaucauuaggaacaucaaauuuuaugcuucgcuguaacucauuggcucucuugugggguuuugaaggacauggaauuguccuuacacugauuucuugcuuggcuucuaaauugcguguagcugcuuuuacuaucuuguggucaguggacgauucuuacugcuguuauugucugcuucugauauaaccuuuucuguaucugugguggccuggaaaucagauaaccauauguuuuccacuugucuggguuuuguuuuuguuuuucuuuuacuuggaccaggguaaagcauaacuuugcuaaaacacuuagacugagugaaggcuuaaaugacuuuuucuuuuuacaaaguaagagguguuuuaggaaucaauuucuuuuuccuggggcauguuuacacuguugaaggucuuuuuucuucuuuuucuuccuaauuucuggaucauugagguuguuguuuaagacuuagaauuuauucuucuguuugauacucuaucggauauguuacuuaaaccuuuaaauuuaaaauaagguguccuuuagguagcauugaagcuguuuaaauuucuucaagaccaaaaaagguuauggauuggauaaauuuucaguagcaucuguucuuaauucuaauaauagugcuuaucuuuaauaugaauaucuuauuuuaaagccaaaauuaguuucagagccacuucuaccuaugugugaggaugugccauuaucucagacuuaguugugaaugaguauuaaaauaguugugguuucuguuauggcugguauauaguuucaccauagccugggaacaucacaacugcugccuugcacccaccuuggacuuuaaaaagucauuuaggcagcauguggcugagaacuagguugcucaagugaaauauauaauaaggaguauagcccauucauuuuaaaacaccauauaaaucaacuuagguagucugcaggcucuuugguacugcuccacaaugagauuaagagucugccagaacauuagucaucuagaaaaucauguugcaauauuuauguauguauauuuaguugaaauaaacaguauauuuagugguacaguugauuuauauccugaaguucuuuaagaggggccaguaaccaaaaccuccaugaucagcagcaguccacagaccacauaguguguguagauagcauccuuauagcgcaauauagaagcauacuuucagccaaauguuugcuugcacauagaggacuuugccuuguaauuuaagaaaaacagacucuucaguuuguacucuaaaugcuaagugauugcucagcagcauuaaguacaguuuucuauuaguucaaaauacacaaucucaagguaauuuaggagcuuuuaggagauguagaaauacuucauuuuucauuggacuuguuuugucagcuuuuugggggucauuuuuauucaggaugaagaugcaucagggggcgaucaagaucaggaagaaagaagauggaacaaaaggacucagcagaugcuucauggucuucagguauugccgcuguugucucagaggaaaaugcuucaucaaaggcuuuugccauuguucccugaaaaaaaaaaaguuagaugcuggaaacagaaagcauaccuuugucaaacuuuuuccaaaacuacauuuuuauuuauuuauuuauuuuuucuggagggagaguuuucuuuucuuuuuuuuuuuuauuauaguuuaaguuuuaauuaaauacauaaacuguuaggccaagaguaagccggaaaagcauggaggagaaugcuugugguuuuccugaaaagcagaaccauggugacauaccacacaacuccuuuguaugccugcaccuucuuguuuuuuguugaguaaauuuaaugugcugaaucauuaaauuuauugggucauuguguagcaucagacguuacuuuuccuugugcuuuaauguccuagacauagacaggauaucuugaaugucugcaaaaugccaagcaaguugcucaagguuucuuaaaauaggacaguugacauguguuuauuaauuuuuuacuuuaaaaacuauaagugcuagauuuuacuacuauauuacauuagcugucuaaagaaauugguuauuuuaauaauacaugucagaacaauuuugcugguuucuuggacuuucuuauuuggauuuuagauguaccauaacauacuuuggccuuuuacccucuugauuaacaugagaaucacauacuauuuaaaaaagugcaaucuuuguccuaagcagaauauauaguuuguuuuuuccaguaaccaaaauuagcaucuguguuagucuguuuuguguugcucuaaaggaauaccugagucuggguaauuuauaaagaaguuuauuuggcucacaguucugcagacuauacaagaagcaaagcaccagcaucugcuucuggugaggccucagaaagcuuauagucaugguggaaggcaaagggggagcaggugugucacauggcaagagagggcaugagagagauggcuaggcgcuuuuaaacaagcagcucuuguguuaacuaacgagcaagaauucacugauugccacagggagugauugauaagggauccaccaccacccccauccccaccccaugacacaaacaccucacuaggcuccaucucuaacacugggaaauuacguuucagcaugagauuuggaggggacaaauauucaaacuguaucagcauccucacugaauuacuacuuuauuauacagauuaaguuacccuuuuuugguuuuauuucagcgugcucuugcuaaaacuggagcugaaucuaucaguuugcuugaguuaugucgaaauacgaacagaaaacaagcugccgcaaaguucuacagcuucuugguucuuaaaaagcagcaagcuauugagcugacacaggaagaaccguacagugacaucaucgcaacaccuggaccaagguuccauauuauauaaggagcuagaagcauuauagcuaguguuugauucacuagugcuuacaaauugcccccauguguaggggacacagaacccuuugagaaaacuuagauuuuugucuguacaaagucuuugccuuuuuccuucuucauuuuuuuccaguacauuaaauuugucaauuucaucuuugagggaaacugauuagauggguuguguuuguguucugauggagaaaacagcaccccaaggacucagaagaugauuuuaacaguucagaacagaugugugcaauauuggugcauguaauaauguugaguggcagucaaaagucaugauuuuuaucuuaguucuucauuacugcauugaaaaggaaaaccugucugagaaaaugccugacaguuuaauuuaaaacuaugguguaagucuuugacaagaaaaaaaaacaaacaaacacuucuuuccaucaguaacacuggcaaucuuccuguuaaccacucuccuuagggaugguaucugaaacaacaauggucacccucuugagauucguuuuaaguguaauuccauaaugagcagagguguacgcgaaauuguguuaugacugauagccuucagcuacaaaaagauaggacugaccugguuuaaaguguucuauuuuguaaaucauuccauuugagucuuucugaugaacuuggcuauacugaaaucuguuauuuuagugaggcuccaaaaugagcaaagcuaggccugauuagaguagagugacuauuaaaaaacauaacuuucuaggagcuauaaaucaaaguuuuaaaaagauguuuggauauauuugaguauuccgaucaugaaaacagaaauugcccugccuacuacaaggacagacugaugggaaauuaugcaccuggucaacuuagcuuuuaagcagacgaugcuguaaaaacuaacggcuucucugauauuuauuguaaguuuuaguacugaucuccuuuuccagugcugcacacuccugguuuggaacuuuaauagcguugcaacgaaauccuauauccaguuuccuguaauuuaauugaagaaaaauacauccaaauaaagacuuuauuauuaacagaccagauagcaucagaaaucaugugacuguuaugauuaucagaaugucuuaacuuuuuagggcaaaguuaacacugaaaguucuagcuuaaguguugaaacuuuugugggaaaaaaaaaucacuuuugaaacucagacuucaguguauacccaauaauuuaaaauuaugugaaauguuuuaaauuugugaacucguaauuacuguuuuaaugauucaguuucuucagagugguaauuguauaaaauugcuauugcagcuuuacauucaauaugaugugccuguaaaccaaggaguuuuccccguuuguaaaaagacauuguagauaauugaauguuugauuuuagaaaggucauuaguuucuuguuacacauuuuguuagucugguuuuuguugcuuaucggguuuaauauuguucuugaaaauaguugaugcuauguuauguauaacuuuucuaauaaaaguuguguuauaagcuguacuuuuuugaguauucauuauucaguugguggugguccccaagggaaaguuggcugaaaaaguuaauagagccaaacacuucguuuguuugccuuaucuagaauaguuauccauacaaaccaaaugaauuuuu

SEQ ID NO: 17771 - RNA, 3128 nt, Homo sapiens
caguaguauuuugccuuugaguaacuguccccagcuccagugcugcaggcacauuguuccagggccucuguggugcuccugaugccccucacccacugucgaagauccccggugggcgagggggcggcagggauccuucucucucagcucuaauauauaagguaaggaggacccugggauggaaggcugggguuggagcuuucucagacuccacugugcugcugcucaaggggaauaaucacuuucuuagucuucuggcucuuagccuaggccaguggggggacugugaaggacucuuucagcugaggcuguugcauggcuuauugggaauacuagaggagagauaucagcaccauuuguugccuuuuaaucugcuguaauugaggcccagaaguuaguuuagcuucucacuaagacugggauggaagguuagcaaggcagcugaauucugggcuuuugagauugugcccaagggagauaacacggacccugcaguccacuuggaaucagacuuuggcugacuggggcuccagccaaacccucauacauacccucauuuguuuuugguauuucccuuucugacagggaaggaaaagaacaugguguugggggaaagcgugggcuuucgagucagggagaccuggguuugaaucucaucucugccauucacugucuuuggagccuugggucaguugcuucauuauucucagacuuaaaguggaguuguuaauuaccaucucaagugcuugucaugaugauaaagguaauauaugggacagcacuuuguacuuggcaccuaguggacaauuuagguaaauauuucccuuucuguuuugcuagcuuuuaccaccaucaacuggucuuagugccuggugagugacagcuccuuuuagccaucaugaagcucugcguuuucagcauggccucuaucccacgcuacccugacacuggccuaaggggacucccagcaucgccuagauuagggaguggaugauauggccagaagcaguagugaccugguccucugcccugcuuuccuucccaggacgagaagcucacugugacccaggaccucccugugaaugauggaaaaccucacaucguccacuuccaguaugaggucaccgaggugaaggucucuucuugggaugcaguccuguccagccagagccuguuuguagaaaucccagauggauuauuagcugaugggagcaaagaaggguaaagagccaaaugcuggggagggaaaggaggucccauuccagagaagaguauauguuuacuguggguaacagaauuguaggggagucugugccuucucccuuagcucuagacuccccaagcagauaccguuuuguaacagguuauuuuuagccaguaagacaggccugcucuagguuauaauuaaagcagauuguuaucacauuaaccaaaugccugccgguuaaucgccccaugguucacucugacacuaaaucccccuguagcuacacaguacuguaguuuaaaaggcuaggaagcaaaaagaaguacuuaggcccaucaccaccuuccuagaccucccucccauucacaccccacccaggaagcucagagguaagugggauuucauuggauugggcaaagacccuccaagcagccaagauggguaagaaauguccugaggacagaguuccugaguggucccagccucuugagaaaauccuuuuaggcaguguuagagcccagagugucccucucaguggcaggugaucauaucagacuuggcaaucugugggacaccugaagaacuggguuuucuuucuaggccccagacucugucuuguggacagcauuaguuaagauggguaguguuacuuucagaucuccuauugcaggaagagaaaaguuaguaacauuuuucucaggcgcuguggcuuuuuuuuuuuuuuuuuccaaaauucaaggcucuuggggucuugacauaggaaucuuccuccuggagcuucugaauuuuuuuuuuuuuugagauggaggcucacucugucgcccaggcuggaguggaguggugcgaucucggcucacugcaagcuccgucucccagguucaugccauucuccugccucagccucccgaguagcugggacuacaggcgcccaccaccacgcccggcuaguuuuuuguauuuuuaguagagaugggguuucaccguguuagccaggauggucuugaucuccugaccucgugauccaccugccucggccucccaaagugcugggauuacaggugugagccacugugcccagcccagagcuucuguauuuauauugcugguuguaggccucagaaaagccuuuggguugguagggguggggguggggugugaaugggagggaggucuaggaagguggugaugggccuaaguacuucucuuugcuuccugcagauuguuagcacugcuagaguuugcugaagagaagaugaaagugaacuaugucuucaucugcuucaggaagggccgagaagacagaggugaggagucagaguggccugagccuuacagcccagacaguggggccugggggagagaagggagcaccuccaggaugaggugggacucuugaauuugccuuucaaacccugggaaaucauggcaggagggcaagugccugaagggcucguaaaagccuagugcuuauuuguuccaucuuuguuugggguuuugauuucagccuaccauuguguuucucaucagacuuuuuuacacucugucuucugcagcuccacuccugaagaccuucagcuucuugggcuuugagauuguacguccaggccaucccuguguccccucucggccagaugugauguucaugguuuauccccuggaccagaacuuguccgaugaggacuaauagucauagaggaugcuuuacccaagagccacagugggggaagaggggaaguuaggcagcccugggacagacgagagggcuccucgcugucuagggaaggacacugaggggcucagggugaggguugccuauuguguucucggaguugacucguugaaauuguuuuccauaaagaacaguauaaacauauuauucacauguaaucaccaauaguaaaugaagauguuuaugaacugg

SEQ ID NO: 17772 - RNA, 313828 nt, Homo sapiens
cagcgcugucgugucgggaauggaauguguaaguguaacauucagaaccggguaacauucggcgaccgaacgcggcggucggcagcguucgcgcgggggccugcgaagcgcugcucggggccggcacugcccgcggggaggacgcgccgccgccgccacccagcgccgccgccgccgccgccuccagccgggccgccgcgcgucccgggggccggccccgcgagcgcaggaguaaacaccgccggagucuuggagccgcugcagaagggaauaaagagagaugcagggauuugugagguuacggcgccccagcugcaagaugcacuagccggcugaacccgggaucggcugacuuguuggaaccggagugcucugcacggagagugguggaugaguugaaguugccuucccggggcucauuuuccacgcugccgagaggaauccgagaggcaaggcaaucacuucgucuugccauugauuggguaucgggagcuuuuuuuuucuccccucucucuuucuuuuccuccgucuuguugcaugcaagaaaauuacaguccgcugcucgcccgcccugggugcgagauauucagccccgcucucucccgugcauugugcaacccaaagaugaaagaccgaaggggagaaaguuaaagaaaucgcccacaugcgcuggaucaguccacggcuuggggaaaggcauccagagaaggugggagcggagaguuugaagucuuuacaggcgggaagauggcggacuggagcugaaaguguugauugggaaacuugggugauucuuguguuuauuuacaauccucuugacccaggcaggacacaugcaggccaaaaaacgcuauuucauccugcucucagcuggcucuugucucgcccuuuuguuuuauuucggaggcuugcaguuuagggcaucgaggagccacagccggagagaagaacacagcgguaggaauggcuugcaccaccccaguccggaucauuucuggccccgcuucccggacgcucugcgccccuucguuccuugggaucaauuggaaaacgaggauuccagcgugcacauuuccccccggcagaagcgagaugccaacuccagcaucuacaaaggcaagaagugccgcauggaguccugcuucgauuucacccuuugcaagaaaaacggcuucaaagucuacguauacccacagcaaaaaggggagaaaaucgccgaaaguuaccaaaacauucuagcggccaucgagggcuccagguucuacaccucggaccccagccaggcgugccucuuuguccugagucuggauacuuuagacagagaccaguugucaccucaguaugugcacaauuugagauccaaagugcagagucuccacuuguggaacaaugguaggaaucauuuaauuuuuaauuuauauuccggcacuuggccugacuacaccgaggacgugggguuugacaucggccaggcgaugcuggccaaagccagcaucaguacugaaaacuuccgacccaacuuugauguuucuauuccccucuuuucuaaggaucaucccaggacaggaggggagaggggguuuuugaaguucaacaccaucccuccucucaggaaguacaugcugguauucaaggggaagagguaccugacagggauaggaucagacaccaggaaugccuuauaucacguccauaacggggaggacguugugcuccucaccaccugcaagcauggcaaagacuggcaaaagcacaaggauucucgcugugacagagacaacaccgaguaugagaaguaagugucugggcuggcgugucuuugggagucagccuugggcucugccggccuugguccaggugugaaguugggggauggggugagggcggaugagcccucaguccucuuuccccuuugagccuggaacugagcaaauccgguucgggugugcagcuagaggcuggggacagagaguuggagcuccucgggcaaacugaaaagccuggagcaccuucucgagccaaguaggugacaguaucucccucuugcuuaggaaaccugcagggcggcgugucuccuguuaagagucgggguuagauccaaguuuaguaacugcauuucaggcauggguacuggaggguguuucugaggguaucuagagacccggagaggcugugaucuacccaaaguccagagaccuuccaccaagagugaugcuuuuguuugcuuuucucaugagcggggguaccuacuuucccaggaguuuucccaacuucacauuuucuguaagccuguaauucauguuagccguggaaauguuuaaauuguaucgaacuuuguguggcccuuuccucucucccccguggcauugacuuuuaugaagggagacuguaaacuuguugggccuguggcuuugcaugcaugcaugcaugcaugcauucauucauucauucauuuauuaauucauucauuucuguacauguccugucucuuuccuaggauaaacuuuuuuuuuuuuuuuaaaugugggccucagucucacugucuaaacuccaguugcuaauuuagauuucccguucccuuuuuucuuuaucuauuugcauguaaauuguagacuguuacucuuugaaugggugugagaugccuccuuacccucuguagugaggcaaguuuuguccaguugcuaaguaacugaauugguuacuuuguagaccuuuucacucuuccuuuuuccuuccccgugacaguaacugacacgggauuuggagucaaagcuaaauuccacaaaucugcuuuauccugagcuugguggaccaguuuccuaguaggugggguugccgcccagacucucacuuacaucuggcugugaaagaguuagugaguuccuacagugcauuuccacguuacgccaguuaaaaaccagagcagccuugugcuacccagggaaggaaggggaaccucucagcugaguacaagaggaacuggcagagguuggcagauuuugcaauugauucaugaaaugcagaauaggggaaauguuucgcaaaccugauuggaacaggaagggguauggugggaaacuggccuugaaaugaaagguuugauugucgucugugcauuuuuucagacacuagggccucuauaggagugauuggaagggaaauuaaaguccuccaagacuugaucauagagagugaaggagaaaguaucaagcacucagauucagcuuuccaacccccaauaccuuuugcuuuucaggcauaagaaaagccggagacuaagaucaauuaugaauccauauuuuccucucauccaggggcaguuauguaugaaugugcaguugcaauggauuacaguuuucucauaaaagacauuuaaacuaugguuaguaaugaacugcuuuguuuauacgacauuuacauugaccuauuccugugggugcuuguaagaaaaaaaugcuuauagccuuucaggaauuucuuugucugguuuaugguggaguaacucgagaugaagucuaaccuuucagugucuucuaaagcagucucaaagaauucuguggaaggauucuguucuucauccuucuaaaagggcuaaagcugagauuucagcuuaggaaauuugaauuauauauauuggaaaauacccuuaauccaagugaauaauaucuuucuuacccuuuuauucccaaaauaaauauuacguuucuacguuuucuguggaauggaagcauuuucuagagaucagcaaugaagggagggguugguuucuuuaaaacuuuaauuuuuacuaaauuuaacuaauuuuugaccucuuugugaucgggccaagaaauaugacacccacacuuugguuuauguuuaaagaccacaaggggucaggaccucaggauugggucugaucagaaaaguggcauuucguagaaaagcaaguuugcucuuucucccaagcagggaucucuuuagcagggacacuucuggauuuucauuauguuccccuuuggcauaccuuccagcccuaaacuugcauguagcccgggauggugcugcgaaagguuuacauucacucgccugguacaccuggaguuuugacucauuccucugaguggguuagcagaauuauuugucuuugagaaauggugcuuacaaacuuuauugccauuuauuauugguuuuuuggaacacaugaagaugaagcaagaacucucaaauuuggagauacgcuagcagagcaagcaacgugugucgugcucuggcguaagagcaacuacugugcuacuuauauugaugcuuucuggaagauggccuuagauaugugagaugcagaacuccucaagucaagauaugccagucucucuagcguuuuggguggaggcgauauugaaguuaggucuguagacgugaucuguguaaguuugacuucucauacugacucauggugugacuuuugauuagucaccuugagcauuaguuuggguuuugcagaguggguuucagacugcuucaggggugcucuaagcacucauuugguaauagcuuguaaaaacacaaucaguuuccaucuagcuuauuagcaaguguccaugggaaaaaaaaagcuucaguuuaauuugcucccucaagcaaucaccuguaaguuuccuuuggagcaaacuuuaugcagccugaugacuagauugaaaauuuaugguauuauggucaaguuagaguauauacaaauauagaguauauacaaauguuucaacuaaaaaaagguugcuuuuggugaaauagaauauuaugugucgauaaagaauuuagugcuaaaagagcaaugacuucugucucaccugugccuuugugaaaauuagacguugauuacaaagguauagaaaagcugcaaggaaugaaagaaaauacuuuucucuuguaauagagagaaaauaaauuucuuuugucauuuuuugacccagacguucaggauuauauuaaaauaucaauuuuuaugauagcuguaauuauuuuuuaucaguuauauauuuuaacacauguggauaaugccagcuaaaacaagucauugcaguaauuagaugaguuguagugacgcuuuagagaaauucuuuguauuuuauguucuuucagcuacuuaugcauccuuauagaauuauuguacuuuugcaugaacuucauaguucacaucccuacaaagggcauuauugugaaacuuuagauucagcuauuugaaauagaagaaagagagggaaaggagagguggcuucuaucuuugacccccuccaaggaaagcaagggugaauauuuaaagcuuuucuggaaacaggcaagauugugugcaauucuuuuugguauuucccuuuuucuguguuugcuaacacuguaccucaccauccugguaucuucaagggucuuggagguaagugaucauucagcuuccaacauccugauuuuuacagauguagaaacugagggacagaacguuucagggguuugcuuaaggcaagaaaauuguuuagugacaaggguagcaccagaaugcaggcccccuuaauuuugccuugaucugcagucuuucauuucuauucucaggcacccuugaaaauucaccagccacaaggagauccuuauuaaugguguuuguuaugggauuucucuuagaauucuucaguaaucugaugaaaacuuggaggacaaccuuugcaaaaauaaaugauaaguaaauaaauaaaagcauguacacaauuuguuauaugguuucaggggcugacacacaccucccgcugagggcauccucagacuuacaaacucuugcucugggaguuuacauuuugccuguuuguuuaguuggguaggucuguggagcuguuuagucuaaguaggaguuuuuugaaccuuucaauuuggcccuaagggguuuagggaauagacugugcauugacugaacaauaaguugaauuacaugcacuuacagcaaaaagaaaauaugugcaaggcaaguaaaaaugcuaaauacuuuuuucuuuuuuuccucauuaucccaaacuguauuaacagacaccuugagcaaguucaugauccagcagugaaccuuagaugaauguuuuccuucuccaaaaugaaaggugggaauugagauucucggguuuuaaauguaaaauauuagcaccuuucuccccacaguuguacaauagcacaaaagcauuucuaacauaaacccaauuagcacaguuaaaaaauaagguagggccagcccuauggaaaauuaugaaguuggcaaguuugucuucugacaccgagauucugauucucuccuuccuuucucgccucuuucuaaaccugcuuucuggagagcaccugagaaccucaaucacaaggaaucccugaguaaauguugggguguuauuugcuacuuucagggacauuuguauuauuacugaauucagccuagcaaaugaggguuuccaguggagucugugaucuaagcuaggggccugcaggauuuuacucuacgaauaauggcuuguuacuaagguuugggcagguccugcccauuggaggccaccuuuggucacccugacucugacagcaacuuuggauggcaaaaggggagaugcuacaccugcaggugguguuaguucuuucugucagaaggcuugaggaucugccuucucagaacacagugcuagaaacuccugccaauaaugaccuuuaauaugccaaugucacagcagaaguugugcuugguagggccuggcugcuuugcucacaaccaucuugaaggugucuucucaggcuauguugcugguguguaaacggaggcaaacggugguaaggugacuugccugaggcuacgcagccuguaaguggcugaauugaggcuaaaacccagguuuuauggcccgaguugucuguucuuuucacggagagaagaacauucauugcuaccucacugcauucgcuuugcagcacugcauauucagaaugaaccaggugagacaaaguggucauuggcuucugcaggcuucuggacauguuucauguucaaacaugaacacagaagcuuauguuuccaugagguuaauaacuacagguugagcuucccuaauccaaagguccaaaaugcuccaaaaucugaaacuuuugaccacugacaugagcauuuuggauuucggauuuuugaauuagggauguccaacucuaaguauacaaugcagauaucucaaaaucuaaaaaaauccaaaauuugaaacacuuuuggucucaagcauuucaagcauuuuaggccaaguccuucucagccuaaauuguguauuugaaacaagguauuuucugaacaagguguuugagaaguagcuauugccauguaauaauuaccuagcgcuuccuucauacucuggaagaagaaaauagugcguuuuuuuucucucgaggucauaaugugaauguuguaugcaguggccaugucaucagaacaggugugccagcccccugcauggaacauguacaugcuucagguugugcggaauuaacuuucuuuagauaagggauaacuagcauucauuucagauaacagauauucaaccuauaauuguuuuuauuuaaaaccucuuccaccuugaccaggcuccuguaauaaacaggauucccuccagacuagaagauuugcugaguaccuguuauuugaauuuacuuuuauuaguucauagaaccuuucaacaacagugugaguuagguuauauccccauuuuacagauuagaauguaggccccugagacaguaaaguaacaagcucagugucacaucuagugagaaaauggcaggguuccuaccuggguacuuagauuccaaaguccauucucuucuacaaaauguuaccaucuuaaagaaucaaacagaguuucucccuguuacauauuaacuuuuaauacgugaagcgugagucagguguuuguauauggaucuuuuuuccauugcuuuacuuuaugaacauguuucccgaggaaaaaguuuggcucagagaugucauaaagguggcuccuaaaccugacauuuaagcacugaacuccuucaacucuucuguucaaggggcauuggaauuguuucuauguagauucugcuuguaauucucuccuaggguucuucuaagaaaagugaggaagcugauuagcauucugucugugugaccuuuccccuacugauagcauccugcagggugucccucugugauuguaagugaaagugaacccuggagaugucgcugcagguggauggggaucagagugacugcugccccagguagacacugugauccaauagaauagaaaugaaaggccuaugggaauauucuguuucuggaacauaccacacccaaugccuccaggaccuaaggcucuuuaaaagaaaaacagugcuuaaaaaauuauaagcguuauacacaggcugagcacaguggcucaugccuguaaucccagcacuuuggaaggcuaaggcgggaggauugcuugagcccaggaguucuagaucauacuagccuggguaacacagugagaucuuaucuuuacuaaagauaaaaaaauuagcugggcaugguggugcacaccuguagucccagcuacuugggagacugaggugggaggauugcuugagucugggacauugaggcugcagugacugaugauggcaccacugcacuccacccuggacaauagagcaagaccuuaucuuucuuuuuuuuugagacagaguuucccucuuguugcccaggcuggagugcaauagggcgaucucggcuuaccgcaaccuccuccucccggauucaagcgauucuccugccucagccucccgaguagcugggauuacaggcaugugccaccacacucggcuaauuuuguauuuuuaguagagacgggguuucuccauguggucaggcuggucucgaacucccgaccuucggugauccgcccaccucggccucccaaagugcugagauuacaggcaugagccaccaagcccggccgaccuugucuuucaaagaaagaaagaaagcaagaaaaaaaaaaguaugcauagccucuguggaagauugggaaaauacagaagauuggaauacauaauuaaauuucuuuccuaauucuauuauaaguguuagccacuauugguaaacuuugauguagucagucuauucuagcacauauauauaccuauauguuuauguggcucugucucugcauauccaaguacccuggauagauagguuaauuauuauuuaauuaauggugaguaaauaaugaauucaacacauuuuucuuaagugucuuguuugugccagacacuuauguauuggagcuggggcuacuucagcaaacaaaacaaacuccuacccauucaccuuaccauucuagucugucaguuuuguaaaguugaagucagacuuuaaauguauuuuuggauguuauuuuuuuuccuaacauuauccaagggcauuuuucuguucuaguaaauuguuuggaaaauaggauuuuuaaggugugauuuuuuuuuuuuuucuaacccaugguuggaccagaguuuguuuaaccauuuacauuuucuuacauauauuuuauuuguuuauuauuauuuugagacagagucuugcucugucacccaggcuggagugcaguggcgcgaucucggcucacugcaaccuucgcuuccuggguucaagggauucugcugcuucagccucccgaguagaugggauuacaggcacccaccaccacacccggcuaauuuuuguauuuuuaguagagaugggguuuugcuguauuggccaggcgggucuugaauuccugaucugaggugaucuacccaccuuagccucccaaaguacugggauuacaggcgugagcuacagcacccagccuucuuacauauuuaacuuguuuuuuuuuuuuuuccucauuagaaauagucuguaauggguuucaccuuguugaguguuuucuucuugacuagggucucucucucaaaacacaauauagaacuuccuguccuguccucccuaacuccccacuccaaucccauucugggcuauagcuguuuuuaaggugaacacccauuuagugaaguagccaucauuaaaugacugccuagauaaacauuuguagguguuaauugguccugccagggggccuuugaagcuccacugcucuguucucuuugaaguuuuguuuuucuccagccaaaauccucccuggucucuuacugagcagacaucccuagacuucacuccaagcacugugcauauaaccuugccugggauuucagaaucugcaggccuuaccuagguagauguuacucuucuagcuaauuguaugcaguuuaucaaggauuuguuucuguuuucucuuugguuguugacuccauggaccauaggagguaaauuuggacaggucgcuuugaccucugggcaucuaaguaaggccugggauuuuaaguguaaaggaggcacuauucuaagugauuuaaaaauggacagaaaaggagaaauuugugaggauacacagccucuuuuuguguacccuuuugucuucugugaagcccuuuaaaagggagagccuguggcccugcaccauaacaguagcugaucccccaaaguuccuggacuagguuuuuaacuucucagccucaguuuccacaucuggaaauggggaucauaauacuggucucauagggucguuaagaaggucaaaugagguggaguaugugagacuguaccuuguaaacauuaauguguucuacaggguggugguauuauuaaacucaucuuccugcuauuuccuaaucaacaacagagguucauuuaguuucgaaacuuagcucuuccuaacuaagccacagcaauaacuuaucucuacuuugauacuuaaguccucaggaaauugugguaggugcccuggaaguccagccauuguuucuguaaagaccuacaggggucuucaagcuggggcuugcaugugugugggguagggguggaagcaguugagggggaucccuggggcagucagauacuuccuugacuccauggccuucagguucccagguugacugcucuauuaaugcaggugaucucuuuuccaguugacuuuuuuuuuuuucuuuuugagauggagucucgcucugucgccaggcuggagugcaguggcgcgaucucagcucacugcaaccucugccuccuggguucaagcgauucugcugccucagccuccugaguagcugggacuacaggugcaugccaccaugcccagcuaauuuuuguauuuugaauagacaggguuucaccguguuagccaggauggucucgaucuccugaccucgugauccaccugccucggccucccaaagugcugggauuacaggugugagccuccgcaccccgccuccaauugacuuuuaaguccucgccaguugaggguaacauuuggagggacaccgugugugaguggagcucagcuacugggaagccucccucggccgguucagcaggcccuuauguugcaaagagccgaaaaucauuugggcuaccuuaaguuuugggauuuauugugaggggacauggggcagaaacugaacugaaacugcucucguaaguucucaggacccaccacaauaccugggccaggcuccuuuguuccugcucuaugccuucaugucuugcuuggcuagcaucucuggcccugugugugucuuccaaccacuggccagucuuuccugaauucucucguccagggccuggaggagaccagucggauugacuuuuccaguaagcauugcuugcuggggagagccauucauauuaggccacgucuuggguaugguggugaccuggucagugaaacgacugcccugucauguugccacucuugauuuacuugguggucauccucuugugaaaacagcccaaaguugcuuccugcaacagaggacugugguuaggggaaguuggcuguggcaggcgcuguugaagccauauccuguuggcaugcacauauuugaccccaguugaugaugaggauaacagcaacagcaacucauaucugagggcauccuaugugaggauaacagcaacagcaacucauaucuaagcacauccuaugugcaggguaaugagaaguaucuucuuuaaucuuuauguccaccuagcaggaagauacccauuuuaucuccauuuuacagaugaagaaacugaagcagacagucuuuaaaagugguuugccuaagagcauacacauagcagaugaacugaggcccucugacuuuugaaccuguguccuuaaccacagcaccguacugcuuuugaacagcuggaacugaugucauaaagaccacacacucacaaacaauaguaugauugauuucuagaguaucacuuggauuucuaaccuagaauuuauuuaaucuuacguuagacaauucuaaccuguuagguaaucugguuucucagccugcaguagauuagaagcaguacauuuaaaaaugaaagagggauucuugcagauaguacugggaagaaaggacagcugguaacccaaauauaaggaagugggccaggaaauuauaaaauguaaugcccagaagaaguaaagaaccauggcaauugaagaacagcuggcccaaugcccaagaauguguucuacacccuccucaggaaugaaugugcuuccaaguccaacaccuacugcccugccugucaccaagcacagcuucuguggauauuugaugaacuauaacaugguacaguauuggcucugaaacaucauuuguguucacuguccuuuguuuaagaauguagaaaaagaaguaauguguuuuauaacuuuuuugaaaaccguaugauuaauaaaauauacugauggucuuaagaguaagaucuccauuugaaaacuugucuaccaacuuuagcaauuuccgccaaggcuccagagagacagggucuccuuucgguuagcauuugauuucugcuacuuguugcuaacucugauuucuggguuuucaagaugcauaucaguuuaaaccuaggugaaaugguaaguuuucugauccugugguguaggccuguagugcuagcuauucuuuuuuuuuuuuuuuuugagacagagucuugcucuauuguccaggcuggggugcaguggugcgaacucggcucacugcacgcuccgccucccggguucaugccauucuccugccucagccucccaaguagcugggacuacaggcacccgccaccaugcccgacuaauuuuuuuuguauuuuuuaguagagacgggguuucaccauguuagccaggacggucuugaucuccugaccucgugaucuguccgccucggccucccaaagugcugggauuacagguaugagcgagccacugcaccuggccacuguguuagcuauucuugauggacuaguaucuagaaugacuugggcugugggcucagguaaagagaguagcuagccuagggcuagggcuggcccugccugccuaaggcguggcauauggauguuaggguuuggagaagggaggggcccaggagggaacaagggacaucucgucucuuguccuaugguuguccuggcagguauguugggcauuucacacuccuagcgggggccuagcuuggacguguagcaggcacacuuccugcacacauuucaguguccugacggauugguagaaaucauccacagugccacugauagaaaauaugaucaccacccugcuugaaugggccuugggggugucucauaguuaauucacauguuacuaaggcaggcaagcucugccugccuucucauccccagccccagggcagagccacacuccuccuccuucuccccgcuuuccccacacaccuccuuuccacuuucuggaaagccagcacccagcugcaucugacuucuuccagagucacuuccuugaugccucagacaaggccaaauucuccugguaugugcucauauagaacauuuaacacccagcugugguuuuccauucaguuagcuguuuguuugucucucuccaguagauugcacagaaccugaggggaggauucauguugguuuuucauugauuuacucaacagauacuuauugagugccuacggugugcaggcacuggggauucaacagugaauaagaaggugcacguaccugccuucuagaugcucauagccuaguggcuggaggcugaggaucauggcauacacauuuugucauauauuagaaggugcuggaugcugugaaguaaagcaacguauggaaguggguuaaggcagugggucucaaccuuaacuguacaguagacucuccuggggagcuucugaaaaagccaggccccaguccaggccaauuagggaugaaguuccagauuuuauuuauuuuuauucauuuauuuuuauuuuuuugagaaggagucuugcucuguugcccaggcuggagugcaguggggcgaucugggcucacugcaaccccuaccucccagguucaagcaauucuccugccucagccucccgaguagcuggaauuacagauauguaccaccaugcccggcuaauuuuuuguauuuuuaguaaagaugagguuuugacauguuggccaggcugaucuugaacuccugaccucaagugaucugccugcuuuggccucccagaaugcugggauuacaggcgugagccgcugcacccagccggccgaaguuccagguuuuuaaaaagcucaccaggucguuuggaugcaaaguaggaguggggaugaggaagaauuuugcagcuuuaaauauggagggaaagaaaggccuccuugggaaaaugacauugagcucucguaccauuauaccuucagagccucagcaccaugcccgacugacucacaggaagcacucaguguuuguugcauaaaugaaaaaaauuuacauuuauuuaaccgaagggaauguuacuacuguugauaugguauauucaaaguauggagucucuaaauguuacugucuuugguuuguagcucaggcauuccuguuccuacuccaaguucauuguguucauuugcugguucacccagaguuucuugucauguucaaaugggaaguuucucccaaugaaccuuuuuuuccccaagguauccuuucuuccuuccuuuccuucccucccuccuucccuccuucccucccucccucccucccuuccuuccuuccuuccuuccuuccuuccuuccuuccuuccuuccuuccuuccuccuuccuuccuuccuuccuuccuuucuugacggagucuugcucugucgccaggccgcaguggcgugaucucggcucacuguaaccuuccacucccugguucaagugauucuccugccucagccuccugaguaccaccacauccagcuaauuuuuguauuuuuaguacagaugggguuucaccauguuggccagcauggucucgaucucccgaccucgugauccgccugccucagcgucccaaagugcugggauuacaggcgugaaccagugcaccuggccucuuuucuuucuuuuucuauuuuuacuauuguguuugauauaaguaucacugaagccaaauuaaaaugaaccaaaggguuuugcugcauaacacaaauccaaauaauuuauugguacaggaaaaaacauuaugaucuuuuuaucauuuaacagucuguagauauugaaacuucccccccuuuaauuguaguuuuucucccaaaagauugauagaauaaaacuuuuggcucacauuuuuugcucagguuacguucaaacucugcuaacugauauugaagcauugccccagagaaugcaguaacacagggcuuaauugagcuaucaggcugcuaaugaauucauauugagauuuaucauuuaauuaaaaggcaaagcggggaaaagcaaagggaagguguacaauuguuccuuccgcuggccuccauuuccuccauuuaaaaucguggcuuguuuguuuaguuuguagaauccugugggauauugcauagaaguacucaaggugcauagguaaaauagaggguguccuguauugcaaugacuugacuucuuagugggucuuaaaaauugauucagauuuggugacaaucauaugacacuugauuaaguagaaauuauguuuuaugauguuuuuacaaaagauuaggaaggccauuuuccaaaauuauuccuaggucuguauaucugaagcaaucugaaaauucaaucagagggaaucuaauacugagaugcuuuugcuuuacugacagagaguaaauuuuucuugaaaacaccauuucuuauaugcuacaugugucuuuaaaauucacaccugcauugaaaaagcuaccuuuaagcaacacuuuuuaugauaacugcauuuuuaaguaugcaagugcaauguugcaaaccugucaaugcagggcagucagucuuuuauugauucagaguggaaauguauaauauuuuuuguauuuagauuauagaguuacauguuuuuaaaaaagaacaguauuuuaugauaaguuaaaauuuaaguaccucaaugcuuaguacgguuaaaagguggaguaguguuuuccugcacuuaguuuagacuuagcuauaucuaaggaguaacucaagcagggauaacagagggcaaaaggauuagaugucaaaacaaaucuuagguuucuaugaaaauaagcuaagaaaugagcccccuuggaugaaaaauaugaagugagaauauagggaguguuggugagguuugaaccucuuugggccucaguuuuccucaucugauuuuccuacacagagaccucugauugaagcugucacaucuguacaugcacauguaugucugcauguguguuguauguuugcucagggaggagggcaugguguucaacugacuccaaauauuugauaucagacaguuuugucuggagagaagagcaauaagauuguggaagugauccuaaaaucuaguuuaacucuuguguagcguagacaaaaaguagagauccagggagguugagcaauuugcccaaggucauguaguugugaccgaauccgaaauggaacacacgucucuugacuuccagcugaggauugcuuagagguuacacauaaggguucugguuugaauucagauggugacucugucacuagcuacgagaccuuggucagcuucccuguuuccguucuucacuuguaaaauggagauaacaauuucaacuucauaggguugcuguuacagggauuaaaugaguaauaauacauguaauaugcuuagaauagugcauggaacauaguaaacacucaauaagaaacuauuguuacugucauuauuauucugucuguuccauuaaacuacauuugaugccuguaacuucaggcuuaccguuuguauguguuuaucaugguuuuaauuucauuucuuucauuugaccuguuuacagcucauuauaauuguagugugcaauauuguacauuagcuugccagucauauagaagcuccuggugguuuggcaagugcccagaauuccaaccaccuguuggaacuguugccaaaauacaguagauuuuuauuucccagauguuguucaaccgagaguacaaaucauuaauaugacuuugugucuuuaaaaaaauucguucuccuauuacaaaaguauuauguuucccacuaguucugugaagcugagcagucacagaggucuuguuccugccucuugaaaaaacauuaaaacggguagcaaaugugcugggggucggucaccugagauagcuuucagagauaaaccugugcgagauagagaagggaaaacuauuuuucuuuucuagcaauccagguagccaagcaagugauuccaccgugcaggggcacuuagcaaaucaggaagcgcgauaacagugaaugacuuucuacuuucaacaauuugaagggcugcuaacaacugauggcuucuucuugaggauggcauuaucaguagcagcaggacccagaccucugcaccguuucugcauguuaaguuuaaacaguguaugccuauccuugaggauaaacuuauaacagggccaagguaaaacuuagagaagaaauucuagccugugauuugaagaucugggagcauucagacauauuggaacuuaaguuuucauucuuuuucucaggagacaaagcugcaauuaugaauaaacacauuguaagagccuuucugugauaccguguuggccaccaaauccagaugugaucugauuccuauccaguuccacauuguagcaggcuuugcugucauugggucaucuguguuccuugaaacuucaccauauccaaaaaaagcauguuagaacaggauuaaauucuucuuauacauuacagaauuauacagaggguucucuaacauccacuguucaaaaagagacucuggcaaaugguucacuaaguauaaguaaagugagauggaaugucugaucccaaauuugauagugcuuggcucaagacaggaagcaggguauguauguuaugcacaaugaugauuauaggccuguauuuguauguggaacauguauucaaauuucaaaucuuuuuuuuuuuuuuuuuuuuuugcugggaauuuuucuggagcaugugguguauauuguuuucugccaagcaucaaggggcuguuuuauaaagggcuuuuuugggggguggggggaguguauccucuccuuucuuuucccaaaguuuucuuguaucuucuccacaaaauaaaaauuucuuucuucuaguucacugacuuggagauucaagcagcagcacgauaaaaauaccauauugcauuuccaaugaacuccuuuaauuagaugagaugaauuaauuggauuuuugggacaugucugugaaaguauaagauacucacuuuuggaacucccaggcaugguguggccugggagcuuucucaguuugcuccuauucaggacaugguguaagaacugucauuugaagccugucauuuuagucccccuuggggguuuuacaaauggccuagugauuuuucagauagcagagaauaaaucagcagugauuuggccugcccuucagccuagggcauucccugguuaucaccagccucaucaucaggugcuuguauuacacguuuuucuguccacaccggcaggugagaugguaaucuaagaguugauuuccaacacgugcggagggacuuucgaaagucccccuagucccgguauucucuugcccuguauaauuuuagggguccaggcauucaggcuuggaucguccuccuuaugucuuucagggccuuggaaaauucuggaauuuagacaggggcaguaagucaguggcuguagcccuugaaucccauuugggaccuuaacucauucuaccuugcauuauaauuauuugguuuuuaacugucuagguuucuguacuuucagggguaaagcugauucauucuccucuguaucccagaguccaccuccaaggugguagguugcuugauaggugcuuaguaaauaucauauuugauuaacuuuuuguagccuccucuuuagucuagaaauucuagaucccaaauagaagguaagauaugguauauucuggacuuuuaguuuucuauaucuccuuuucaaauacagaccuagggugacagacaaaaaaauauugugaucaaaguauauagcauuuccuuucaugguggaaaaaugugccugauaaauguuuucucugcauuauuuuccuccaaauauauuuuaaugacaguuauuuggauauuucacacuuuauacucgacuugggcucagauuaagucuuguguuaguuauaaccuugaauaacaauuagguucaugagaacagggaugguguauauuuguuuuuaaucuguuucccagcacuuaacccagugcugaguuuauagugggucuccaagaaauacuuguugaaugaguggcuuuuggucaugguggccuuuuagugcagaaaaacuuuuggaucugaauuguuagauuuacuuaauuuuuuuguaauaacacagagaauguugaauagaaaaaguaaguuuagaagauacauauauauauagagagagagagggagaguuagauuuauuuauuuauuuauuuuugugagauggagucucgcucugucgcccaggcuggagugcaauggugcgaucuuggcucauugcaagcuccgcuucccagguucacaucauucuccugcuucagucucccgaguagcugggacuacaggugcccgccaccaugcccggcuaauuuuuuuuucuuuuuauuuuuaguagagacggaguuucacuguguuagccaggauggucucaaucuccugaccucgugauccgcccgccucggccucccaaagugcugggauuacaggcgugagccaccgcgcccggccgacuuauuuauuuuuuuguaauaacacagagacuguugaauagaaaaaguaaguuuagaagguauauauccauaucucuauauauuuuacccuccuugagguucgaaauaguaggagugaaauuagagauuuaccaaaaucggaugaugauuugcaccuuugaaauaacucaugccuuugauugucacuuuagcuacaaguagguuccuggucauaacuguaauaucccuacaagccugcuuuauggaacuugagcugcaucguauugucuaagauaggccucgguucuuggccgggugcaguuuauguucuuugaaacugucuccuuuuggggagcaggcugagagauagugaacucauugaagagaauuguagcggaacucucuagcaacuuccuaauagaagauguccccuccuugacuucuuugguguuucagcugccccauugaaggaagggacagacugugcccuugggaccagagccuccuugcuaacugucugcaaaugaaugaggcaccagcaugccaugcucagccaaccaccugugguacaaaacagcuuuccuggacucugaucccuuaguauaaaccuguguauacaggauucacaaggauauaauucuguggugucaucuaucaggcacaugcuuuuuuuuuuuuuuuuuuuuuuuuuuuuuuugagacagaaucucacugucucacccaggcuagagugcaguggcccuaucuuggcccacugcaaccucugucucccaggcucaagcaauucuccugcaucagcuucccgaguagcugggauuacaggcacccgccaccaugcgcaguuaauuuuuuguauuuuuaguagagaugggguuucaucauguuggccaggcuggucuugaacuccugaccuuagguguucugccugccucggccucccaaagugcugggauuacaggcaugagccacugcacccggccagggacaugcaugguuuucuacagaguggcuucagcuuccacgguucaucccuagacaauuuugccuuuuuuuuucaagacacggucuugcucuguugcccaggcuggaugacaguggcacugucauggcucacugcagccuugacuucccagggucaagcaauccucccaccucggccucuggagugccagcaggacgugugccaccacacccugcuaauuuuuuauuuuauuuuuuuagagaugggaucucccuguguugcccgggcuggucucaaacuccuggucuuaagugguauuccugccuuggcaucccaaaguguugggguuacaggcaugagccaccacuuguggccuacuuggcucuuuuuuacagguuuuugguugacacuucucugcagaauagcaccuggcaccucucaccaccacugaaaaggauggaauuuuauacaccucuuuuuccuagguucucucuagcaguuaccaagggaccaucggagguacuuauuguggcuguuuacaaaagccuugccuccagucugagucaccucacccuacucucugcuucuuccuuuuagcuacucuuuuuuucaguaacccucccucuuuccucugaaggcuugugcuugcacacacaggcagacauacucaugcacgcgcacaccacacaugcuuccuguccucuggcucucccguauccuauguaaaaccuccuacugucauuuaagugaaacccuucuagcacauaagaguuuucaucucagaagcucaauuuuaccuuucacuuuucagauagagaacacccaagguuuuuaauaaucuggcgaauguguuaaaaaaggacauauuuuuuaaaaucuagauugcaaaaguaauacuguagcauuguugaguucagacauuauagaaagugaaaguucccuaucauuuguuucccauaaccaccuugaauaguuuaguggauauauuuuauucuaagcacaugcuguuuaucuucuugaaaacaggaucauggcauagauauacucuuuuguaauuucucuuauuagaaaagaagauuaaucauauaucaaacacgauuccaugucacuccauauagaucuuucccucauucuguuuuuacagcuauaagggagucugcugugaaaaugcuccuucgauuaguuuauaacugaguguaaaauuuggcauuucacucuugauuauagucuuuuucuguauauucacccccaauucuuugagaaugaggaguacccuaauuuuguaagcaaaauuuuggggggcuuuggggugaaaacuaauuuaaaugcuuauuuucucaguugccuaccuccauuuaaaaaucaguuuugagggcuauaaaaaaaccuuaugauauuaaggccuuuuuuucuguauaaaaauaacauacaauuuauuuuuuccauuuauucaaaagacugaauuacacuagccaagaaaugaucagucucguguaaaagaauaacacacguucuccuugaaucaagacuacucugagauucagaaaugccaguagcggaagguggggugugaccccuuaaguaagugugacuaguuaaagguguauggauauucuuuguggaaagcgggcugccagauacaauuucaggcuguuucauauuacuucacacggugcuuucaaacuguuuauuuucucucuuggcacuagugaguacagcucauaacuggccagauaauaucuaagucuaggaccaggacagugaauggguuuuaccaugauuugaucaaaaguaaacaagaaaacaaaagcagaggaaaaaaaaaaaaaagagaaggcaucacauuuuucucauuguggggcuaaaaugcugcauguugaauuuucacuuucugauuagaacccacaguugaacagaucugauuuauuuuuuuggggucaggaagaaacugucaaauuuuaguuugacuguucuuuucuuuaggucuccccccuuucuuccccuaccuuuuuuuuuuuuuuaagcauuacuauauuaaucagauagcagccacuguuugacauguccuucugugguggcugcagauuaagucugaaccgugccagaaaucucguugcauuuuuugauguagcagaaaugaaccugguucauuccaucuuaacagcuuuagccaaauggcucagaagggaucuacccgauuucauaaagaagaguuaaugugcagucugguuuaauacaggugcccuuaaaauacauuuuuguuuuguuuuguuuucucacuuccaaguuuaacauguccauggacauuggcuuuaguuuccccaagaugaguccaugaaugaccuuguuccaguaucccuugcugauuugaguucccaaguaauaagccugggaauguuuucagugcagcagccgggagaagaagggggauucagcaguugcuguucaaugcauuuacucucuaccugcuggcuucaaacaguauuaacuuuaugugcuccuugugcauuguguuuaauuaaaagcaguucucuucacagaggcacuuguaggauuuuuuuuuuuuuuuuuuuuugcccugaaacgaauaaaacaaauaggcgucugguauuuguuuuguauaacacaauccccauaaaaugaagaguaauaaaacauaauuaucuguaaaggcuuguuuuauaagccugagaaugggcuuguuucuaccagguuuuuauguucauucauaggagaaagaaucucuuuguacauuaauauguaacaacaauaagaacaaaugcuucccaauuacaugcaugaaucaaacuuaucuuuuauuaaaaaauuuuuuuucuguuguaguaaaaguuugucauuaaauucuuucuguguaaacacauuagauugaaggaaaauguuuuccuucaauauucuguucaacuggcauaacuuuaugauuuuuuucuccccagcauaauuaaagaaacaacuuuaugguugguuauugacuuuuuuaggucagagagcacucuguggauucuaaaaccgccuuccagaaaaguacacaucaaacuucuacguacguuuuuauaggguuuguagagcucugauccuugguuaaagaucccugacaaugucuaauagcuguuuugaaaacuguaccuccaaucugaagcuaagguuuuaguuuuaguuuuaguaugugaauaucugaugaaacgauucaaugguuuuguagcauuggauucaauuucaggguugggcuccuuucuaggaauagaggaauauucuuaucucaggaaaaaaaauucagagugugggaaguacgaaaauuauuaauucaaagguguauuugcugucagauuggauggcaguacccacaucccuaggggcuccuguucccaagacuguuuucauuguuucuauccagcgcugggcacgagccuugaaguggcgaauucauccucugaaguuguguguccauugcugcaagaauaaaagaagcaguaacagaaucaugcagcgcaguauuucauggugacaguuuuaugugguugugugauguugcagagucuuguaggugauaucuacccuuuucuuuugaaucaaaacacgggguuuuacuggaggagggaaguuucagaaacaaccuagucuaacacaaaauuaagcuccuaaauaguuaucccauucugucuacuacaaaacuaauugcuuacaggaaguagaaguacacauaucuaauauuuauauccuguuugaguagugguuucuaauuuuagauuucuaaccccuuuuuacauuaucuuuuugcauugaaauuauacugaaacauucauauuauuaugaaugcaagcugaauuaaauagaccaagauucucgguuucucccuucauguugucaucuacuagagaaugaacagcuuaaaauaagugcaucaguuccucauccaaagggaagcugaauauuccaauucaagaucacuuugcgugcuuacuggaaauaccauuuuugaacguacuuggcaacuuaaagugcccaauuaaaagcucuguugaaagaggaagucuguggaugugcaauuaguccuuaggauucagagcauuuccuuuauguguggaaggccauaauaugaaaucacuggucacaauagcuuuaugccaggugcuuagacuagaaggcauuuucaggauggauuauuucuguacucuugcuccuaaaaugguuuaccuaaagaggcucccaaguccauaaaaauacuggugaugucaagaaauuuuggagguggccuuucacaaauuuuaggcagucaauaaauauaacuagccauguacgugauaggcaauacacaagacuugcuuauauuccuagacuuucuauuuuaucugauugacaguguuccucuucccaccuuuuuauucauuuauuuauuuuuaaaagaugaggauuggguaccagaaaauuagccaguauugugugcuuuuccuuacuaaaaaaaugaggccucgcugaguagggccagaugagcuguauauucugagauuauuuauaguguuuaugauagagagaccaaaaacaguaagcacuuaauagcuuuccuuauuuacaagucagauucaucuaagggauauuuuucuuuuauuuuucuggugcuugaaauguuccuuuaaaauagauuaucagaggauacacagugacacaaaauuuguugcuugugaaaaugcagaguggauuaagcuuuucuuuuucaaggcucugcaacaaaacagguacauuuuuauuucaguaaaaacacugcuuuuuuuuuuugccuccgucacacacacgaguaacauaggauagauauguguaugugaacauguggcucuuguucccaguuguguaauggaugcauucccuuaaaguuugcaguaaagugaauguuuauuaagcaaauuguuuuuccccagugacuucuacuguaaaaauggcauugucuuucaguaggcucugaauauaguauguucccauauucuuugguaagaugaccaaucaaccaaaaaaaaaaaaaaaacaaaaacagccccaauaacaaacaaacaaaacaacccuuuagguaccauaaaucuauaggaaauacuaaccuucugaugaagcuggcccgaugccacuuauuguugucccccacgccuaagcuaugguauauggcuuuaauaacaaaauggcaacacacaauaguaccacaaccuggaggguguuacucuuucuucugcucacccuuccucccauuguucccaugggagagaggacagacaccaaggcuguagcaaauagguuauuuuaauaaccucagcauccuuguuucuauaugauauacauuugauagccaaguugaauuuacccaccucucucuaaacacuuuuuccuaacccuuugucaauuugucacaccaucuuuggaugaagagugguaccugaugguguaugaugcuuaacaaucgaaacaucuguaccuuguuagccauaaaggcucaucccauuuccuuccauaaacaucuauuguaauacaauauggauuguguaaggcacugggcuuuaggcccccagcccgaauaucugucaucuauuaaguacuuacuguggauaaagaaggcaguauacuuaacaugcacuauuucaucuaauuuuugcaaaagcucuuugaguacauuaggccagucuccauuuuauuaauacggaugaggaaagugagaccaagacuugaguucaaugacuugcccagagucgugcaaagcauaaggggcggaguaggauuugaacaccgcaugaacugggcucuggaaucaaacgcuucccuaaugccaugcccuaggucucagccuggacugugcucccagagucacuuaagcacuuuucaaaacacugacauauguggacccagcauuucgaggagcugggcucugggcauuuggguuuugaagguuuuacaagugacccugaugcucugucaggcaggcuuaauaacgacugaauuauauaacaugcccagcuugguuucuugcuugguuguugaauugcugcaugaaaaucugaucccugcagucuuugagccugcagcccagugaaagagauggaugugcacacaaccaagcaugaacaagaugcauuaugacaaguacuaugguaguacagacuuugugcucugugauaauuccuaugacacgacuugcaguugaucccaggagguagcaucugggacauagucacuuuagcaaguccuauuuauucuagcuugggagaguuccuugcaucuuaacucuguauacucugugaucaccagacagucuuggucuagguuauuauaaaaguccuaguugaggaucuugaaucucucccauucaguuugacugagagagcuuggugauuagaucagugguuuguauauuaccucauuugucuuccaaacuaauagauaaguuccucaggauccacuccagugggauuacuaggucaaagauaaaucauuaccagacugguugaugguaucacccaggcuggugugcaguggcaugaucuuggcucacuacagccucugccucccggguucaagcaauucuccugccucagccuucggaguagcugggauuacagguguccaccaccacaccuggcuaauuuuuuauauuuuugguagagaugggguuucaccauguuggccaggcuggucucgaacuccugaccccaagugaucugcucgucuuggccucccaaaaugcugggauuacaggcaugagcuacugcgccccgccucccucuuuucuuauugagacccauugaccaauagcuuggucaauagugcuugauucuugaguuuagaaaacuucuauugagcuucuuacuauguccuggggacugugcugggcaguaagaacaccagaaaggguguggcgucuuaggagccuauuaaacuagauuaggaagagagguguugaggugucaccuagggcauaggcagagaaccugucugccuaaugauacuggguuuaguucuugaauucuuuauauucagaauauggauuagggccaggcuggccuugacaaccugaaucauuaaacacuuauggugacuggugggugauuagccacauaagaagaagauauauucauaacagauauaauaggagcaauggggacucgauggagaguauuaaauaguacagugucuuccauaaauguucuuuaauuguggagauuacuguucuguagauuauucacucaggcauugaguaugcguuuauuaagugcuuuuuguguccuaggcucauucacaagucuaaacuucaaauuugguucuuaaauuccucaagaccagaguuuagcuaaaaguaucauuauauccugagauggaauuuuaucaaauuguaugcuuaaaaugaggagauaugucuguuucuccaucucgcaagccccaccaguuuaacugucaauuggucuugucaaucaacuauaagagguguaaaaaugucuugggcuauaaguacauacuccagggcguauccuggugacagagauugagaaacugauuggaagagaguguaaucaguagugcuggccuuacuguucugaaauuucugguuucuuucccucgcuccaaacuuaauucuuucuucucuauuuucaauuucagaagaaauuuagaaugagugagggaaauuaaaaugaaguccagaagaccagcagagauuucaccgggcauguggguaggaaagacgugugagaaaaccauuugaaauggaauuaaaagaaaacguguucagcucacuauauaauuauaguuagcuuggccugguguuuuggguugcauuaccuguaaguuuggaacucauuuguuguauagaaauugauaccccacauuuacuuaaauuuugcccaucuguuucuuguuaaaagaaacuggacaucugcuaaaauauccuuguuuuggauuacucaaucuuauugucaccuuauaaugguuuuauuuugggggagguuuauucguauuaguaugauggggaaagaacagaaagaucuuauuggaaaauaaauuuagaauuuuccaaauaauaaaaucaaaagauuuccagccguaaucuuaagaugccuuuucaugaugucuaguuuuagaaacuuuuuuuccucucagaugugaagaacaaugcuuuuuaggacaauagugaaacuuacaugagaauuguucuuuuugcauuguguuauggugcaugaugcgaaaguuuagaaauaaauauaucccuggauacaacaggccucaguuaagacuucagcuauuuuuaaugcauuuuguuauuuuuggccuggcauaguaucuuaggaugagaaaauccauccccuuccccuagucugaggucacauguugccaucaguucucuguaauggagucaaugauguuaugguuuuaaaauaacgggaaauuaacauuucuuguccccaugauuguggccgcaggacuugaucguuuuuauacuguuaaucacacuccucuuuuacaagaacuccccgacucuuguuucccccagcaguuaaaugccauauuuucauauauuuaccuuauaucuggcuaaaaccuugcaauuuuuuguuuugcucucgguuuuugugacaauuuuaagaggaaggcaaauaauguacagacuggguugaaagaggagaaaauggagcaguuguaauuccccggggcaggguaagagacuguuaauacauuagugguaggagggcuucugcagaaaauacgacugcacaauuaaauggggcuauuaaaagcacgccagcaucaauucauuaaaugacaguggcaauuucuuuguaauccccuuuuccccaucuccuccugggacucaguauaugcagggaugaaaggcagaugggcaaagaucagaaagacuacugaggaagagguacaguuauuuagauaucugcuuccucaucuucuuugggggcagcuucugugaugaaaacacuuuaugaaagguaagacccccaaauaccuguucuguagacauuggggaugaaaauguacauccuagcagaugaucugguucugcauuccagaacacugcucugacuuuagaagcaguuaucuaugcauaguauaucuacuuggagcuaaaacaaagagagaaauuguuugauugaaaccuucuuauugcaaaaguaugcagaauugacauucagcaaucuuauguaaaaauacugcaaaauguuucuuuuucuggaaaacaguguauuuuaaaaaucaguuggaaucugguuaccugcaugaccuagugagaacuucaaggcuuggggaaaugguugagguuagugguuaugaguauuugauauccuuuugcgugucauuuaauugucuaagcccccauuuccucaucgguaaaauggugauucugguaucugucuuuuuagugcugcucuguaaaauuaaaugagauacugaaugaaaagcauuuugcucagugccuggcauaagauaagugcucccuaaauauuaacuaguuuuauuauccauugaauuuuaggacuccacccuccccccuagcccuccaaaagaguuaauggucuuaucugccugcugaagaguaggguuaugaggaagcugagacauggagagaugauguguuaauuagugaagaaaccagaaugggaaccacauuuuaugacuucccacugcauugaagugccucucauaguaugagacuucuguauuuaguaaaggagggccaacacuugcuccaccuauuauaauagaugagguaugcuuuuuaucuauauacuuaaaaauguaguuuuaaguucauugcucagguucuuucgguggcaaaaauccuugcacuuuaaaaggcauuauuauuggccgaguuuuaaaagaacuaccuucagagaaaaaugcauuucauuuugauuaugcccaacgccugcagaauaccauuuaaacuacaagugauauaaaagguuaaguauuugauuaaaacuaaucuccuuuaaaaacuaauguuucagucuccaccagaacuucuucagggaacuucaguguuuugcugauaacuggauccaauuuaugggagguaaaaaaaaaaaggcaguuauuuacuuaauucaucuauuaguuuccagacuugauauauugaaucuaaagaauggugaaauuaauagauaagagaagaaguuugagugguuaaaaaauggaugauaucuccuauuucagggaaacaguauuugaucagauuucagggugguacgaaguucuuguugaugauaaaaggcaagucacauuuaucagcugaacaacucagaaaacacagaugaucugaauuuguggaggcguccuccauaccauuuucucuauugcuuugaugauugucugaggucucuaccaaacagauacucauauucauauuuccaguucaaaucccuguugcauugugaacucuuugggaacagagaccacuuuugccuuuucaaccagugccuagcagggugccuggaggcauuagggaauguuuauugaauaagggaaugacucacacuguaugccaaaaucuggcuucccugaguuuauaugccucugguaaccuuuuguaaaugacaccuuuucuauaugauuagccacuucuuucuuucuauugaaguuauuucuuauuuccaaguaaaucuuguugcagccauccuccuccugacuacauccaaugugguucauguuuuuucuuuucuuuuuaauuuugggaggggugugaagugcaagauagaacauaaugugggcuaaauccggggcuauucaacuugacuagggucuuuggccuuccagaauguugagaaacuaauuaguggguggggugggggugggggcgguguuagaagaaauggcugggauucuuuguauccaaaagaauguuucuccuuggugaugaggcagguauugucaccccucugaauaaauccuuaggcaaaguacaaaaacaccagccggcugaacaaugccuggccacucuggccuuaggauugcaauaccuuacggguaaguuuagaaaugaguuuccuguucagguuuuaggccugucauacuguugaguggcugucuaaccuuugaacuuucuguguuuuugacaucaaaaggaacucuaagcuuuaccaaaaagguuuuauucgaguaauuaauacucuucaugcacagagggaaauuagccuccaacuuguggacauggugaaaaauuaguaucuucccauuugcucggcuuguuugaacuauaguugauuauuuuuaaagauaaggagaucaaauuuccuuaauauuucaguauguugcuuuuuguacccuuaaaauuauuuuuuccuaugcagaauugacuuugauuaaaaaauguuuuugaugacuauuuuccugauucgucaguauaucuaauuguguucauuuuacucaugaaaaaucuugucuaugagggacguauuuuuaguaacauuuuuauagcauauaagaacuuuuacagcaaaaacaggaaucauuaagugugugugcuuuuaucauaacuucucuuuuaauggaacuuaaaaucuuaacucguguuuuugcagcacuuuuuuugcacaugguagguucuuaauauuugaauggaauucagugugacuguucuuuguguucucaaaagucugaucuuuguaacaauuugucuuucacuugagacuuuuuuuuucuuugcauaugugcacgucucacucuugguuuuccuuaaucuuuuuuaacuaaacacaucuaugacucauauuucccuauuuaugaauaggagcaauuuaaaauuucccaacauggugguaugugauguaacauaaccaaaggcuacauguuuacccuuguuuaauuacccuucauuuguggaaagaugacguauguauuuaugauguaaaugucuuucagaaugaccuuugggacuaagcuuuuuuuuuuuuuucccaccaaaaaauggucaugaccuaggaagccuuguuaguaaaauuuaaaaaggaaaaguuggcugggcaugguggcucaugccuguaaucucaacacucugggaggcugagguggguguaucaauugaggucagaguucgagaccagccuggguaacauggugaaaccccguuucuacuaaaaauacaaaaauuagcugggcaugguggccugugccugugaucccagcuacucgggaagcagagacaugagaauugcuugaaccuaggagguggagguugcagugaguggagauugugccacugcacgccaaccugggugacagagcgagacuucaucucaaaaauaaaauaaaauaaaaauaaacaggaaaaaucuggucaaaugccccuuguucuucuucaacagauacauagugaguuguguaaaaaaggaguuggaaaaggaauauguagauucaaagugacuuaaagaauagaaaaaaaauuuguuuuaaaaaauggccaagacuaaaucauagugucuagggagguacaccugaauaauaaaacuauaaagaaauacaaaauaugauuacuacuaagaauagucuguugccaguaguacacagaaugagcacucaaauuauaacagaagcauuuugguauucauaaauguucuuuuuuuaaaaaagaacacaaucgaaauuauaauauaggcuguaaguacugauuuuaauuguagugaaugugaaaguguuguuaaugaaaauauaaagaauauuuguuaaaguguggaccuagccaggaauacuagguagaaaagguaacucuuuaaaaacauuuuuuuaauugugaaguuaauuuauugucacuuuguuugauauuuauuauuagagucccuagguuaauucuguuuuuauugcuuuucagaauaauuaagaccuaaaucuucugccgaauucuguuugguuuccuuauuucuuuugccauguucuuucauuccacaaauguuauugagcacuuccaguguaccaagccuuguguuuacugcuuugaugauaaaugcaauaagguaaugcugcuuuuaaggauccuucaggauaggcucuuguagcaguaaggacuuaguauuuuugcuauagaaguguauggagagcuaucuauggugcaauaacuguggaaauacaguuuuuauucuauuugguucccauauacauugaguccuccuuuggugggaauuugaucagguuggucucaguugaauccuggcugcauaugccucaguaaggaagaaggccuaggggacuguggaaagccugguggugguccuggaaggcuugagaauaccuggagcuggaagcuccuugcucauuggugaccuuuuucauaugcagcagagcucuuggcauuccuagcauacuaccuugaaaggacugugucuugccuccuagaaauucuggacuugguagaaucauuuguuuauguuauuuuaaaaagaaaaaaaacucugaaauguacuuuuuggaagaaaaaugaacuuguuuuuggacuuuucuguguguuguuucuuuaauugaaaauucugucuggagauugauuuucaacccccuuccuuucccucuaguuuuaaauuguaacauugcuuuccaagcauuucaaaaaaacaacaaaaaagaaauauuuuauuauuacucuauuuuuauuugcucauuaauaauucuugauuuucuaucuauaugaaaucaaagaaaaauuacuguauaauuuucauccaguugcagucaauucuauaacugaaauacaagauaaaaaauaaguaauugauuuacuuaagaaacaaaggcaucucgaccuccuaaaaauuucaucaaauauucacucggcagacccuucuuuguaauaggagcucacuuacuauugugagcacugacagugugagcacuuguggcagggauuggguuuccugaggaauucauaagauacuugcauugcuucugggcaugagggugaauaacacagccauuggccuucaaggccuuugaggagguguucuacggggagaggggcugagacagacauauuccugaaaggaauaauuacugcgugauaguggaaauauacacaaagacuuugggaguaacagugauggagggacccauugaaaacuuacuaacguuuacagcuguuguuaaaauucauccaaaccagccaauuauaucuacauucucuagaaugaaaguacaaaaugauuacaguggauguucuaaacaccaguguugacacaauccccuuuuccuacuggaauggggaucuaauggggaaagugaaauucuuucucaaaaccuuaucgguguugauaccuuacauguacauguaaaagcagcugacuuuguguuuuguggccuuugagaucauauaacucuuauaaagcaacuuacaaauuuucugggagguucuuuuggaauauugcuuuauguuuuguuuuaggaauauacuucccucuccccugaauuaucucaguggggauauauaaaucuacucccuauccaaagcauaaccauguauguauuuguuuucucuuuaucauaugauauaguuuggauauuugucccccuuaaaucucauguugagauguaauccccaauguuggaggugggguccggugggagguguuugggucauguggacugauccgucauggcuuggugcuguccucaggacacaaugauuucccaugagaucccauuguuucaaacugugugaaaccucuccccuacucucucuugcuccuucucuugccaugugagaugccuguucccccuucugccuugacuuaagcuuccugaggccucaggagaacccgagcagaugccacugccaugcuuccuguacagccugcagaaccauggccaauuaaaccucuuuucuuuauaaauuacccagucuccaguauuucuucauagcaacgcaagaauggccuaacauaccauauauaaacuauaaaacaaaaaaaccaaaacccagaacaaugacccacugcaguacaaauaauaacucuuucuuccaaaggaacuucuuucauuguuuaaauaaugagaaacuugugucguuagaaacacuguguagggugcagcguccccucauuacaaacauuucugugccuuagaggacacuccuccugcuauguauccuuaggaggaacacauagaucagccucucuuccuuuuguccagcugcaguaucgggaauggagacacaacacggucaaggugccuaaaacuagaguggccuggggugagucuagacuugaucuucccagauacugucccuugucagacuccaacacugugcacagccuggucucucugggcccaggaauuugggcacuugcccaaagauuccuuugcaggugcuccuggaaaucagagcaguguugaagcaggauuuaaagcaguaacaucugucagauguaaccauggcauuauaucugagacaaaaaauuguaggaggaaaaaugccuguucggagugugggguuacugaaaacccgcuuguugacuaguguuuuauuguagugaugggaaaugaaugagacugguaucuacaccuacuggcacgggucugaauaaaacccacagccggcucuccucucccugagcuuccagccuucugugguccagauuuucauauuccuuccaauuugcccagagcaagcugugacccucauccaucuuuuuuuucucguuuugcauuuaacagaguuguaaagggauuuauaugcuuuccauuagccuuagcaaagcugcugucaugaauauuuaauggaaaaagcaguuuguuuucuuuuacucuuucccagccuucccuccagcccccagcucucccuuucucuugccuggagaaauguaaauaucucgccccucaccccuuggccggaucccaaagccccgggcucgcucaauucaauguucucacccgucugguggggacuuuuuuuuuuuuucucucuucucucucucucguagcccccuacgaggcaacuaaggugguggccgcggugcgcggggccggacacgcguggggcucugccuggcccgggccuccgcgcccucugccugcaccacagcucagcagcccggacagacgguccuuuccuuugaacuucacgggagcacaauagcuucccugcaacuuagcuggagcucccucggaugcauuccuggcucuucacgggucgcuggccccuuucucuuugcaacaggaaaaggggcgaaugucugggacagaaaaugacuucugaagacacgaaaagauuuaccgugucuggagcaaccucugaacuuuugugguggugaucucagaaaaaugcauauuuuccuauugguugcuuagaucaucucccauccuucuucccucccccuccccguccccgcaguuauuuaucuaauuucuccauuucugucauaccucacccucacccccacucccaccccacccccauuccgguuuugccuuuuccuuaauucuuuguccgcucuugugcugcgggaguggaagcgucugaaaggugaggcugggagagggccugaaaaguuuguguuaacugagaaggaagguuccaggcgaacccuccucccuucucuaaugaagucauaccugcuggagugugccugucccaagggaccguuggaaagaugagagaaggaaauccauauaaaaugcuuaacacaguauuuggcuuuaguaauugcucaguaagucauagcuauauguuauuaauaugauacacagucauucuucugaaaugaaugggcaugaaugcuucccucucugcauaaggaauuauuugugcuggauccuucuuaagaggcuucucuucucuucucuucucuucucuucucuucucuucucuucucuucucuucucuucucuucucuucucuucuuucucuucucuucucuuccuuuccucucucuguagcccaggcuggagugcaguggcaugaucucagcuaccgcaaccucugcgucccaggcucaggcaguucuugugccucagacuccugaguaccugggauuacaggcacgugccaucaugcccagcuaauuuuuguauuuuuuguagaggugggguuuugccauguuggccaggcuggucuugaacuccuggccucaagugauccgcccaccuuggccucccaaagugcugggauuacaggggugagccacugcacccugccagagcucaucuauuucugaugaaugccguccacagcaugcuucaccgauggaggugucauuucauuucucuuugaguaaccuaaaauuaguuagcguaugucacuaauguauagcauaugucacuaauguauaacauaguucuaaucaacuaaaaauuuguacagacuccuagaugggcuacuaagugaauauauuuuccucuguccucugguggacuucacuacaacuuuuacauauuucgauacugaaauucuuaauagauuuggcuucaaauuccagccugaugagauaauauuggcaucugccccugaaguccaguaucaggucauucuugcuccacuucaggcuucuuucaaauuugguaaucgugcuccucgugucuuggauggcuauauuggcaagucagaacccuucaauucaucucuguagaccuaccugccuuggguucccguaacccauuaguaagucccuuuggguaagaguucccacuaauaauguuuuucucucgauuucuuuaucaugccuugaaacugacuugaaacauuuuguuaaaugccuagcuaaaaucccaacacacuugugaacagauguuaguaugauggaagaacagaaaaaagacacggccaagcuaagauguugguaugauuaaguuggaugaacagaaaaaaugugcagccagaucuaucuccagaaucaaccaauuuccacauugcuuucgaucucauccuauuauguuuucuguaaguaaaacuuccacugcaaauauuaauugauguuaagucaaaaguacugacggucuggucacaggggcuuagggagaaacgagagaagcaaaaagggucuccccccuuaggguaagcuagagucuugcugggucagacaauuaggcaacaauguaaggcaguauauaauuaaaugcuaaauuauguagagcagauuaugugcuauggaauggagaaaauggcucucacaacauuucuaauguccuaaaucaguuuccuaaaucagaaugguuucauacauccauauguacuuaaagcaugcucaguaucauugguccuuuccugcuuuuuugaagccaugguaauaguaaacauuuucuaaguaucuacuguaggucagggaacuggucuaagagcuuuacagguaucaacuaauuucaugcucaccguguaccucugagauagguaugcuuuucuccauuuugcaaaaugagggaaccaaggcggggagucuaauaccugcccaaagugaguaaugauaaauuccuuccucuuuuugauuuggugggucuguggugaggguagacuaggagaggcaguguugcauucugggaagugaaccuagauuuucauccuggcuucuuuuaaccuacucaccuguguaauuaggaccuugggcaaggugcaucaucuuuuggagcuucuccuuuguaaaaugggacaggaugcuguuuuaagauuuaagugcuucuuaugcaauaggagcucaaagagugggagcuguuguuuauuaaaaauaacaauaucauuaucauauucucuaccuaaagagaccuguugaaauuggacagaaaaggaacguuucugucuugauaagucuuaaaacuccaguaccaagugcagcauucguuucuugugagauauuuguagaauggguggauagaaggaugggagaggagaggggucugaagaauuccuguagcaagcuaaagagguaucaucuuccaauugagcuauuuuuagccuuacucaucauuuguaaucaaaacaauccuuuucuuagccuuacuccucccccaccccugccccccuacuacuuuugcgaugguaaucgucauugccaacuuacuuucuuuggaauacacaaacagagcugucucuuuccgucauggagauuuuaacaguaaaaaacucacugcaccauuaccucugccuuguauuccagacaauaguaaaggacauuguaacaucacugugucagcgcaaacaaagaacuauguaauuuuaucccauauuaauacagugucacgcaggagguacuaucauuagauggcaaucuauaaaaauggccccugagaccaggcacuggcacaauuauuuauucuucaauuauuuauucaguccuaaggauggaaaugcugacagacacugcaaaaugcucuaccuaccaauuuacagaaauugaaugacggaaucauuuguggacugaaguagcuuuuuauugacccuauuuuuauuuauuuaaauucucacuuucacagcuuaacuauguuuacuacacccacuuacaugauagaaaugagaggcuguuuuguucauaaaagcuacuucaaaacaaauuaauauuuauucugaaagggucagaucacaaauggaggcuuuaaaacggccucaggaacauucaaaucgcauccuuaauauuucauaugguuuuauauuuagauuggcuauuuuauguagucuuuuuucccuuuuuagugcucauaccucuugagaucccuuuucuagccaggauggagggaacaguuacacauagcuuccauuugcaguaaguaauuucaacuuaauuuaugucaggggagauuuccagaagguucccgcuccugucugcuauucuugugauucuaauauauuauuuguacaugauaaaauacaauucccauuaauucacacuuaauuaagucauaaaagaauuuguuuggucuuaacuccuaaaguuuaaaagauuauuugcauuuguauuaauacuggaguuuaaaaauuauggcuuucuuuauagaucaguuccgauuuucccuaaaucaguuauuuucaguuuugauuuuucaaacacuugggugagauccaauuuaucucaccuucugauaguuuuaaaagagaaguaauuuuaauuuacauuaacuuuaaaauauuuguaugccaaacacuaguuauuuugaggggaucgaaacaaaucauagcagagauaaggaacuuucauacuuugggaggauuuuuuuuaaauaacuguauguuuacucuaaguagauauguguaugcaugcauucacuuaugauaugcacacacacacacacacacacacacacacacacacacacacacacacacagaaauuuaugauguccuuuaagaaucuugggacuaucagaaaaaaguuaagugaaauaacaauuuucaaaaauacauuuuuguaguaaaaacgcaccaucgguguuacauuacuguauaaaucaaauuugcugaaguuuauaaauauuuuuauguuuacuuuaaacuuggacauaaucagaucuaucugcuguugacgacauggcucucaauauaaaaauaaucaccuuuucugcuuaaagccucauucucagaaguaaaauguguaugugaggauauuaacuaguucauaggauuguuguagaaaaccuuuuacauauguggauacugaaauucuuauggccuggaucaguggccuggaucauagcuaaucuuuaugaaaagaucacuguauuauuacauuguuacuacagguagauuuucacccugguccuugcaugaaucauuugguuguacuguccaugauguccaguaguagauuaaaaaaaaaagaaauaaaaacaaaaacccaagccaaugccuacgacguugcuacaaguauccuuuaaccuguggugugaaguuauuuccaaagaugaaguuugccauucaaauaccauuuccugguguucauuugauuucuguaacaccucuuuuucuaucuccgcuaacucuagaucuguaguccuuccaaacaugcuaccuaccacuuacacuuugccaaaguguaauuuuugcucucuuaucugcuucauaagagaauguuuguaguuucaugauuuguaagugggagggggugcuuagcaggaguugagaucaccagcccagggaggaggaaauggaaucagaauaagcaagaggaauagacgggguacugggcugaagagcacugugggagggugcuauuagugauucacacugcuagagugagaccacucuuugauucuguuuguagaaauuuuaagcuaaaagugacagauuguugccucucuuuauguaaaguauuacacaugggaaguuaaccucugcuacaggauacugaucaagacaagucaugggcaagugcaaagagcuaagugguuuacuuuauacacuaguaugucccuucucagucuuucuuguuauuucguaugacuugcuuccuccagcuaguccaagcuauguuuguguaaauaagaacugccauuuaaugaacccuugcuaugaaccagauacuaugcuagaaggggguguagguacuccaggggaaaggccucuccagcagauuagcuuguucacgugauacuagagucccaaaagggcaauaguggaagcucuaaagcuucuugcagcuuaggcuuggacugaauaaauaacagcaguaacacaacagcaaugguaauaguaauaaugaaaacaacucuucuaaaaaauuugaggaaagucucuugucuauugaauauaaaaaauauuuaccauuaaagauuauuuuaaaauuuauuuugaguguuuauugucuaucaggcagguguacuuggaauguguuuuuuguaauauauucugccgccuaaaaauaggaaauauauauccagguuuagguguuaggcaaguuuuucacuucugguuucuauuuaucuugaauguauugcauuagccacacuauuuaacauggggauuaaaaaaaacugcugugcauguucucacuuacaagugggagcugaacaaugagaacacauggacacagggaggggaacaacacacacacacuggggccugucgggggagagcgggguggggagaacauuagggaaaagagcuaaugcaugcugggcuuaauaccuaggugauggguugauaggugcagcaaaccaccauggcacauguuuaccuauguaacaaaccugugcaucccgcacaaguaccuuggaaccuaaaacaaacaaaaacuggugugaucucccuguaagacaggauuuuaaaagcaugucuacauuuuugaguuuucuuucaaggugccaagaagaggcugaccacauuguuugaagaaugguuaagaacuugaacuucggaguuugccagacuugcauuccaggcucagcucuggcacuguaagcucuguggccacacagcuuugccgaaccaaccugcuuagcaguaaaaaugagaauaauaacauuuccauugaaagguguuaugaagauuaaaugaaaguguuuuucuaaagcucuagauauauagugggggcccuucucagguaaucagaaaguuguaguugcaguuuuguuacuaauauugcaaaugcucugaaaaugugccaccauggcuaugucuuguagauggugacuuaagcuuaccuuccacagugggaaaauaaaugauuuauuucccuuuaauagccaucacucuguugauccagcccugcaaagcuuacagcauggggcuuaugaaucaugaaucaacacaaaugucaccaagcuaaaagagaguuagcagaaguagccuauguuaagauuagguuucugauuuaaugugcaguuucuaaaaaccaaguagcauguaacuggucuuauccuugcugaguuaagauugcuggaucguuaauuuaauaauugagagaggauaauucuugcaacuuccaauuaguauugacuugaccacugcuuugauguaggaugaaaccgcuucacguuggugugauuuccucagcuaugguguguauagucuaguuuaaagcuaggcucuguuauguacuauguccauccuggaaaguucauuagacaaggaacagaauaguggcucucucaagcagucagucauccagugaaugcuauagcaccugcuuccauccagcccauguauuccuuccccucauucuucuuuguuacuucacaccacauucuuccuucagcuaguccaagcuaugccugcauaaguaagaaccgcaguauaaugaacacuugcuaugagccagacacaguguuggaggugguauagguacuccaggaggaagacgucuccagccaguuagcucagguguguuuguauggcaccagugccccaagaugacaauauucaaaaaugccagacuucuugaaguuuagacuugagagucucccagugucauuucuacuacauucuuuugguuaaagcaaguuaccuggcuaaaccuagagucagugagagaggggauuguucaacagugugcauuuagggagagaauuguggcuauguuacaaacaaucuaccagagacuuacagacggcagcugucuauuccccauuugacuucaucauuuaugagcagacguuuguuaagcacauauuggguagcaaaacaucuauaauauuagcuuuuaauuuuuuaaaaaacuuuuauuuccagaaagcuuagcuuuaucuacaaguacaguugguccuugaacaauguagauuagggggugcugacccucugugaagcugaaaaaccauguauaauuuuugacucccugaaaacguaacaaugaauagccuguuguucacuggaagcauugcugaugacauaaauggucaacuaacacauauuuguuuguucuauauauuauaugcuguauucuuacaauaaagcaagcugggccuggcgcugugguucacauguguaaucccagcaauuuacgaggcugaggcgggcagaucacuugaggccaguuguucaagaccagccuggucaacauggugaaaccccaucucuacuaagaauacaaaaacuauuuuggguguggguggugcgcaccuguaauuccaguuacucaggaggcugaggcaggagaaucgcuugaaccgggaggcggaggcuacuugagccgagaucaugccacugcacuccagcucugggcaacagagugagacucugucuaauaaauaaauaaauaaauaaauaaauaaauaaauaaauaaauaaagcuagagaaaagaaaauguuauuaagaaaauaauaaggaagagaaaauauauuuacuauucauuaagugcaaguggaucaucaugaagggcuucuuccucauugucuucauguugaguagggcugaggaggaggaagaugagggguuagucuugcugucuugcgggugacagauguggaaguaaauccucauguaggugggaaugagcaguucaaaccuauguuguucaagggccaacuauaguugauuaacucauaucucuacaguuaauuuucaaacagaugugauagcugaaugagaacuuuuaagauaguacuggacaguaaccuuauuggaacuggaauggccuuuagacuuuuuguguccaguuucuucucaccuccucuuucucuucaaaugugcaacugaaacugagagaccucagucccauguccaaggucaggcagauacuuagcggcagagugaggacuccagcccauuucugcagcucugcugugcaguggaagauuugggacaaguacauuauuuaaaaaugcccacccacuaaauauuacauuccuaacuuuucccaauacacaaauaugcuugaacuuuuaaaagcuuguuuuuggucgugcuugguuuggaaugugaaugacuaaaacuaccuuuagcaauuucccaaaguguaaguucaaauguacagagaauuuuuuuccugaaugcccaacacaauaugcaguuuuacaacacauaccagauucuuagauucauuuggugaaggaagccucugaauuaaaacuuuuaaauauuucugauuugcaaccagacgaaaaagaagaaaauugacaacuuuuuugaugcaacuuugugaaaucaugguguuccugguuuuucuggucugguuuuuguuguuguuuuguuuuguuuugccacaguuuaguuccucaccugaucuuuccuuguauccacuucagagucucugaaauguuaucuguuuguugguuccugggaaauugagagccuuuucaaagacuccaucuagaagcauauuuaaaagugugaaagaagacauuuaugcgaccaacaaacauaugaaaaaaagcuuaucaucaugggucauuagagaaaugcacagcagaaccacaaugagauaccaucucauaccaguuagaauggugaucacuaaaaagucaggaaaggccaggggcggugacucaugccuguaaucccagcacuuugggaggcugaggcggguggaucaccugaggucaggaguacaagacuagccuggccaacauagugaaaccccaucucuacuaaaaauacaaaaauuagcugggugugguggcgggcaccuguaauccuggcuacucaggaggcugaggcaggagaaucgcuugaaucugggaggcagagguugcagugagccgagauugucccacugcaacuccagccugggugacagacuccaucucagaaaaaaaaaaaaaaaaaaaaauucaggaaacaacagaugcugaagaagauguagagaaauacgaacacuuuuacacuguuggugggaguguaaauuaguucaaccauuguggaagacaguguggcgauucuucaaggaucuagaaucaaaaauaccauuugacucagcaaucccauuacuggguauaaucccaaaggauuauaaauuauuccgcuauaaagacacaugcacacuuauguuuauugcagcacuauucacaauagcaaagacuuggaaccaacccagaugcccaucaaugauagacuggauaaagaaaauguggcacauauauaccauggaauacuauguagcuauaaaaaagggugaguucauguacuuugcagggacauggauaaagcuggaaagcaucauucucaucaaacuaacacaggaacagaaaaccaaacacugcauguucucacucauaagugggagcugaauagugagaacacauggacacagggaggggcacaucauacaccggggccugucaaggggugggagcuaggggagggauggcauuaggagaaauaccuaauguagaugauggguugaugagcacagcaaaccaccauggcauguguauaccuauguaacaaaccugcacauucugcacauguauccuagaacuuaaaguauuaaaaaaaagaaaaagaaaaaaaguguguagcgacuugacgcgguggcucacgccuguaaucccaguacuuucagaggccgaggcggauggaucaccuaaggucaggaguuugagaccagccuggccaacagugaaaccccaucucuacuaaaauacaaaaauuagcugggcaugguggcacaugucuauaauaccaccuacucgggcggcugaggcaggagaaucgcuugaaccagggaaguugaauuugcagugagcugagauuguaccacugcauuccagccugggccacagagcgagacuccgucucaauaaauaaauaaauaaauaaauaaguaaauaaauaaaguguagcucuggucuuacuaaguguaugauguuugucuccaugaaauaauaauaauguaagaucugagaaguuaauacuuaaaguaaaaccuacagcaaaacagucugcugaauuugucugugaucucacaggagagucuaguuguaaaccgaagcaaggaugguagcuaauaucgcagcaguguuuguaagaggauuuuuaguuugucaugcuuaaacagaccccucaguauucucacagagaacugaagcaauucauuuucaagacuaacaagagcacagcaucugcaugcauguggcagguauguuagugaauguugugaaguagguggucccaucaguugucaugguucaccucuguccagacugugauugugugacucgcaguuggcacuucagcaaagcuuaggaaaaugccucaucuucuuuugugggagguggaaaaauaaguagcugcuuucaaugaacacugcaagccuuguuaaagucuguaccuuucauacagaaacuccuagaugaauggcaauggaaaauacggguuugugauaacuuugaaugaugugugauugccuugauuagcacuauaguuacuaagcagauaugcacuucuuuguuuuaaaagagaacuugaauuuuuuuuuuacuauaacugccaguugcuuaauuucuaccacuuugucuauuuuuuuaaaaaaugaauuuccaccuaauuugugcuugucagugaugacaaguuuuaaaaguaacucaaguuaaaaaaaaaaauucuccagaaaccaucaucugucaaaaaguuuguauuuaauguuuucuuucagguagaaaugagacauuuucuccuucuucuuuccagauuugcacccuuaauguuccagaaagcugagcauccauauuauuuugaguuuaggaauuuauagugaccuagucauaguuaugagguguuugagggaaaugaagggaaggaugaguagcaaagacacauuaaacagaauaaauuauauagucuuguuuuuggcaacuagucuagcaugcaguuuccuugcuuuguucaguccacauauagaacaacucugucuaaaacagugauccaguuaggccaguuuccuguuuaaaagcuuucuggaccgucccuuuuccugcuggcaaaaccccaggcuuugagacauaguucuuucuaaacugacccuaauuauucuucccaggucaucuuuacugccacuacuguuccuugugaauauuucgcaucucugggcuguuaacauaugauuccuuccacuuugaauggcuugugaaaaagacgggggucuuuucacaagcuggugauacucuuuucagucauguauuuagaccaaauccucucacuuuguggagucuuggaauaguguccacguaaggcuggccugguuaguuucuccucugcuuccugaguccuugaguggucuuuguauauagcgugaagugcacagcauugggaagucugugucugcaagcccaucaccuucacuaggauacaacauuuucaucuuuggaccucuaggcuaaccggagauugaaacuuacuuggccucuaccuaaacauuucuugagcaacucagugagcuguccauguaguuuagcagacguuccgaugauuguuucauggaguuugugucaacggggaaggacugcugagaggcagaaaccauaaugaccagaaagcuggaagucauggaacacguguccacguuucuucaguuaauuuuuagaaaugagugaaugucaccugacaguuggugucucuuguuuuuuuuuaaugaagcuguaccauugcaagccauuuucucucucuaaguuuccuguggaauuucuuuccuuaucaagauaguaauacuuuggaguuuugaauuuuuaagagauucagucaaagcaucuugucauuuuauccaguugcuccacuucuuaaucuguaaaacggagauagugucuuugcuauuaauuuuucuuaagggacacagaauccaaauacucuuugaucuacaaaucuuuugcaaagaugcauaacuguuuacugaacauuuuacuagaagucagccuguugcuuuuaaaaucuaggaauguuauuuggcuuaccaacuaaacauauucauauuuugcuuagcaugcccccuuucagaugacuugcugcagaauaaugaggugcaaguugaacaaaguacuuuucaaauuaccacaggaccucaccaguuuuaccacuuaccuccagauguguggaggccaucaugggagaauuuaccuuuuuauguuuggacauuuuuguaaaaagcuugugguguugaaucaauggguuaugaaaugguuuuaggaauguaacgagccaucccgugauucuacagagagagacaauuuuaugagcacauuuucuauugaauguguuugcugguuguacuugaaccaaaccaaacacaaucucuaaaucauaacacauacaaccucucaacuuggagacucuugauuuacaaaugucucucugugacugaaguggcugccaagggaaucaccuucccuauuuugguugaauguguuuuuaauuuugcaugagcugucuuuguugauaauaauaaaaugauaacaguaauuucagccuuuauugaaugggugugccagccacugagccacguguuuugugugcaguguuuaguucacuucacuauggugcccuaauaaggauggauuuuagaugagaaaaccaguacagggagaagggaauuaacuuaccccaagugccucagucaaaguuugcagaaacacuuuuuguggaauuuuuugucucugugaugcuuccucauuucagucucaggcauuuugccugcaaaucccuuucacuugagaacacccauugugcaaccauuucuguuuuugguuucaccaucucaugauguaaagaaagggaaagugauaccaggcagugucuuuuuacuaauaaaaggcagauaagucuuccucaaauugcucuucuuggugaagaauaauacuugugcuccaaaugcuuuggugaugugauuuuuacacgaagcagcugagccaggugguguuccagcuuguuccuggacauguugauacagcccuaauugcuuaagguaugugccucuucuuaaucaucucuccuuuaacuggagaacugugcuacauuaugaccuggaaaaugggggcauuaaaagcaaccccaaauguaaauggcccuuaccagcaagucaccagcugaggaaaugcagacgucacaugaagagaaccuccuugauccucuaaggccccuggggacuggcuuccugagaguguacaaguuggugguugccaucuuaguuauuuucagggcccagguagauguuaugaguggaaugcagagugguaacugagaugguugucaugcaagaaaguggggccaggggacuagaccuucgagucuuucagaaguuggaaauguggaauuuuagggaaaaucucccaauuuccaaaaauugggaucaguucaaacauucgaaaaagucggagguccaaaucaaacacgucugugggccagaaucagcuugcaagaacccaauuugugaccacuggcuuaagauguguugauaaauggaucuauugguccuugacuaaagggaaucuaggaaagauuuguuuuauuuuugggggguaagaacauaacgcauaagaaagaagucacuuacucauuuuuaccugagaguuguuuauuugucuugugaaauacugaaaccuuagcacucauugagcgcucugugguagcaagugauuugugaugaugguaguauuuuuggagaagauuuuuagagguucagugugguucuaaguguguguauuuggguccuauguguggcaguaaagaaauguguucuuuggugaacaguuuuugcaucccuguguucaccugcauggaauugcaaguuguuucauaaauggaucacuaguauacgcagaggcuaugcauugaggucuuuucucuguauuauccuauuuaucaaccagcugucagucaaagaaacacaaacauggugaguauuaugggauuaagggauuuauuauagaaauugguccuuccucaaauaguagaggagcuggcggaaguaaaggucuugaaggaaagugagaggauuagagaaaguuucaccagaaguucuugcguaggguugggcaggucagaacugcaggaugcugaugagggaccauagcagggaacggaugaaacauuccaaaagcugcugcugccucugugucuguggaguuccaaacccuguggucugcagccaugugucuggugcuggguggagcccuugcugcucaacagggccgcuuguuaggaagaaacagggaucagagcagaagaaagcaaagacaagcuggaccccauugggcaccugccguuguccaucaugguguuuccaucaaccuuaugagagugguggccuguuuucagguucacuuuccaagucucauuaagcuccccauauggcuagccguaccccaggaccauagcgggaaggguauuccauuaaaugagaguuccuggcuuaccaaguugacaguuguaugauucaguguacucuacaaauaaggacaacauccuuaggacuauacugccgugagccgcuggcuacucuccccuguugcccuaaaaggcuuguaccugcucugaaacacaguauugaaauaucaggauuuggaaccucugccuuggccaggccaaaguagguguauuucuguuuaggguccucccagcauaguaccagcaauuuacaugcacauuagauuaaugauuuuaucugaucuuucuuccuggaaaauuugggucuggugggguggagaaaagggagguacucaagaccaucauacagagaagcagaaggggagaacaagagaaauuuuggagguuggauugagggaagcugaacucaauuuuaauuuggguccaguccauguaaauccucuacuuuuuugucugccugccugucugccaaucaaucaaucaguccauucauucguuaaucaguuauguauaucuauaucuauuaauauuuuucuguagaucuauaccuaucauauccauccauauguuuauauuauauuuaccuaaucuauuuaaucuauaucauguuaugcacauauauaugaaacauuuuugaguggaaaauuuuauggaaaaaguauucuauauaagguggauuaguaauccucuuuugaaaaaaaauucuaguucuucucaauugugaaagauaugucuaagcuuucuaacaaaaugaacuccaaacagucuuagaugucugccucuuuuuaaucauuuagugaaauaauugguuucucuuuuuaugagaagguguuaggauaaguaagaaauccugauacuuaacucgucugccuauugcuugacuacagaguuauuagaguucagucuuugcauuaaaaggaaacauacuuguaauuuugcacucuuugccaaagugugagcugcuuuuuaggcgguacuucaacuuuuuauugagguauuggcuacuucuacuucuugcugguaguguggcuacuaaacaauauaaaguauauuacuuucaaaccuuagaaaauuaauucagaaguccuagagcacagaaacagguuuuuccugcugcuaaaauauuuucccuccuuagguuauuuguguguguuguguauuugugucugucugugugugaguggggaaguuauuugauguggaaguguugggagauacauugucauuugggaauauacuccugaagccacuaaacaucccagguagugacagugguuugcucuggugcagaucacuuucgauuuuuuuuucuuuuccuuuuuuuuuuuuuuuuucuuuugagauggggucuaacucuguugccaggcuggagugcaguggcgcaaucuuggcucacugcaaccucugccuccuggguucaagcgauucuccuccucagccucccacguagcugggacuacaggcgccugccaccgugccuggcuaauuuuuuauuuuuaguagagaugggguuucaccauguuggccaugauggucucgaucuucugaccucaggugauccucccgccucggccucccaaagugcugggauuacaggcgugagccaccacgcccagccucacuuuagauuuuuuuuuuaaagagaccagacauuuuuugaaccccucaauauguuaggcacugacuggagugcuuaacaauccuagcuacuuagugggaagacugccuuuucuuucuucuuuuucuuuuucuuuuuuuuuaaauuaagauggaguuucgcucuuguugcccaugcuggagugccauggccugaucuuggcucacugcaaccuuugccucccuccuggguucaagugauucccuugccucagcccucugagucgcugggauuauggcaucagccaucacacccggcuaauuuuuuguauuuuuaguagaguugggguuucaccauguugaccaggcuagucuugaaauccugaccucaggugauccaccugccucggccucccaaaguguugggauuacagaugugagccauugcgccuggccaagacugccuuuucaaggcucuuaggagacuuguuauggcccagguguagaacauaagaauggaaguugaacauucacgaauuaaccaaucacaauucagcacauaacuguugagcaucuauuaugugaugaggguuaggaaaggcuuuuuagagagggcagugauuugggguggaggaggagagcaguccuguccuucgugucuguguucaccuaugaucaucauaaggaagagcauccuggaggacguuccuguccuguaucccagggccuguguuuaggaaaccaagucacaccuccauggcuuuuugguaauggcauaguugguugugaggaguuguucuccuaagucugacugagucgucauccugugcucuuaagcuaugcuuuccaagcccaccaggcccuucauucccagcugugguuggaaagauacauaaaguucucuuccaggcucucuucucugguagaacuccuugacaauuugccuugucaaagcguucuucugauaauguguaugucuaguuaucacaccugccaucuuuuugugggaagcuuacugucuaggccagaggaccccccagcacuaggcuccuuccuagccuuccucauggauggucacccaggcuugaauuacagaccuuucucuccuucacccagggccaaguacuucucuuucaaacggucccuuuucagacuugcccgcaugugugaaaauacaagggguagaucuuaggggccugauagguaguaagugguaagaugcaauguaagccgggguaggggggauguuuaucacaggcuuccuggaaacuaguuggguuucacugaguccauucauuuccuucucucugaugaaugaguaaucagaugauucacagggagcugcuaguuagaagacugcagcauguucucacuagugcuguccuguuagacccaggggaaagguuauauugguguguuuuuaggcaccaugugucaauucuuucaagauguauauauauuuuuguuuuucuaaagggggcaggguuucaaaaagguuugagaagcauuguguuagaccaaguuuguccaaccuguggccugugggccaccugcagcacagaauggcuuugaaugcaacccaacacaaauucguaaacuuuuaaaaaacauuaugauauuuucugugauuuuuuuuuuccuagcucaucagcuaucacaaguguuaauguauuuuauguguagcccaagacaguucuucuuccaguguggcccagggaagccaaaagauuggacaucccuguguuagaccaucauuuguuugcuauaugaugucauagugguagaauggucacuuaagguaaaaucugaauagagaaauuuggcagaaaucauaggaauuucuguuugaaggcauaaugaggguuaaucauuuuucauaauagauguuaagauuaauaguaaucauagcccauauuuauuaagcacucgccacacacugguuugagauuaagauuuugcgagaauaauaauaaucauuuaaucuucccaauagcccuaugaaggaggcucuauuauauugauuuuauacauaaggaaacugaaauuagacuuaguuauuaucaagggauggguccaaaugacaagaccagccaucuguccuggaaaaccaugcccugguaugcauucaaaaagagaaugagguuuuguuucucaucuccauuucuuuauacuggaaaaaccguucaaaauuuaauacagcuguaugaucuggcaaaauucuucuucagauagagguggauuuuaaagagaauggugauuugucuacacguguucacagcagcuuuauuuauaguagccacaaacuggaaacaacgcagaugcccaucagaggugaauggaugaguagacugugcuauauccaugcaguggaauaauauucagcaauaaaagagaacaaacuauugauacaugcugacauggaugaucccaaaauaugcugagugaagaagccagagaagaaagaauguauagguuauaggaugccauuuauacagacuucuaggagaugcaaauuaauguacaaugacaggagacagauuagugguugcaguacaaugguuggaguggaugguaaggaaaagagagugcaaaaacuuuaaagagugauggguauuuuauuaacuuaauauuggaaguggaugcaugagugcauaugcaugucaaacuuaucaaaauauacaguuuaccaaugugcaauuuaucgcauaucaauuauagcuccauaaagcuguuaaaaaauuuauauauauauauauacauauacauacaguaagggaaggcaaggagaaugacccauuaaugugugggaguaauaaaagagaaauuguacaaugagaggcucacucucagagcggccucggaaccccagagagguuauuauuguuugaucagucagucaacagguauuuauugaaauucuuccagguacuuugagagaaugagagauguaugugagcuuaacugugccugguagugggacccauuuggaaagagcugggcucuggaguuagucugauguggguuucaauccugguuuucccacuccuuggguuaaagcuuuugaacuccuuuaccuucucuuagcuucucuuuaguccuagggaaaaauggagauggcaguaucuuuauuuuagggucguuugaaggauuagcaauaauauguaucaaaugcuuggccaaaguguggggcacaugguaggaaugcaguggcagcgauuauuaucaucacuuuaauugcaaaacuggaaguucagauuccaggaggaggauguaguugcuguggacuggccuucucaggcaaaacuucacuuggaauaggcuuggaagacuguauaggaguuacaugaaguggaaugguuugacucaaagugcagaaaugggacuacauaaaucuguuagguuucuugaggaaguaggggagaucagguaggggaagggcaagaaauccuacuuacuaggaaagauggcuuccuagcuaguuuggggcacaaauacucaacagaccauugcuauggugaaaaugguagaaaugagaagagcaauggagggaggaagaccugugucaugaaaauacuuaucugacuguucagcauuauugauauuguggucuggaugacucugugucauggagacuugcccuguacauuauaggauguuuaacagcaucccuggccuccacccacuggaugccaguagguagcauucuucacccccauacacaugacagucaaaaauaucuccugacugccagaugugccuugguggggucacugaagaccacugcuuuaguaauuagacuaagcaucagugaagaugagauuuucauuucaguguuggaagggagaaaggaguggaguucauuuaaaauaauagaaugaacugcucuaauuauagagguguagcagaaguaacaugguucagagcauugacagcaaggccacuuauaagcuguauggucuuuggcaaauaaccuguuguacuucagcucccucauguguaaaaugggggcaauaauugcaccuaccuuaaaucaguaaguuaaauuguaacugaggccaccgauuauuugcuuaaagaaaacagcauuacuccuccuuuauuggaaagacuuugaagaaaaggggaucuuccugucucuagcucucuugaguuguuuuuuaaaggacccaucuuuugaaaagacccguuaaaaaauuagucagacaugaggcuauugaaagaucaauguggaaaauguacuuugucccugaguugauucuuuuucucugggcccacugaaagaucuucagauuauaauguaaaagugaagucuuuuugaacagagcagaagaaaaggauaucaagggcaugaaguggauguuacugaagggagucguggugugcuguaaaggaacuccugagagggacauuggccgaagggucaucucccucuucuuggcacugaacgaccaccacagaccacaaaagggcuuagaaccgaccuccauuucaaugggacuuuucagugacacuugagaccucgugucauagccaguuugugaccauucuccaacccaagcauucugcugcuuuuacaacagauuauuuuagaagcugcuuaggagaugcuacuagggaugugucaggcuucaacaaauuaggauuuccuccccaccacucugaugauggugagaccagcauggagacuggcagagugaugaaugcauuggcuuaucaaggucaugaguggcagccggcugcauuguguccccaauucaaacaaggaucccccaacacugcaacagucuaggauugucuccuaaauucuucacauuccaagcacacaaaggagguguccuggagccauguaccuuggggaaggcagauuauuuguaagcucuuguguugccuucacugcagacagaugggccuccucuauccuaaacagaggcuauuuaauaacguuugcuucuuguuaacuuuccuuacucaccugaucuaaugaaccuaugcugcuuuggaacaucacuggaaauguuucagaacaaagcaagaaucauuuggacuaguacuucuuuuggagagguggcuauuaaaugggguuuaaaguuuuucauuuguuuguuuuuuuaccucuuagauuuggagcuucuucuauggccuugcacauaucauucugugacuaugaugcccacauuagcccaguugucuuacaaguauguaaaauccuuccagcaguucagguucauuuggcauucuuguuaaauguacugcuguuaggacuggaaugagaaaaaugauagaaauacaaguaaccauaaaacaaaacuagaauagaauaacagacacugaaguaaaaacaaaauguuuauccauauuuugucauucaggccuauucauugaaauaaagaguacaaagauuuuaaaaauccaacuauauuaugaggaaauguuuuaagaauuuuuugacagucuuuccuaaacauuucaaguugauugacaaaagauaacaauccaucauauugccuacuagccaauguuuuguggugccuucaccucugaguucuaggaagugguuuuaaucauguuugcguucagcuccccuucccauuuauuaaagauuggaaaaugcuaagguuuaguugacaugaugaccuuaacguaaaagggcaugaagagggcaaagacucccagcuucuaagucuaguucaucuguuacucucaaaggugucuuugacacuuagaaaugcuuccacacccuugccgacuuuuacuuuuuaggaagugugcaguaugguaacccccuuucaaaggccaauagcaaggccacgccugacuucaaaaugagguuaugcuuuaugcuggagaugcacagcagaaaacaguaguccagccagguggggaaauaaagccagaagagacaguauauuuucaggagcaauuuagugcuugauugaucuuacgauauuguuagcguaguguuuauagcugauuggguuuaccugaagcaacugaccagcacuccguguuuggaaacagucaagggagaaaacacauugauuaguugguaaguuaacucuguaccuccauacucuaaaauuaguaaaucagccugucauugacagcuuggaaagauguuccugugucucacugaucccuggccaggguugccaggacuuucucuuuacuuuguguuuucccuggcccaucaauucuucuucaacuuuugugacuuuuuuaaaacuggcuuuauucaauuuuuguuuaacugaaaggcacaggaugcaaacugaauuuauaggauguuuuauagcgagaauaaaaggauaaauuucaaaaucauaugcuaauauguaaacugaauuuacucaaaacauuccuuuuguuuuguuuuuuugagauaggaucuugcucugucacccaggcuggugugcagugguaccaucauggcucacugcagccucgaccuccgagcuccagugauccacccgccucucagccuccugauuagcugggacuacaggggcaugccaccgugcccugucaauuuuuuauauuuuugguagagauggaguuuugccauguuggccaggcuggucucaaacuccugggcucaagugauccacccaccucggcuucccaaagugcugggauuauagacgugagccacuacaccuggccaaaacaucacuauauuuguguguauggauuauaccuucucugcugauguuaauagcagggauucuuuuuuucccauucuuucugugaggugugauggagaaaacuuauguccuauaaugaaaugggaauaaggaucuaaaauacauuaaauagcacagaacaccucccuccaccuucuaauucuuagagcaauaucaucuuucuucuucuuuaguucccuccaagauuaaucaagauauuauuuauggaugguguagaccugguguggcaaauuagagucugugggcuaagaauggcuuucacauuuuuaagugguuaaaaaaaucaaaagaagaauaguacuuuaugacaugugaaaauuauaugaaaaucaaaugucaguguucauaaauaaaguuuuauuggaauacagccacacucaauucauuuacuuccugucucuggccacucuccugcuacaauggcagaauugaguacuugcaagagagaccauauggcuuguaaagcccaaaacguuuacucucugacucuacacagaaaaguuugccgaccccugcugggaggcagaucgaaaaugaauaaucaucaguaauagaaagagcacagccuuuagaaucaggcaguacagaguccauguuaugucuugguuuccucagagcugcaacuauuacacauuauuauuccaccuuagaagguuugggugaggacgaaaugagauaaugaguguaaagcaucuauacauguauagcaugcugccaaauaccucacagauauucagccagugcugguaucuuucccucuccagguuacaaauauuucggguucauugccuuaccucagguccucuguucacacagaacuggagugaaaaauacccuuugcaagucugacaauagccggagagacaaaaacccaugucucucucucucuaccuuccuuuauuuagugucuuuuccuccauaaacugguggcguuuagcccugugaaaugucauuuuaccuuaaggugaauggguauauagaauuggucuugaccuugaauaaaagaaggacacaccaggcaaucaucauuugggggaacuucagagaaauugcuccaugagaguaacacagagcagugacuucugcuggagggguucacaggugacauuuugagcccugugcagccugugccuccgagacagucagcgagggagcccuggcggucguggggcugccuucgccagcuucagaacugugguuuuucccccauuaacacacuucuuguuaagcugaugugguugcuuucuaaacugaaucuucccuuggccagaaagaaagaaaaagcuucccugcgugaagaugaagguuuauuggcaaugucuucuuuagucucuuagcaagaacagcaaacagagaacucccuucuuucugacuuaaguuacacauauuuuuuuucucuuuuuuacuuucaaagcuggcagccucauaagagcagcauucaaauagaccgugccagggaugcagggcaccaugaauggggcauuucuuguccuucuggcccccuuucccuuugugcugucucuuuuccauguguuauuagccaccuugcaaagucggagcuuugccaacaaauucuggguucuguggguugcugucugaaucugcugcuuauucaggaaaaugaguuaguuucugcuguuuguagaaaaaaaucaacaaacccacuuauagguuacauuuagguuacuaauauaugugguagcacagcuaaguaaacuggagauuaugcugaugcuaugugcuuauuauugcaguguggguuuuaaugugaauuuugcacaaauccaugaaugauaugcccauuugccuuuuuaauuuucuugcuguuaaaaaauuagcuuauuuuguagccauugaaauauauauaaagaaaaaauuaacuucuaccuguuuuuuuucuuuuaaaaauauuuuuaugugaucuaaccagucugaaauaguuggcuguaaauggaugugggagugucauuucaaaccuuuuacaauuugggauuucuucuggggggaguggguaucagagcuuuaguucuuguuauuggcuuaugacgauagucuggaauuuuauagauuguguuuggcugucagcauggugcuugggugugauuaauuuguguagcuugccauuggauagauaauauucauuccuuggauccuuguucagaagggauuaaccaagugaacuggaaaacaugucuuugcaggagagcuuucacuguuugugauaaucagugaacaaucuagugcuaauuuaauuccacucauagaucuggcugacucauuggcucuuaaugcuucuuaacuucuauauuuuuaaucuucaguuuuuuacacauauacaaauauuauaguagacauaguucaaaacuuaacauuucuccagggaucuugcucugggaaugcaaaguaaauacccucuaaaauagguuucuggaauguuguuuuucugaugggucuguuauuucugccuuucuucuaaugggaaaaaaaauugauuugaaaggguaaaauaaacuuagcuuuuuuggaaagggaggguuaaaauaaaauuaacaacaacaacaaauaaacaggugauaccuuagagaccuaucuggcauaggacuuuugaagccuauaacauggcuuuggguuuugguauugaucuuuuauagggcuaaauaauuuauagccaggcuuuugccuugugggaugguuggaguguguguuccaccaggaggcaaagguuucuguucaaaucuuccuguucacuugauuuagguguuugauaagugacugcaaaauggagaggucacuuuaggaaagguuucucucuucuugcccucuguugccuuugaguaguuuccuccuguguuuuguucaucugaacaaugcauugacuugcccuauguaggaaggcuggagagcugcuuaugaauuguaguaagaugucuuauggcuuccagggagcaaaccuagggaguucccagguacugauuuuuuuuuuuuuuaauauuaauucuuguucuguuguccaggccagagugcagugguaugaucucugcucacugcaaccucugccucccggauucaagcaauucuccagcuugagauuacaggugugcaucaccaugcuagguauugauugauuaauugauugauugauugauuguggugccuccauggacuagacucugccucccacuuuacuuguagccuaaauguaggugacaggugaauguaggguugccagauuuagcaaagagaacuauggggcauccaguuaaauuucaauuucagauaaauagcagauauuuuuucguauuaaguaugcucuguauuuuaucuggcauccccaagugaguguuggggaauuaguuuucucuauccugaaggccuucagguucgaucacauauucagagauaauugugagugagauguauggaugggaaaagagagcaccauuuauuagguacuuuuuauaucaaguacuuuguauuuaguccuuagcuugggaggcaaguauuguaaacucacuguaccuuugaugauaaaaguagcuaacguugauugagugcucucuauguccugggcccuguucuaagaacuuugauguauccuuauuuagugcuuaaaauaaaccuaagaggguuaaguacuauuaugauuuccauuuuacacgaaaggaaacugagcugcaaggucacauagcuaguaagggauuguucugggcugaagaaaaaggaugcauggaggggaguaucuugcccaaggucacguuauuaguaauuaguggagucagaauuccaaugcagguuccuucacuccagcucuucuuaccucagaaaacacacuugccuggacccuccccuggaguuggauuuaguuggcuugggcauggcgauuuuuaaaacuuccccaggcgauuuuaaugcacagccagacugagaaccacugcuuuaccccauuuuuggaguaaaaugaauuacccuccuuaggaaaucuggucgcucuauguggccauuccuuuaguuccugccccuccuccacagaaacacaccauuccaaaucuggcagcuaauuuuucauggucuuuguuucuucaaaauuauuuucaggaagucuuggugaauauauguugggguauaaacagaccacaaagaaagaccccauagggguauucuguugauggauuuucugcacgaucuuuucuuuuucauucuuccauuauacuuccuggaggagggacuaccccuuuguucgucauuuaguuccagcuggguaccagguuggguauuuggggagguuuacagauuaauaaaacuagaccacuacccuccaggaguuuucaauuuuagaagggaaguauauaaauguaauucuagguuuaauuuucuaaaagucacuucagaggaauacaaaguauuagggaauucagaggcagcagaggcagagugagguggugugaagugugagcucugcagucacugccuugguuugaguuccugccccaccgcuuccuacccacagaacucuggccagugcuugagcccuccuggucuccaggacuuuguuggcacaguggacaugccaaauuuuuugaugagagacaugacgaguuagugcugguggagugcacaccaccgggcccagugugagggucaguccuggugagcugcugugcucugugcguugccugaagcuuuccagcaggccuuagcugaugcucauggauccaaaacaucaauaguaaguuacuaagccuuaucugcugcuccuuaaauugacagagucaagaauuagguaaccagggaggagccacagaggugugugaaugggaaacuagacccaguccuggaagaugagcaggaaauggagugggagacauugauaccccaagacccuaguuaggcaaaaagaaaaaaaaaaaaagacaucuaggcugggcacgguggcucaugccugcaaucccagcacuuuaagaggcugaggcuggcggaucacuugaggccaggaguuugagaccagccuggccaacauggugaaacccugucucuacuaaaaauacaaaaauuagcuguguguggugauaugugccucuaauuucagcuacucaggaggcugaggcaugagaaucgcuucaaccugggaguugaagguugcagugagcugagaucaugccacugcacuccagccugggugauggagugagacucugucucaaaaaagaaaagaaaaaaaaaagacauccaguccauccagagagcccgggacccuuaucuaguaagaaggcagcugcaauagaaagaggaaggcauuuggugugaggacucagauacguauuauguauaugugguggcaggugggaggaggguggugauggaagcuucuagucuuggugguaacauucacgauggaugacauagaagaggcugauuguuaaagggaaaaggaugaugaauuagguuuuggguaaaguuauauugcagccuucauugcaagcaaugcagugccacauucuauguuguuaauacgcacaugccccagauugcacauuuggggaugagggaccucucuauaucuaacuuuuacugguuugagagcgugaaugaagaaaggcucacaccacugcuaccaucccaucugucuuuuauguugaacuugugcuuucuuccccuaguuuguuuaggucuaaguagaauacuuugcauaggaaaucgauaaaucuucuauugcuguuugagugauggggcaguuucuuuauuaccagacaguucugcgagcaauaaauauuucuaauauccugaguauauuuauuucuaagugggaguuagaguaaugagacauuuacuaacgcugggcucgacucagaauucagaaacagaagguagaugacuggcaaggacuguuccuacucuagaguuuuaaggucauuagaaagcuuuuguuuuguugaaagcacuguacuuuguguacgauaugguugagccuuuuagaagguugcugagacuuacgucuuaucuuugcuuauauaguaucgacuagagguuggcaaacuuuuucugugaagcgccagauaguaaaugcuuuagguuuugcacauacauucucugucacagcuagucaacgcuuguaagaggauagcagcuguagacaauauguaaacaaaugagcuauguuccaauaaaacuuuguuuacaaaagcaugcgguggggcgccuguagucccagcuacucgggagaccgagacuggagaacggcuugagcccacgaguuuucgaccagccuggguaauagaguaagaccuugucucuauaaaaaauaaaaucagccgcgcacgguggcucacaccuguaaucccagcacuuugggagaccgaggcaggcagaucaccugagguugggaguucgagaccagccuggccaacauggagaaaccucgucucuacuaaaaauacaaaauuagccaggcaugauggcgcacuccuguaaucccagcuacucaggagguugaggcaggagaaucgcuugaacccgggagguggcgguugcaaugagcuaugaucgugccauugcacuccagccugggcaacaagaguaaaacuccgucucaaaaaaaaaaaaaucauaaagaagaccaaaaacauuucaggcuggauuuggcccacaggucuagguuuucugacccuugguucacuauaugagccaugggggcagcaguucugguuugaucaaccauuaacugugugacuuaccuucucugacucuccauuuuaucaacuauaaaaugagaucauagaagaacaaguuugugguguuauuuugacacugaaagagaucacaaaaguaguuuuguauaguugcuauaacauaguaagguacagaaaauguuagcuaaaggggaacaaaaaauccauuucagucggcguuauacguaacccugauguuuaacugcgauuaucuuaagguaagaaagagacacuggcaaagcagaauuuuugaagggccaauuaagaucacaacucuacacaaugagcugauguaaauaagguauauauugacuuuuaauagacuuaaaaagaguugaugagaucauggaaagcuccacguggccaauauuguuauuauucuguagaugguauuucuuggaaauuuuguuucauucccuuucuggaagugaguuggacuuuuaccuguuuuuuggcauagauuuggucucuccuccucccaguaguggagguguaaggaguaaaaacuuuuccuagaaauaaaacauaacaagcacuuacugagugccugguguguguucacauugugugagguguuaugacugcagaaugaguuuuccauaaucacugugucugcauuggaguuggaggagaauaucuuacacagagcucccaaaucccuugcaauuuccugggugaucaacuaucuuuuguucuaaugagguuacccuuaguggacaugaugcuaaggcagcauauaaauaagugagggcucaugugaugugggcuguguaaaugugccaagauacuucagugugagaaaaaaagucacaugugauggcauuagucuguggaagcuucguggagaaaacucuggauagggacuuuggaaguguaguuuuucuuggcugaguaggucucuuuccuaggaaauaauucugucccauucccugcagguaucaaguuuggauuuugaugaauaaagugucucuucguuuuaaaaauagggcacugaaucgccaaggcaguggcauacaggguagaacuucguggccauggcccacguggacuguaauggcuucaggcauuugguuuugcuucacacuucaaagaacugaaaagugaaggggauuuauuuauucaugaaaaccugccccacacaacugcucugugugccuggaauucuuguugugggugggcaggcugaucuggugagaacaguaguggaaagaggagaggaacauuuccucccuaggauggaagucccauagagcacgcauuugagacugcugaguucauugccauaugcuagcacauuaaacagagugcgccauagaguuggggcucaaaaguuucuuuguaagggagugagauaauaauugagcuaugccuucugcucuuaauuugguguuaggcauacaagcaggguaaucuaaugacagaaugaacauaaaacaagugagacugauucaacagaugaggcuguguugaauguauaggugggcagaggugagaaggagcaacuguccaucuuggaguucaggaagguuuuggacaugguguuguacgaacuuggucuuuaaguaugaauggagauauaaguugaauggaaauauaccagguauuucaggacaaagagaacacaggagaacaugccuaauuguaggaauggcagggcaaaggaguacuggaauuaaaaaacaaggugggggccaggugcccccagaggcucaugccuguaaucccagcacuuugggaggcugagguggguggaucacuugaggucaggaguucaagaccagccuggccaacauggugaaacuccaucucuacuaaaaauacaaaaacuagccaggugugguagcgugugccuguaaucgcagcuacucaggaggcagaggcaggaaaaaucacuugaaaucaggaggcggagguuacagugagcugagauggcaccacugcacuguagccugggcaacagggcaagacuccaucaaaacaaaacaaaacaaaaaacaaaacuaaaccaagguggauuugggaaagacuuauaagcccucugauugagcuccuuuguuguugacuucuugauccucuuuaauucaggaaucacaguuagauuucuuagaauccuucuuugugcuccaaguaucaaagaccuuauggggcuccccagccauaauggaaaaaguaauuucuuuaacaggggagacaccagagcaagagcggagauggggguacgaggggguccucauuuaugcagcuggccagagcuccucauccaacccggggcuuagugaggugacagaugugauguuggccaauguagucuuccuuuucuuucuuuuuuuuuuuuuuucugaggcagagucucgcucugucacccaggcuggaaugcaguggcgugaucucagcucacugcaaccucugucuccuggguucaagcgauuccccagccucagccucccaaguagcugggauuacaggcaugugccaccacgccgagcuaauuuuuguauuuuuuaguagagacaggguuucgccauguuggccaggcuggucucaaacucuugaccucccuuuucuuuuuccuuccuuccuuccuuccuuccuuccuuccuuccuuccuuccuuccuuccuucuuucucucucuuucuuucuuuuucuuguuuaaaaauacaucuauauuuccucuagcuuguauauaaacugaccucugcuuuaaguauuagcuauuuauugaggaacacgaugcaugggccagacacugugcuaagggcuucaccuguaauacucgguauagacuucuuauaauauccuauggguaagauacuauuauuaucccuacuccuauuguuuuggggcaggcaccuuauccauuuguuugcugcuguauuccccaugccucaaaaggugccuggcacuuacuaggugcuggauuuuaaauggauuaaucacaugcagaguaauuugaccaagucauacugguuguauaugggaguuggagaugaagacuguaggguuucaaagucuggacucguuacccugcaccaucucugcuuucugaugccuaguuagagaaagaacguccuaucuguuuuagacuugaggacuucuuuuuaaugacuuuuucagacuugaggacuccuuuuuaaaguuguagacuguuccaccuagauccuucuggucauucucuacuuuguuguggauaaaaauuuuauaauaaauuagguaauguuuaaaaguggcuuuguauuuuguacauuugcaacaauguguguauuaaccucuccuaauuccaucuacuggcaaagcuugauuugaugagaauuggguccccugcaguaaugugacucugaagcugacggauuagagagcuugugguucaggcaugaaccuugucucuuggguuggaccugagucuagacugacccuagaguuggaaauuuaguagcuuaacugacagaacugacgugaacaauugcugcuuuuuauuaaacaagggcaguucaucucauucgcaaacauuuucuaagaccuugugcaccaaauggugagaaauaagaaaguucccugcccagggagcuuauugccugcuggaggagauaaaacuuuuggaaaugggguagaaugugguaaguguuuuaauagaagcugcaggagcuuagcugagggaggagaugaccuuuggauggugucccacagacauaucaguggucuuuggaucuagaaggaccccacuguugucugccuuguugcaauuguagcauggguguucuugaaggaagcacaaaggaaauguccacugacagaguugaagaugacacuggcccaguagguuugcuauccaauuuauggaagcaaggcaaaaacauagacaaagcacaggagauaaugaaggugugaaacauguucaaaauaaucaagaacccaaacagauaccucaaauuucuucccaccccaucucccagguaaccaaaauagcuaccugguuuuuuacaacuuuucaucacuuuaaauacacuugggauucccauuucugagaaacaaagacagaggaagagagaauugcaaaaggcguuaguaugaaucugugguuugcggacugguaauuaggccagcaggcuuuuuugaacuacagagcaguuuguuaaaaauaauguuaaaaaaaaaauacaccaaaaucagguuucucaccauaaugagaaggaaaguuccagaggucaaacacugggccuuucugcuucucauuugagauuuuuaugagccagaaagcuucuucauuaaacagcaauuucaacauugcaggacuguauguuuuuuggguuguuacgcuuucacagaauuuuugaaucauagccacacuucagaaugaaaauucaaagucaaaaugcuuacauggacuuaggagaagugcuauucucugccuuucuacuguaguggcuuuauuuuguuuauguacuuguuuauuuauuuauuccuggaagaaaucaucaggccugcucagucaguaguucaucccaccaguucaacuggaagggauuuuuuaaacccuuucaccuucacucauaauucaugucuuaugaauuaugaauucaugaauuauuggugccugcuugggugaucaguaaaaauaauucaucagcauuuucuucaaaaauuuucacucuucuggcauguugauaguaccagucgguggucuuuucauuguaccuucuggaucuuauuuuuuuuuuuuuuuuuuuuuuuugugacggagucucucucuuguccaggcuggagugaaguggcgccaucucggcucacugcagccuccgccucccggguucaagcgauucuuccgagucagccucccaaguaacugggauuacaggcgugcacccuuaggcccagccaauuuuuguauuuuuaguagagacgggguuucaccauguuggccaggcuggucuugaacucccaaccucaggugaucugcccgccuuggccucccaaagugcugggauuacaggcgugagccaccgugccuggcauuaauguugaaauagaauagagguuuaaccuuggaauaaaagaaagaaucagcaaauacauuaucugagccuacauacacuuuguaaaaaguauacuuccacuguucagaauuagaugauggcacaaaaccuguugaggucuucauucauccuuacaaauguuuauuaugcugagugucccaggugacuggauacaguggagugaauuagaaauuugaaauuauugcccugaggggaccuacauucuucuuguuggagugcgucugugugggauaagguagacaaauaauauaggaaauucaaaaaauuguuucagaccauaguaaguucuaugccagaaaugaauaguccauaugauaagaggaacagacauugugagauguuggaucuauaggaaaagaggaacagacgccauguucaggccauggugcauguacaaaagaccuuuuucugaaaucagugcaggcagugaguggccagguguauuaggaucuuuuagauguaguuuaaugaagaguuuauggcuuaaagugagacaguauuacuucagagcucagcuucucuccuuggauuuucucucagcaaaugggagaaguaacgucugcccuucggaguuguuacaaggagacaagauaaacacaggguccaagugcuugguaaaugguaagugcuguuauuagagucagguguucuagucacagguccucaacagauacagcuuuggcaguaggaggugcagcugaccugagcuguuuuuaaauuaaaauuaaagccaccuagguuucauuagucagcuagcagagaggaggucugggggaccaugcuuaaccagagucagaugcuuggaggucauuggacucuacagggauucugcacagucacugggacagaagacgugcuccacaaauaggcaaauauccuuugacuucaauugaauuuauauuuuauccauuaagggagccaauuuaccuccaguguuaguuguuauuuuagucauuuacccacuguucaacguuuuugccuuuucauauauuuuguguuuuaaaugccauuaggauaucuacccccuuucccacuuuaaaacaaaauaauuuuggaacucagaacucaaauccuuaauuuugaacuuacuuucacuuuuuaaaaaaucuuggccgggugcaguggcucacgccuauaaucccagcacuuugggaagccgaggcaggugaaucaccuguggucaggaguucgagacuacccuggccaagaugguaauaauacaaaaaaauuagcugggcaugguggcgcaugccuguaaucucagcuacuugggaggcugaggcaggauagucacuugaacucgggaggcggagguugcagugagccgagaucaugccauugcacugcagucugggcgacaagagugaaacuccaucucaaaaaaaaaaaaaaaaaaaaacaaaaaacacucuuguugauacaaagaaagaucuagaauuaaaaacuuuacaggaggaaagugaaaaggcuggaacuaacucacccaaaauauuuagcaaguuaaucauaaauaagauaauagauuuugagucuuucgguuuucaguggagaacuuuauauuugauuuugccuaaugugugaaacuguauaaagcauacucuauaguauauguuccugcugccuggaagcagacacaucaucaaagugugugugugugcaagagaaaacacauuaauuucucuuucucaguuugucauaagaggggagugcuauaaagaaucuucuggcugggugugguggcucaaaccuguaaucccagaacuuugggagaccaaggcugcagugagcugugauugcaccacugcacuccagccugaaugacagagcaggaccgugucucaaaaaaaaaaaaaaaaggaaucuuuuuaccugcaaauuguaagguacucgagggcagacauuggcauuuucagauacaugugacccuguguguuugugugaauuucugugcacacguacaucccccucccacgccuugacauaaugcauacagauaaauguugagguucaguggcagcuguuuuguuucccacagacauuuuacuuagauuauucuggaaaacauucugaagagaaucacaagcauugaucauaaaguuagaagaugugauguuuaagacaacauggacauaggaauugaaauuuucuuucccauugucucucgaguguuuuugaggccaguguuucuuacucuugcuugaguauaccuggauaacaaaauccaguuucuaagauuucugcccuagagauucugauggauuuggugugcugcgugccccuagacccuggagauucuuaggacaaagcaaauuugggacacuggggaagaaaagaaaaagagaauaagauaaaguucaccugaaaggauauuccaggaauggggagcagaguuugcaaggucauagaggcucaaaagaacaauggagaaagggcaguagaugguggggguaggaagaacaaagccuggaaggugguuaagagacacacaaugaagggccuccuguucaaggcuaaagguuucuacucuaucauggacccagugcugugaccuuacuaaauguguacauuuuuugucuuuacugaugaucacagaaguaacauuuucuauuaaaaacggaaacauuacuagaauaaaugacccccaaagggaaauucucccauaauucuacucugcucaacucaauugaaauuacuauccucaaggguuugugacuaaacuggaauuacuauuguaaagcaguggauaagauggaaugagaagcucaguccuauagauaaguuaucaugcgauuuacuaucccaggcaagagaucaguggggcuuugaauaaggccuaggaggagaccgaaaaggggcggccacugagagauauggagacuauagaacaggucagacugugguaaagggaaggcgauagggggauucuaaggggcucugagguuucuggaauggcuaacagccugaauacuggugucauuaagcauguaggaauacggugggaagaucauaugguuaaggacaugucaacuuugagguacccagggggauaucugugugaagaugucuguaaggcugcuggaaauuuaaaaguggaaucuaggagugaguuggaauuuaggaauauagauuuggaaaccacagauacaugaaaaaaaaaaaaaaagacugagauacagagaaagggaggcaagaaacagaauaguaaaaugggucauuacugccuaaguguuuuuguuugugaagcuuaaugagcuaagggcucauucuuagguuacaguaguggaagagagaugaguaaauuaucucugcaggucaaagagguuauagaaucuguucucauaugaauuaaucaaauuuaacuucucauguugaaaaguagacaacucauaaaggagcuaucauguaaaccuuuuuuuaacuuggaagaaguccaaauacagaauacuuacagauugaagaaaaauguucaguuuagauuucaaguguggucauuuccauagcuauguggugaaagaaauuguguuuccgaaaaucguguuuccgaagaggcuauguuuuuaaaggugccacugggaaacuaugacuauuaugaguuuugcaguuuugacauuggaugggguguguguguguguguguguuugaauugaguuauagaacuuacauguaaaauuauucaucugacuuccggggaaaagucuguuuuuuuugaaauaccuuuuuuuuucuauuuauuccuuuaauuauuauacauuagaaagaaaugacaaggauugcauccuaguuuuaaaaugcugaacuuuuaaaaaggcaauuuuauuuuuaagacuuuaaauaacucuuauuaguaauuggauuuguggcagauuccaagagggugguuuuggaaagcacaguggcuuccgguggcuucagaccuugguuuggaauugcaggccuaccgcacaccgacucuggagagugacuuggagccuccaaauuccaagcuuccugugugcgagugaggcuagcaaaccacauugaguaggacagccugaggguuaaguuacaccauggaugaaaagcugaugcaugguucuaacuugcccgggcuugauauucaaaaaaugucuauuccuuuuccauuuucucucuuuuccaaaaauccucuugcucuguuucuguuaagacccuuuugcaacacucuguuuuaacauggugcuuaauauauugucagaaaccacauuuuccagugcauauggugcaguuuuuaauuucuaauuuagcuuuuuaauuaaaaacucaccuuuugcuccuaauaccuauagggguugguuuccaauucugcuuuucuggugguaacugaaucucuguucucccagugaugaguguaacccucuguguacaaguaggaacaucaugacugccaugcuugggccauugguauaauuauuucugcuaccucugaagacuguggugaggguagaaucagaguggucccuagccaucgucccccuuuugaauugguagucaucuugaaugucacagcagccuagacuuguagaccauaucaggaaaguagaagcaagaauucugucgugugcuacuccacuccaagaugcuguaggucaucagaagcucugugacuucagaugugcaagugaggccaaggcacugucacauuaauaucugugugaucucgguggcauugugcuuuuccaucauugucagggcugcugggcucucugugccuaaaagcugcuucaaacaagcagcucacauuccagagcucugagagauguugucagccuuuaacaguuuucucuucgagaagacauuagauucuguacagguugcagaaacguugucuuaagguggcuggaaggaaguguuugaaauaacacaugugcuugugauuuugguaaccaaggaaacauguaccugauacaaagcuuccuuuaaaaaaugaugguacccuucugggauugccucagaaucacccacagcaagauuccaaagggauuuaaaauuaaaguaggucacuuccagcaacuguaucaagaguuaacagagaaucaccucuuuaaaaaugaagaaucaucucuuuaaaaauguacuguuuagaagaggaacccaauacauuguggauacaauaugcuaccaucugaauaaucugagucuugcuuauaauggauguuuaauaagucuuaccuggauuaaauuuuccucugcuucugccuuauuauuuguauuauuuuuauucuuaguuugccuucuauuccaaauuaauccuuagcuucucgccaucucuuuucuaacaguuuguuauuaaaauuauauagugaugguuaaugcagccacuaccuguacuuugcaaacagauuuugcuaauacauccaugauauguagaaugauagaaacuggaguugacuuagaagauaaucauauccaaacuuuucauucaauaaaugagaaacuguugcugggugugauggcucacaccuguaaucccagcacuuucagaggccgaagcagaaggauugcuugagcccaggaguuggagaccaaucagggcaacacagugagaccccucgucucuacaaaaaccaaaaaauuagccaggugugguggugcacaccuguaguuccagcuaauugagaggcuggguuggguggauugcuugagcccaggaggucaaggcuacagugaacuaugaucaugccacugcacuccagcuugggcaacagaguaagacccugucucgaaugaaugaaugcaugaaugaauaagaaacugaaucuuuaggaauaguuacuuagaguccuagaagucugacuuaagucugacuuaaaucuuaaguaaguuaagagucuggcuuaaaucugaacacaguauguacauuuuaguaauguucuggacacagagaccugagccuugguacagauugugugguauuauuaccaacaccguuuuaacauuuauguuacaaaagacuucugcauguuggacaacaggaaagaaauacaguacuuaacucacaaacaacaaaaggauuaggacaguccuucugaaagcaggggucucaacaucaaaugugacaacagccauacaggcuuuacaaauauguagacuggccuaguauaagagaacagggagugggcacauauuuagcgcauugcaaugggcauaaauaccugaaguuacuugacccguggaagagcccuugacagccagauaggcagcaaccccuuuccuagucuuuguugucauacacuguaaacugaaauugugcugcauuuuuuuaagugguacauuucauaagagguugaagugaaaagaauguaccuagaauuuucaccugggagaaaauuuuauuccugauucuugguuaucuauaaaauuauauaccuggggauaaaaauuucaguuuagcuuaaaacuuaaauuguuggccaggcgcaguggcucacgucuguaaucccagcauuuugggaggcugaggcgggcagaucaccugaggucgggaguucgagaccagccugaccaacguggagaaaccucgucccuacuaaaaauacaaaauuagcugggcgugguggcacaugucuguaaucccagcuacucaggaggcugaggcagaugaauugccugaaccugggaggcggaggaugcagucagccgagauccugccauugcacuccagccugggcaacgagagcgaaacucugucucaaaaaaaaaaaaaaaaaaaguuguuacccucugugaaagacacugugaagcuuugaugguauuuuaaagacacuagauuauauuagagagucaugaaaauuagcacagacccugaaaaaaaucuuuauuguucuaaaacagugguucucaaaugccucggaauccccugggggacucuguggagcacagauugcuggaccucacucuaaaauuucugauucaccacgucuaggaggggaccugauaauuugcauuucuaacaaguucccgggaguugcuccugcuguuucugcuccggggacuacagauugagggucacugcauuaaaagaaacccaaguuaauuuaauacaaguauugcauuuauuaggucggugcaaaagucaucgcgguuuuggccauugaguaauggccaaaaccgcgaugacuuuugcaccaaccuuaacgacuuggcauuuuuauuuuauucucaacccaauugcucagccagucacugcaaggguguggcacuucagauagcacauuauauaaucagugguuugcugguaaaugcuugacaauuggcuuuaggguugaggagcagccuugauuugcaguguugccaguuucugugauauaaacagucucaucguagccaauuaaaagcugucaaucugacauuggcuuguaaaauuccugaaaauuuaacaguuaucuucaguacaccacugagucauaaggaggcguuaaaggucagguugaaauuuaaucucagguugaauggacccuuacuaucucuuuaaggggcagguauggagggagaugaaaaauaagcccuuguuuacuucucggggauaggacagagaugugugucuucaaggggaaggagacacuauaguucaaaagucaaagccuggcugcucacagaggguuuuauuggcucaaaagccuuuuaacuuuaaauuagucacugacuuuaaguaagauuuuucccuugaaaaaaauauuugaauuuuuuuuuuuuugagauggaaccucacucugucaccccagcuagaguacaaugacucgaucucagcucacugcaaccuccgccuugcagguucaagcaauuccccugcuucagccucccuaguggcugggauuacaggugcgggccaccacgccuggcuaauuuuuguaguuguaguagagacgggguuucgcuguguuggccaggcuggucucaaacaaacuccugaccucuggugauccgcccaccucggccuccuaaagugcugagauuacaggugugagucaccuugccggccaaaauauuaggauuuguauauuuuauugaauggaaaaucagaaauugcagcaacuccggcccagauucuuacucaauggcacuuagcuggagccgaggagcagcuguuccccccacaccccaucuguacuuuguuuagacuggacaggcuguuucuagaccauccacucccaggcucucaacuaggguacacaugggaccugcuucaucauugauacucaugccuucaagaauuuguaugcuccuucuuagaugcauguuucagaagggggaagggaagaauuugaucaccuuaaaaggaccuuuagaaacguaagagugaaagugaaccaaguaucccuuuuuguuucuucuucaguguuuucacuccuccuccucuuuccuuuggaaggggaaaagcaggaaagaggaauuacauuuucuagaaacagaagccaagaccucaagaagccucuaacuggccaggcacggugguucaugccuguaaucccagcacuuugggaggcugaggcggguagaucauuugaggucaguaguucgagaccagccugaccaacauggugaaaccccaucucuacuaaguacaaaaaaauuagcugggcgugguggcacaucccuguaaucccagcuauucgggaggcuaagccaggagaaucacuugaacccaggagguggugguugcagugagcugagauugugccacuggacuccagccugggcaacagagugaaacuccauuuaaaaaacaaacaaacaaaaaaaacccucuaauuucucuuucuaaacuguagaccugguaucuagaugaguuuauuccugauaaaagcauacaugcuccuaggagguuuaauuacuauuuauaugguguacgcacuuuucuuuucagaauacuguuauuuauuugucacuucaguguuucuuuucccauugcucuucucucagccucuugugucagcccugcccaggcuggcuuuuauauccuuagccuuuuuuuuuuuuucuaaguaugggaaaacauaguuuagaaguaaucccuucucacaaaaucaccucucucaaccacucugugguuauuuuauuugagggugguggaaagagggagauguuuguagagccucagagagaaaagcacgguuuuaaaucuaaucauuaucagagugagagcuaaauacuuuugcaaccuucaugagagauaucccugggaauuuucuggauaaauaucauucucaaguuuuggcagugugcagaauuuaggccacccacauuguauggggcauaaaacuguuuagugaaguucaaauaauguguugcaagaguuugguugaacuuguaauuuaaccuugaggaaagcaaauacuugugggaaaauauuugugcucaaaaucaauaaggaaugugcaaguaggaugcccucacucugagagcuguaguuugcagcugaagcuaguacaaaguggcauuugucaguaguaaguaaaacgagcaaaguggauggguggcaagacuuugacauuauuggccuaucacauucagaucaaguucaucugcagaugaauagucacuaagauuuguuaaguguuuacuuugugccacauaguacaacacagaacuuuagcacuauaagacccugaccugugagauggggaaauugacucuuggagaaguuaguuacuuugugguggucucauagcucaaagggggcuauaauuuagucucagaucuaccugaccucacauuucagauaacuuauuaucugugcaugccauggcccuuaaaagaggauuacuuguaacuuuuuauuuauuaauuuauuuaauaaagagaugaggucucacugucacccaggcuggagugcgguagcauggugccucauugcagccuugaacuccugggcucaagugauucucccaccucagccucccaauuagcuaggacuacaggugcacaccgcuaugucuggcuauuuuuauuuuuuguagagacugggucuuacuauguugcacaugcuggucuugaacuccuggcuucaagcgauccucccgccacggccucccaaagugcugggauuacaagcaugagccuggcacauuauuuuuuauauucaucaauguugaaucuacaaauguaucucuguacaacugucuuauuuuaaacuccuaaucuagguacauguaguccuuuguauauugccuagaacauacugccuaacuagacaaucauauauuuugauuuuaauguauauugauauauauuuauggugaauauaucuuacaguauuauucauugcuuuauggcuaauuuauuuauuuuuuuucuuugagauggaauuucgcucuuguugcucaggcuggagugcaauggcgcgaucuuggcucagugcagcuucugccucccagguucaagcgauucuccuaccucagccuuccgaguagcugggauuauaggcaugcaccaccacacccggcuaauuuuguauuuuuaguagagacgggguuguuggucaggcuggucucuaacuccugacaucaggugcuccuuccgccucagccucccaaagugcugggauuacaggcaugagccaccacgcccggcuggcuuacuuuuuuuuuauuuuauuuuuuccuuuuuauaauugacucauuugucaacuacucauauauaaauauaauauauauguuagucauauguauauaauuuauauacacuagugucauauguauaucuauauauguauaucuuauuucauuuggaaaaauuagaaacuaccaggcuaucagacacccaccuaaauaaaacaggaagauucuuauauucuauaaaaaacacagcaucuggugaauggaacauguuggaauuucuaucaagaauucuuuuaugcaucaauuuucuagagguaucugguguuuuuccaauuaaccuggaaauauguuuuggaaagaauuuauuuuuccuagaggccagaugcguccuugcccuuuccccaacauggcccuuggccaccaguggaguguugggagcucugggaagagagcggcugccgcagacguccaggcaugggcacuuucgccaucugucccguguuguagguuuucauugcuuuaguuguuauccucaacacaagggccuuuaggggcugggaccacaacucugccuccuauucucccauuacagcugcauaauuaguuguaaaacuuuuacuuguaggugaaaacucauuuuggcaaccauuaauucccacuguaauucauuuaguaacugcaguacuucuauuaaugggaaaguaaggucaagcaucaagcagcaugacuaauauguguugauaauugcauauuguugauaacuguaaacucugagauugcacuaauaaaagguaauaauucccaaggcaaccaggaagggaacuggggagcggcugcaaauuuagccuuugccauuuugccaguuguuuagcgucauuuacguuggugggaauucuagugcucauaaugcacuggaagauuuuuuucuggacuacguaagaguaauuggagauugauaaugugucgauaugggggcaugggaagugacugaugcuggggcagaugguuucucuagacaauugcuaagagggugugcaagaaaguugcagcuuagcacaagcuuguguggucaaaaaguaaucugcuugcucuuuggacccacauuuuauguaagcugauacugagagcaagcacuuguagagagagggaggugugaagauaguccaaagacuugagcuagagucuggcucugccauuuaggggaaugcccuugagccagaucuguuaaauucauugagccucaguuucuuccacccuuguagaauguaguuauucuuguaaagcuguugauagcauuaaaugcgauugugugugugugugugugugugugugugugugugugugugugaaagaaacugauuuggaaacucgaaaaccccucuauaaacaggaaccuggaagucuguuuguccuuucuuaauuuucugaugauacaaauagauauaucauuguaaaacuauucuguguacuugaguuucuuucaaaacacuaacccugaguagugcuugcaauuucucuaaaaaguaaauuaucacagaaagucaguuuaugacccauuuucuggggcuagaacuaccuuucuuuuuggggauggggucucacuguguugcccaggcugggcucaaacuccuaggcucaggcaauccuccugccucaggcuccaaaguaacugagacuacaggcacaugccacugagcccagcuggaaguaccauuuuugguaacucagauuccuauagcugugcauggggucauuaccuuggacaaucugaugccugagaagacucuguuuuguguuuccaaauggaccaucuuauggaccaucuuugcuuggaaaaggcacuguccagaauguguggcuaauggauuguugaaggagcuggacauggcccaggcaguccggugaaucagugacugaugguuguuuguaguagcuaaugcuguucccuccccccaaagauaaaagaaccaaaaaaccaucaaguggcuugauuugacuauagcagcauuugugacagaacugggaaccaaaugaaaaucaacuuaguacuacucuucaagagauuuuuuuuuucuccagaggcuuagcguaggucauaccccagauguugaugaugaauauauugauugcuaucucagggcgaaaucucaaaaguuuguguugcccuuuuaggaauuucacaguuuauauugaccuauaaccaagaggcagguucauuauguuuaauugcauuaaaagauaaaagaaguagagaaauugaaaggaaaaagagcccagagauuguuaccuuuuuaucaagcaacagcaugccacaaacuuugcauaaauaaaaaauaauaaccugagccuuucaucuugggaaucuaaugaaauaaaugugugcuguuuuccccauuagcccucaccuuagccagcccuuacauuguggacagaggagugaugucauuauuugugagcuagaugacuggcucaguaggugccgugugguuccuaagaagauuguaggucuugccauugcgucuugugucucuugcuguacagguggaaacaucuguguguuuucauuauggugaccgcuggguaacuggucgccaaccucuguaacugaagaaacagcccucacaauagaguacacucuuuucccauccagaguguggcaguccuuuucugcgugagccuuugucugcauuuuuaccucuugcaaacccuccuccagccagagauugauaugccuggaugauuuauggcagugauugucagaaacuuuugaagcccauccaauuucaggauucggguucucauuucuugucauuuauggcacauuugaugaauucucacuaucagcugacauguuucauaauugucaaaacuuugauugaagugguauuuuugaaaaaaaaaauuauggaagagaaaaaaaggaaacaagacuccuucaucacauuuuuuucuccugugccuaaaaccgcuuugccggagguucacagccccaucauuuagccucucagcuacuugcuggccuggcaagucagucuccucacucuccuuuuacagucuugugccugcauuuacuggggcuuuucuuuugcuuguuugggccuuuuuuaguccagaugauaaaagcuuucgaaaguagcccuuuggagaaaguuucuaagcuuucccuucagcugucuuucaagguauauccgguggggcaugaauagauaauaauagcaagcucuucucucauuuuguuaucuugaccuagugcgguuuguuuuguuuuuguuuuuauuccaugagccaacauucuuuggcuggaauguuggcucuccaggucuuuggcugaggucaaaacuuagaagucugcuccuguacuuuggaguucuccuccucauggugaagcccacagcggugagccaggaguggaucugguuccuucaucuguagaguuuuguuuuuguuucuuuaccuaccuuaguccugugucucuuucuaggucagagaaaacuucuuauagcaaaugacuccugucccuucccacucugacccccaguacagugacagggaauuccugcuucuccuagcuuguccuuucucaguuucuuuccucagaagcaaccacuaucugcagugccuuuugucucuuucuagauauacuucaugcauagauaaggauucauacauacacguacauagaaacacacauauaaacacagacaugcgaauaucaagauauaguuugaaaucauaauucugaacuuucacucuaguguuuaaaacacaucaauauuuaauaucucacugcugcuaguuggaugaaagaugaccauuuuaucaugcucuacaaggaucaugccuccugugaucugauuucccuccaacucuccagccucauccagcacuuuucuccucuuucucagaccucuaggcccacuuccuguucuucuguuaauuccucaaacaagccuucccuuguuucuuauauuagcugucacucuguuacauucuguaguuucuugacuguucauuuagggcauuuagcacaguuuguaaguuccauauuugugugauuauuuaaauagcaucuuucugccucuacugaacugcaaguuccaagaagacagaaaugaagcuguuuuuuuuuuucuuuuuuuuaaagcuguuuuaucccuagagucugugcauuaccuggaauauaauaggaucuccguagaucauaguugaaugaaugaaaaacaaauggcuggcuggcuggaugaaugaauguaugauguagaaacuuccuuuggguagggaggaaaugcuaccuuuuggaaaacaguuguguuuuaguauccaaacacauguuuucucuguagaccuuagguauuuucuuuuuguuguuucuaaccauuuucuaagaagucaguuauucuagaaaggcugaucauaggcaccgucaaggaaaaucuuggcaguuauuaaggguauuagcuuacaggguuuacauuuucucaccuuccuugaucucuuuuguuucuaccgugguuuauuuuuugaaacauaaguagucccuguuuuucuucuaagauuucucccacauuuucauggcuuaauggggcauccaggagauaauaagugguggaugggagauagggggaaggagaaagugagcaauguccacucuagacuuacaguccucugaaggcaagauuagggucccacaucuuuguauucccagcauguggcacaagguaggaacuucacaugcaguguggagccacaaugugagggugaacaaauaugcaggaagaaaggaagaaauggcauugcuaauucuggaacuggcauuaucguuaaugagcggcucuguaucugugcucaagucuugcuucuaauaagcugcuggggauauguauuaccugcuguugcagcugcuauuucuuucaaauuuacuauugcuuuuucccuuuuuaguuucuucaucuaccucuuuaguguuaaucuuugugucuaaaaaaagaaaacauagaguuuggagcaaggacagaaagauuaauuucuacguacagcucugcaucuggacgugguccucauuuauuuuugaaggcugaggguuuaguuuaugaugacuacauuuuccuaguagccugagagccugcuaggaaggcugucaguuuauauuucuauugguccacuucuugcacuuaaaauggcucagagagugaagccauuccuauuuuaaagcuccccuucugcugacagcuuucuucuuagccaaagccaggaagaaguauuugcuauuacccauuguuuuagaugugcuaacaccaugcuaauugccaauagucaggaauggucuuucuuaauaacaauuccugaguuauuuauaauuaacccauuguuuauauccuaguaauguuauuguauuugaagugauugaaaauagcuuaaucugucuuaagugaauaauuucuccuuguuuaccuuauucccagcaaacuuccuuuuuccugauaauacaaaaguaaacuuuauucuauuucauccuaagugaugaaacuauuuugcccauuuaugaaacauuuugaauacuuacaauugguuauuuuccaggaaauauugggaccuugccuugaaauuuaguaugguuuaugacuugguuuaugacaccagacagaagcuacagauaugaauccucuaaccaccuguuccuauuuuccuacccuucauuaauuugacuuuugacuuuugauaaaguuaucacauauuaaaauauacgugggugcuaagccuuauacugugaauguuccaggguucaaauauuuuauuuuuacugccuuccccaggcauuaccuccauaaaugauagaacauacuuucuuuuugucaugagaaguaauugguuguuucuuuuaaccugucucguugcauuccagaaaaauaauaaaucuuuaaaauuauuaaaauaaugagcaacaguuauagacauuguuggguuaaccuugggaguccaaagcugauccuaagaggaauuaauaauauaucuuuuuuuuuuuugggccaggcgugguggcucaugccuguaaucccagcacuuugggaguccgaggcagguggaucaccugaggucaggaguucgagaccagccugaccaacauggugaaacccuguuucuacuaaaaauacaaaaauuagcugggcgugguggcaugcgccuauaaucccagcuacucagggggcugaggcaggagaaucgcuugaaccugggagguggagguugcagugagccgagaucgugccacugcacuccagccugggugacagagcaagacuccaucucaaaaaaaaaaaaaaaaaaaaaaaaaaaaagaauauauaugcgcccggccaaguauaucuuuuuuuaauauauugccucccccugcauuaauuuuuuucuugcuuucccaguuauauaugcauauauauaaacuucacagauaccaaauagguuauugcucauagguaauauaauuuguaccugauguaaaggcugcaacugagguuucacugaugguugguuuaccuggaauuuugugaguuggaaggcuuacugaaaugaaggaaaaugcuuauguaugacccagcucucucucuacgcauugaccaaaauagguugaucagggcaacagaaaugauuaauaggauagugcagauuuggauaaagagcaaaaagauuaggauuugaaaguuggaggaugaagggagucauguaggauauagucagguggaauucggacuugcucacaaaaucccagaauacuguaacaaaagggcacuucuuuaugcuagaaggagauaauuucacuuuaaauaaagggaaauggaaugucuuugcccagaggauaacaagcaaauagaacucauuuucccgaagaaccuguguagucuggggugucagggauguguguucaagaaaaauuuaggcaaaacccaaugauagcuucucaaggguaaguuucaaacauucagacaauaucccuaacccuugagugaaccaucacacagggaaacgauucuguuguacagaauauguuuugaugccacugucagacauaaagucuggugggaacuggacuucuacucugacccagggugacaauuuuuauguuuuuaaaaucggccgucuuccagaaguguucauuuuacagugcuuauaucucaguaccugaacuucugcagaagaguuuuauuugagucauaaauuucuaaugucaaaaccucccugacaauuauuagccaaauguuuagcccaaaagagagauuaaaaacauauaucuuguaaccuagcuacccaaugaguuaacccagagagaauuuucauguuggaaguaguuucauaagacuuuggggagagauaccugcagaucugacauauuaguggucagaacaaaaaccuuuguaauacaugaucaacugucugccauaugaaaagcguauucauagaagcaacucaaagugcacaguuaggcaguccuuaccaauuaaagccucccucuuuuaaaaauuuuuuaaauaagaguucauauuugcacaauaaaugauuuauugagaaauuuuaauguguaagcuucccacugacucuaacugaaauuagaaagcuuugaaaugaacucauaaauauuguucuuacauacaaaauacacuggaagcuguaaaauguaaagcaguuuaucauugaaaagcuaagcuacauuaaagaauguagauuugguuuaacucuaucuuccccacgugaugccgaagaauuugcgaaguacuuuuuauguguuuuguuuuauuugaucuguguaacuacccauuaaaguuagaaggaggguggguauuacugucuugguuuuauagccaagguugcuauggucaaagaaggcuaagugacuugcuggaaggucacugauacagcagagugagggcugaagaacacacauacucugugacucugagaucuccucuccuucauccgugcuaacccauaauguaauacuauucgaucaggcacaguccugaaauaaccucagagugcuuaaugcugaagggcauauucuguguuuuaaucaaagaagacuaugacagcaagaauuagcugcaccagccccuuugucaaauguugguuagcugaauauuugaaaaagcucaauauuugugucuuugaucagauaaugcacuaaacauugauuuauagaggauuaucauagcaucuauaacguguuuuaaauaacacaauuaaaauaguuaugauuuuacauaauaggacaagaucguaauguagugcaaccacugaaagugaagguauguaaagaccagagucuuuucccuagacuacuagaauuaguaguuccuucuaauucuagcaaggcugaaaacuuguaaauagacucuuuaguaguguuagagugaacuguuuacauuuuaugugucuguaggaacugaggccagaugggucgauugcauccucuaguaauuuccaaaugaaguuuuauuaaaauccuuuccagacaagcauuuuuauaagaaugacuaauaaaaccccaaacacaaauuuuagguucucuuauuuuauaaaaacaugcaaguugcuucugaaguuauuggaagaccaguaaaauaauaaaucaguaaagauggaagaagagcagagacuuugagcaaccccaaaauaaccaggggugagcaacauugcugggcaucuuuugcacauugaacugcucagggcucugaaacaugagacuaugaaagaagcauuccucaugcaauggguuuauugcuugguuauuucaccaagcaccauuuauugaaaggcaguguuccugguggcuaagagggcagagucuggaaucugccaccaccacuuaccaaguggguaacuuuggucagaguuauuuaaguuuugucucaguuccuccaacaauaaaaaggggauguugacaauacuuaauacauagcgagugcuuaaaauugugugugacacacagaaaacuucauucuguucaggucacccugugagcauuguuggguauggugggaaaagaaagacacuaagaucuuagagaugacuucaagguuccuuuucugguccaagacgauguacgaugaauagucacaggaaaugacucuuuucugcgauagaaucuggacccaccauuuaccuugugguucugcucacuguuuagugcugaguugcuaauuuuaaugauucuuccuguuuuaagaagcauggcucugagucguauucucucucucugccugucuuucucucuguccacaaacacacacuuuuugaguacaacagcacagaagacgauuuagagauacaugugcucaagacuuaccucucucuguauaaaaguuugaaucucaauuacucccauuuccucuuucuuucuuucuuucuuucuuucuuucuuucuuucaaucguacugcuaugucuuacugcuuccuaagugaaaggggaaaagaaucaaaguuagggaaaucaaagguuucagaaaugaaaaacuggauuucuaaagcacucacauuguaccaacuuauuuugugccuguuccuuuaaguuuuuuuuuuucuuuuuuuccucugccucuagagcuaccaaaagcacacugaucaguuuuuacagcuuugccaugauaggugcaguaguugcuuuuuuauugaaccguagauugcagcauuauaaaacacacucauucagaggaguaaugaaggccauuuuuaauugcauuugggaagcaggguacuauuauuaaauuauaccuaugucuguauuggaaaaaagagagagaaaaccagguuguguuuucuuugggauuugagguuucccagagcuggagugaauucaggguugcgugacaaaauuuggaacuucagccuuuugggauugugagucagaauuuccccaguccugugauuaaccucaugcacccacaacuguuguaaaucaaacauccaagggcuuaguaauaacgaaauuuauuauuuccuggaagauaacucucaauguaugugcguauacaaguaagacagaguggcacacacagauuuuuacuuaaagauuguuguuauacacuguauuaguuuccuaggucugcuguaacaaagucuauaaacuugguggauuaaauaacccaaaccucacaguucuggaggccagaagucaagaucaagguguugccagggcuguuuuccuuccgugggcuguuagagggagucuguuccauaucucuugccuagcuucuggggauuuucuggcaaucuuugguguuucuggcuuuauagaaacaucauccugaucccugcuuucaucuucaccuguuuuuucccguguguaugugcauacauguguguguguuuuuccaauuuuuccccuuccuauaaggacaccauucauauuggcuuaggcacccacccuacucugguaugaccucauucuaacuuaacuaauuacaucugcaaugacccuauuuccaaauaaggacauauuuggagguacuuggaggcugggucuucaacuuaugaauuuugcagaggacacagcucaacuaguaacauacaccuauagaucugucuuuaguggauauguauauaucacacuguucuauacauuggagaagggugaaaauuaauuguaagaaaaaauugcuugugcaaugaauagcacuauaauccccuucuugacaguuaagggaaucauucuggaaagcgaaauugcucugagccaauguguggaaaauucugugcaagagcucauuccuuuuguugcauuuuuucaaagauucuuuuggcagugcugggcucgguccagaugccuuccacaucaggugguuuaagcauguguguacaugaucgugugcaggguugugggaagccaauuacgguuggaaacaguuguuuagcuggcaauuagauuccucacagucucgaauuauguugcuuuaaauuaagauuaugcagauuugaguugcuuugauaauuugcaaaagccauuuugggguuauaacuaaaaauguaaucugccaauuaggagauuuucuaccugauaucuguuuuguucauuggacuguggacccauuuuaaauauuuaucaucugcuuucuaaaccaauggcaagagugucugcauaccaguguggugaggggagauacagugguggaggggagauacaguggugaggggagauaagucccugaaucagacuuagcuuucuugaggacucagugcugacuuuguuacuguuuacuuuagcaacucagguaaaaacaugcgucaaauaacucuuuuguuucauauaaaaccugagguuuugcaagagacaaaaccucuuaaaagugagauuuguuguuuaaauaagaaauaguguucuauuauuaacccaggccagcugagacaagcuuuuuaauuagccuaaaaagagaggauaauguauaaggagaaugagguagguuuuacuuaguaaugucuuggagauuuaaaaacuuauccuauggugaucagauucagauucaagcagacuaacggauagcaguauuuuccguucaagaugauggacaucuuaucuuuauaaaugauuauaccgguccgucugggagaacaagaugcuaaauguuacauauuccuuccuucuuucauuggaaguucauuggaaauuuuauacacguaccaugcauacagagaaguucgugcaucacaaagauucaacucgauaauuuuucacaaagugaacacgucuauaaccagcaccaagaucaagaaaucgaaugucaccagaacuccagaggcugcuugugucuguuccagucacugacucagaauuuugugauggcauggaaagcuuggcuuguugucugccggcagugaguauugaugauuuugggaacacguuuccauucacagugccuuuucaguuguagguuaguuuuuacugggagcaguuucaugcuucuuguucauucugcuagagacugggguuagcuccuuagaguuaagccuuuuggugagcauaaugcagagcagaagauggccuuuacugcagccgggacaaagucuuccaggugcugccugccuuccucucuucccaccagacuaaauucuuugugguuccuugaaacaaagguggccuuccccuuuaccuccaggucuugguccuguggcuuuccuacgucaggaucccaugcccucuggccccguccuacugcauucauuucccaaggcugcuguaacaaaguaccacaaacggaguggcuuuauuuauucauuuauuuauuuuugagacagagucucucucagucacccaggcuggaguacgguggcgugaucuuggcucacugcaaccucugccucccagguucaagagauucucaugccucucccacccaaguagcugggauuacaggugugcaccaccaugccuggcuaauuuuuuuuauuuuugguagagaugguguuucuccauguuggccaggcuggucucaaacuccuggccucuagugaucugcccaccucggcuucccaaagugcugggauuauaggcgugagccaccacgccccgccuggaguggcuuuaaacaacaaaaaucuauucucucacagaugcgaagucuagaaguccagaaucaagguguuagcagaguccugcucccuuggaagccuauagguuuccuuccuugccucugguagcuucugguagccccaggcauuccuugguuuguggcacagccuaacuccagucccugcugccaccuucacuuggccaucuucccucugugucugugcaucucucucugucuucacauggcauucucuucuuugugucucuuuccuuuuuuuauaaggacagcagucaacuggauuaagggcccuccccacuccaggcuggggugacagcugcaacaacugcuuuuucaaauaaagucauaugcugaggugcugggguuuaggaauuuggcauaucuuuuugggagacacaguucacccauaacaucugcauuacccccuucuuaguuuagaugccgucuuuucuaggaacucuucugccguguuccuucccccaacaucuggcuuugaugucccucuugacacuggaacucucuugucaugcuuucuagcaucucucauaauuguuuuuuuguuuuucuucucugccggacucugagcaauuugaugucaggaauaauuuaggguauuuuagaauuuuuuuuccaaauuauuagaaacuuuagaucguggaauuuuggauacauuuaugcauuuugauguaaccugaaauauuuguaaccgagucauggucuucauguucauuuugcggggaagaagugauaccuauugguaaaagaaaaggcuuggguuaaacauuacccccucucucgaguuucugugaucaugacaaacauggauucuaaauccuuggcuugagagcacaugaauugccgagcagauguggcgucagcgcuugcaaggcuguaagcagcuuacugauccagcaguuuaaagacuguuuacuggcaguggcaacauuacuucugguugccugucuuaauucauuuuagauuaaucugucuugcaguucgaaggaaaaugaauugagucaguaacuucaagaguuauguaaaaucuguacagugcuaaauaauugaaugggguuuuauguauggucuuuaaauuggaaugucaauuugacacaaaugcuccaaaacagaguguuagaugagcugaucuguuccucauauaaaagcuuugaaaauuccauucuuguaucacucuggaauucaccguucccaucccuugcagaauauuaauguuaacuuuggggaaggugagucugcuuguguaacucuugggccugggguugagguuuuaggguaaugguacccaaacuugaacggguuuaagaaccacacgaggaguuuguuaggaaggaugcuuggcugggcaugguggcuccuaccuauaaucccagcacuuucggggcugaggcgaggggaucacuugagcccaggcauuuaagaccagccugggcaacauagcaagacuccaucucuauuuaaauuuaaaauaaauuaaaaagaaaaaagaagaaggaugcuuucuggguccagcuccagaaauucuaauuugguuguucuguaacugggcucagggaaguccuuuggcauuacaggugguucuaaugcugacauucucagaccacauuuuaaagaaauaacugguugaagggaugcacggacaugagaaggagaguaugugaacuccugagagaaaauucaagacuauuuugcauaaaauacauuuaucacaaccaggcagaccaaaaaugaccuuuuugggugggauaaaggggauauuuugcagacccaaagaaaauaaauucuugagauuuuuucccagaaauccaugggaggaaggcugaaguauccuuauucuuaucagaaaacauauuugaauuuuauuaccaauaucuuuaaccccauuuuguagaugggaaaucuuugaggcucaaagagcaaagaaggcuaacauuuguugagcacuuaauaaaugaaacugucaauauuaguaauuauuaucgccaucaucauuaucuuuauuuaaccuauagcacagcccugugagguguuaucacugccauuuacagauauguaaagcaagauucaggcaguucagauaacuagcuaggauuacacauugagcuuguagugagccaggauucaaucgcaguucaacuuaacuccaaaauccauauucuuuuuacugcaucaagguagauuuaagaucuuuacaugacaagaguugccagguaaaauguaggaggcccaguuaaauuugauugucauauaaauaaugacuaguauaaguauaucccaugaaauauuugaacauacuuacauuuaaaaauaguggaccauaguauacuagaaaauucguuguuuaucugacauacaagguuaaccagguauccuguauuuucauuugcuaaaaucaagcaacccuguauguggguaguggguuuucagauuguaugaucguacuuucugacuucugacuccaaguccauccauccuuucuaugugccacauucuguucugucucauucuugggucucugcuguccucuuggggaagagagugaauggcuuaccuacucuagccccuguacuaaggggcccaguggcucaugccuguaauccuagcacuuugggaggccgaggcggguggaucaucugaggucaggaguuugagaccagccuggccaacaugguaaaaccccgucucuacuaaaaauacaaaaauuaguugggcgcagugacgggcuccuguaaucucagcuacuugggaggcugaggcaggagaauugcucaaaccuagaaaaugaagauugcagugagcuaagauugcgccacugcacuccagccuggugacagagugagacucugucucaacaacagcaacaacaacaacaacaaaguagccaggugugguggcccaugcuuguaaucccagcuacuagagaggaugaggugggaggaucgccugagccugggauguugaggugcagugagcugugauugugccacuguacuccagccugggcaacagagagagauucugucucaaagaaaaaaaaaacaucagugaacacauagaaguaguucaccuuuucuucacccacauuaugcauguuuucauuugcuuaauuuuagagacgaaggagugagagccaguuaguugccuuacuaacgauagaaagaaucaggccaccauucugcuacaacaaauuuaggaaaaggcuuuuauuuuggguaugauuacagucagagcaauaagggugaguuagaaaauggaacaacagaaccuccuggggucuuuuuugugagaaaaauaauaauguuuugguuaauguuagauugaauguccauuaugugccaggcaauuuacaugcaucauuguugcaggcugcccugagagguaguuauuuuuaucagccccauuuuaaagauguggaaacugauagagaugugaugugcacagccccaggucaaacagcagugagacgcagagcuggaauuucagccaggugucuccacccuggaggccuguucuuagugcacugugcugccaaggcuaaagccuuuuaucugggccuggucucuguccuagagacugccuugucggguggccuuguggaaaucugcucuuuggcuuggggaggcagacacugcaccagcagcuuguuccaucuagccuuaggaagcuucaccuucccggacaaaaagggucaauccaaaaguggcuuuugacaccugugccaaacuaggaagccgcaguggcuucuucgggaauuaggccuuagccccguggaagaaacucuguccuguguggucuucugugugcaguggaaacuuucagcaaggcuucuaaauucuugaugaucacaggaucgcuuugcaccgaaaacuggcaucuggccugcgcuucauugaggguucccuacuuuuggcgagagcuuuugaaggccugggucugugaguuuuccuuuauuaguaaaugauaacaaagcacuuuaaagaaaggagacacguccguggugguaguucuugcugugugaagaaagggagcacuggaucugagaacaaaccucucccaaguuggucccuggggcuccuccugcugcugcugcugggagccccuuccuugcaccaguggucggcugcuucccauguucucucgcgcucucuguaggacucugccugcgaugacuguccucccuuccugagccauuuauaaaaacagacuguuuccauuucuaagugacuaaagggauuccuugaaguagugagaucaaagaugcguuuggaauuugucucugagugaauacuaacggcuugucauggagacaugucacaggggagcccgaucuugggaaaaccaaaugaaagccuuaggagccagagagcgaucaggguggggagugacagaugcagggaauuuuggaucagacaaaccagaaaugaucacuuuccacauaugcgacuuugggugaguuguguuuguaucugugaaccucaguuuuccuaaucugaaauagcauuagucaugccgaccucagagaguccuagaaauuaagugacuauuauguauaaaaugccaggcauggugacucagauccaguauuuacucgauacuuuuuccccucuucauacccuaauaugguaauggaaaauggauuuugauggauuuuguaggcacauuuuaaaauuaaaagcuauugcagaauuccagcuagucauucacugguguucauaagguuagugggugccuacuacguuccaggcucacuuuaaguggcuggggaauggaguauuaugagacagacacgaguccugccucuuuguagcuuccauucuggaccgggaagucgguaacagacaaagcagcagagggaguacacuuuuaaugucaggcagggaaaagagauaugagaggauuuggcugugguagucugugagggccucuuugaggaggugucguuugcauauaacacuuucucauggugaaguggcugcuaugcuaugcugacaaauagccauagcugaccagaugaguccuucccacauugcaaacagguuuucaugugcacaucuugauggcucucccauuuccuuaccccucuucuuuccugcaagcuccuguuguccucucagugucauauuacugaacagaguugaauuacccacagaaagcuuucauuaaucuugcugucccauugggguguuacuguaaaccuuggcacccagagcgucugccacggaaguggcuucuagcaaggggagaaggugaagccugagaugggguagagugaggaagagugagaugugagccaagagaguccuuaaacauuucaugagguuccacagagccugcgaucacacucuugcggccgugccguugccagugagaauugaugccuucagcccaggguacugggagccucccagcaaggugaugugccacguaaacaugcuccuaaaggaccugaaugcuaauauccauaggaacugcucugcagcuucuuuuaauuagcugagauggauuuugggaggucagcguaacacauucaagugaaauuuauguugguuuucuuuguaaacuguugcaguuggaauucuucccagugaguggucaaagugcucuuuuuugcuuguuuugaugagauuuggguagaggugaaauagagguggggggugaaaguaggccaaaaaauuugaaaauauacuuuuuuuuuuuuuuuuuuuugagacggagucucccucugucgcucaggcuggagugcaguggcgcaaucucagcucacugcaagcuccgucucccgggaucacuccauucuccugccucagccucccgaguagcugggacuacaggugcccgccaccacgcccggcuaauuuuuuguauuuuuaguagagaugggguuucacuguguuagccaggauggucucgagcuccugaccucgugauccgcccgccucugccucccaaagugugaaaauauacuuauauccugccaacucuaaguccuaacauccaucuugcaauaggcaaaugaagacacugauggacaaagguuauucuuacuuuuuaucugagcucagggauuugguuuuauuagcucuuuagccuaccuguuagcucuuagccacuucuuagaacccaauucccucagcaguugaagaccuccuuguuuugcacuaaauacgcauuugguccaggugaguauagacuagcgguucccaaccuuuuuggcaccaggaaccgguuucguggaagacaauuuuuucacggaccaggagggugguguggggaugguuucaggaugaaacuguuccaccugagaucaucaggcaguaguuagacucucauaaggagcgugcaacccagaucccucacgugcacaguucacaauaggguucacucuccuaugagauucuaaugccaccagugaucugacaggaggcagagcucaggugguaauccucgcuugccugucacucgcuuccugcuuugcagcccgguuccuaacaggccacggacuagggucggucugcugcccaaggguuggggcccccugcugcagacccaguguugguauaugcaaauauugcuugcccuuuuggagucuggaaauguuggccacugucuggucauucacuugcuuugacucacccuuucuccacguccuuuucucaacuuucccucuguggauuagagccacaaaucuaugcccucauuuuccaguccugaaaauggagacaugugaccuggcauaguuuuuguuguuucuuccaggacugaaguaaucugggaaauguaguuuggcugccaagaauuuggccuuuccuagacacauugcugguugauuagaacaacagaggagaauguuagucugggaggcgugcucacauucccaguguagcucaggggacccuuucaccagauaggacucacagacuucucaagucccuauugcgauguggcuucugggacaccuucaaccucugucccugguaagccaauggcugcuucauuucccauguugguuucccccaauuuucugggaccuccacauuaauaccuacuuucccguuuccuuuuaaaucuccuggcaguucuacugcuuggaaugcauucuacagauauacuugcguagauaagagaugacccauuucauaauagcaaucacaucuaacacuugcugaggauuuaccugguuucuggaacuaagaauuuuacauauuuuucauguauuucauucuuuaaaaaacucugugaggugggacugauaguaucuucauuuucagauaaggcaauuuaagcaggaagaaaguaaaauguaaccaaagguguauuuuuuuuuaauugcagcugugguuuuaauaagaaaagauuagaaacaauguaaucaaugugugucuaauuaaauacauaaugcuuuauugccaauaccauaggauacugugcagccacagaaaaaugguauugaauaucuucauauaauagcguggaaaucccuccauaauacaugaagugaaaacaaguaagucuguauauaaaaugcaggcugggcaugguagcucaggccuguaaucccagcacuuuuggaggcugaggcggguggaucaccuaguucgagaccagccuggccaaccugcugaaacccugucuuuacuaaaaauacaaaaaguuagccaggcaugguggugggcgucuauaaucccagcuacuuggaaggcugaggcaggagaaucgcuugaaccagggagguggagguugcagggagcuaagaucaccucacugcacuccagccugggcaacaagagcaaaacucugucucaaauaaaaaaacaaaaaaaaguauaauaugcauaaauuagcucaaccauuguggaagacaguguggccaucaucuucagcaaacuaacacaguaagagcaaaccaaacacugcauguucucacucacaagugggagcugagcaaugagaacacauggacacagggaggggaacgucacacaucccugggccugucggggguugggaggugaagggagggagagcaucagauuuuuauuauuaguuaauuuguuuuggucgucaugacuagacaguaauucacaugguuuaaaacaaguaucaaaauauagugaaaacagucucccuuccaccugcgugccuccucugccagcacugccccucuccaccauagauacucacuaucauuagucccuuggguaauguucuagaaauuauagggcaaaauuguccucugucaaaccccuuacacaacugaagcauauuacacuuuaguuuauucauuuuuuucuuucucucuuccagcucugugucaucucccuguuccuuucuuaucuucccaaacaagauuucucucaucuggugaugcgaaugaaacuacagucuuguaguuaccugggcuugaagcucuagaaucauguuagaccuaucuucuucgucuuuuguauuuaauuuaauuuuacuuuaaguuccuggaugcauguguggaacacgcagguuuguuaccuagguaaaugugugccguggugguuuugcugcaccugucaauauaucaccuagguaugaagccccacaugcacuaacuguuuguucugaugcauuuuccuugaaaggaggccucuaguuuucaccaaguuaucaaaaauauucaagauccccuuagguugcuuaggauggugguaacuguuccuuguuaccuuagaaaggaugcagauauucuuauguaaccugucuguaggcauguucucuagggccaucaaaugcuuuuuuuguuuuuuuuuugagauggugucucgcugugucccccagguuggagugcaguggcgcgaucucagcucacugcaagcuccgccuccuggguucacgccguucuccugccucagccucccgaguagcugggacuacaggcgcccgccaacacgcccagcuaauuuuuuguauuuuuaguagaaacgggguuucaccguguuagccaagauggucucgaucuccugaccucgugauccgccugucucggccucccaaagugcugggauuacaggcgugagccaccgcgcccggccagccaucaaaugcuuuuaaaaaauugaauuaauugccaacucuaacaacugaaggauuucacauagaaauguggauucagugcuuagguaggaaaauggaagauuuggcagcccuacgcuugcauuucuacauggccacgguccuccagagcuagguagaggaugccucuuucauggagagaguguucucuuuuuugccucaggccacucuuacaaccuguuguagucuaaaugacacuggcuuggcuugagaagaaguggguccuagucucuuuucuuccuaaagcaacucuuuaaaaaugugaauauuuuuucagaugauaaaaaugagauucagacaguuuagauggaaucagccucaguuguucacugaaguggguuaggauaaugugaaacuugaacucagaucaucuaacuuuauucuaauauucuuuccacugaaccacaguugucccccauuauuguuacgauuuuugaccuucaaggcauuccuagagauagguagaguauuauaggcauuucacagaugaguaaguugaaacuugguucagcucugaaaaaggaaaguuacguucuaaaagggcagagcucauauuuggucucagguuuuuugacucaaacacuauacuccuuuagugguacucaaaaaccucagagauccauauaauucugacauuuuuuacagcagugauauuaaugauucuaacauauuugacuccaaacagaagcaggaaagguggagggacccccauuguugauguugucucagaacuggaagaaaguuccugcggucagucagagaauaaguuauaguagacucacuccuugcaaagcacugacuggucugggaccaugggcugcaaagugggagagauguuaagaggaauaaggaauugcuuuccagaacccuauaaacuuagaugggcaaccuagcugaguauaccugagaggauuuaacagcuuuauaaaggccacaccucaaguucauguuaacauuauuuuaccugcauucuuaccuauagaguaauaagaauuguccuguuuuauaguauuagagcuguccuauuguauaacaguagagauggcugcuuugauggacacuucuuguaagccguaguauauuugaugcauauuuauuagggcuguguauugguggccaaauuuguaaagugaagacucuguaauaaaugaagaagcauacauaggguguguuauuuuccuggaugguccuuuucccauugcagaguuugcaaucauuuugcaaucuucaccuacaugugacguagaagaaaaaguacagagagggccaauuaucauaaaagacacuuugcguaguggugaaaugcuggacuuguagccagucugccaguuuuaaauccuggcucaaucacuuagcagcuugugugaccuuagaucauuaguuuauguaacccuuuguugccucaguuuucuccucuguuaaaugaaaagauuagacaauucauauccgauagaguugcugugaaagucagcuaauugcacgugaaacauucuuaggaagagccuggcauauacuaaauagugcauagguauuagcuacugcugcuguuuuguuuugcuguuuuuaaucauuguugaggugccuauuccucaguugcuaugcuguagcaaaucgagcuuuguaacuagagcuaagaaacuggugggaaccuaggcauggaaguuguauauguguacccuuugggcugagcacuauaacaugagggguuuagacuaaucccuaauagucugccuagcugcaagcaagucugggauaucugucagucaugagaagcaucauuaagcaugugauggucucugaggcugggcccuuuaacuuguaugaaaaaccccagcugucaaaaguuagguagagagcuuuggaccucaaguccugacugccacucuccagcucugugaucucaugcaaaucacuuugucucaggacuuugucucccucacccccauguaaaagugggaugauaacaucauuuuccaggaucaggguggagaauaaauagaccauguuuacuaaauguccuacggagugugguggccaaguaggugcuuagaaaguggcugcagcucucaguauuauugugaaugaaaaauucuggccucauauccgguaaaucaaaauacuucacccuaacuccuaaggcaauauuguugccuagaaucaucagcauauuuggagaccaauaacgcaguuugcauauuacauggagaauguggguggacuaauugcauccaggcauggggugacuggcuugagauuaaaucaaaaggaauuuccugaguuugugauguaagggaagcucaagagacuggaauacucaggaagugaaaucccagauacaaggacugaaaauaaucauucaagugguggaaaaggugauagaaagauugaucaauggcaccgaguuuagugggacaucugcgcugugcucccucuuugguuuccucccuuucguggcugagagguuugguguaucagugcuucuuccuccucagccagaaaguuucaguuuuucuauauucugcccacccucuuuucuugccuguauuuguccauucauucaauaaagacucauuuagcuccaaaauauucauugaggagcuaaaugugccagguccuggagaugcaacaguaaaacacacauaugcauauacccacaugcacgugcauacacaauuugcacacauacgugcacaugcacaccuccaugcauaugaacauggaugcacacauggccacgugaaucccucucuucuuggaauugacauucuaguugaggaggacagaaaauuuaaacaauaguaguaaggaaaauauguaguuuguuucacuugacgauuauuguagguuuccccacaauuuuuuuuuuccugccucugcuguuugggagguuguguguccaacuauuucuauucuuugaagaacuucuagccuaauugcuuaagcuucacagaaucucuucaaacuguuucuuaaagggcucuaguuauugaauaaguuuugauucacaauuucaugaaaaaauuuguaaacauauuagaaugugguaauaugguuuuucuguuuauugugcuaaaagcaaaaguguagaaaaguacaaaaaccaugaaaauauaccuuguuugaaguaaauaaauaugaacaugaaauauauuauuuaaccaugcuggaggucaauuuuaaaugaauucugcuuuucucugggcuuaaaaagaaaacuuaguaacuaguggguugcuauguuuuauguuaagcaacauuuaaauugaaaucaaaguagaguaaguacauauuuuaacuaaaacagguaugucuaguuauggggcaaguaaaauuguauagcaaugaaauuaaauaaaaaaccuaugaauauuuuuugaguuugaaauacaauuggcagaaucugagcuugcuauacaucuaguuggcuuuuaagggaaacugauuuuuuaaauuucccuucuuugauuuuggaucuugacuuaaagaauccagauucccauaaacauuauacagaaaguucuaauggugccaggaauuagaaaaaucuaauuucuuuuuuuuuaauuuuuuuuuauuucaauagguuuuuggggaacaggugguguuugguuacaugaguaaguucuuugguggugauuucugagauuucagugcacccgucauccgagcaguguaacuauacccaauguguagucuuuuauuccucaucccucucccacucuuuccucugaguccccaaaguccauuuucucauucuuaugccguugcaaccucauagcuuagcuuccacuuaugagugagaacauaugauguuugguuuuccauuccugaguuucuucacuuagaauaauguccuccaauuucauccagguuccuugaaugccauuauuucauuucuuguuauggcugacuaguauuccaugguguguauauguguguguauauauauauauacacauauaaaacauuuuauccacucguugacugaugggcguuugugcugguuccauauuuuugcaauugggaauugugcaucuauaaaugugugugcaaauaucuuuuucauacgacuucuuuuccucuggguagauacuaggagugggauugcuggaucaaauaguaguccuacuuuuagaaaucuccaggccgggugcaguggcucacgccuguaaucccagcacuuugggaggcugaggcggguggaucacgaguucaggaaaucgagaccauccuggcucacacggugaaaccccgucucuacuaaaaauacaaaaaaauuaggggggcgugguggugggugccuguagucccaucuacucaggaggcucaggcaggagaauggggugaaucugggagguggagcuugcagugagcugagaucgcaccacugcgcuccaaccugggugacagagcaagacucugucucaaaaaaaaaaaaaaaaaaaaagaaaaauauucacacuguuuuccauagugauuguaauaguuuacauucccaccaacaguguaaaucucauuucuuaauggcuugggcuuguuggaaauuaaagagacaucaggaaacaggcaagccuuuuuuuuuuuuuuuuuuuuuggagacggagucgccgucugucgcccaggcuagagugcaauggugcuaucucgacucacugcaaccucugccucccaggcucaagcgguucuccugucucagccucccacaaaccauuuuuaacuuaaaucuucuuaguguaaagauaacaacuaauauauuaaauauauguuuuuuuaaauggaguuuaugcugaggaagaauuauuuugaaaauaauuuauuuggaaauauuuccauuguuagauuuuuguugcuaaaaaugguauauauucaccauuaaaacuuuccuaucuucucagcuuaaaacagcauugaaaaaugacuauuuuacuuugucuaaaaaagucuuucaacaagggucucaauaguuuuugaauucauugguuuaauuucuuuugauaaguuugcaagaacaacugauagacauuaagauagcugugaugcauuaguaaauuuuaauaaaaucuuuucuuaugaaauuggccaaugggauuuaaaagcuuggucaugguuuucuaaguguagccccaaaugcacuucuauguggauucacauagcuuuguuagcuuucuuacguaguuguaacccucauuaauuccaaguuuugggagaaaaaaaauccugaauuucaaaccuguucuuggaaucacugguuuauaaaauauagacuggguugaaaaauaacgaagcaugaccuauuauguugguuuuacuacauuuuuucuuacaauuaauaaauaagauaaaaauuauuuuaaaauguaucuuaaucuuauucuucuuauuuuuguacauuucacaauauacauuuuaugucaguaaagcagaguguguacauuaccuaaaaauaaaccaguagauacugcauguucaauuaaaaaaaaaaauggauggaggccgggcgcggugacucaugccuguaaucccagcacuuugggaagcugaggcaggcagaucacuugaggucaggaguccaagaccagccuggcuaacauggcgaaaccccgucucuacuaaaaauacaaaaauuagccaggccugguggcacacgccuguaaccagcugcaugagaggcugaggcacgagaauugccugaaccugggagguggaaguugcaaugagccaagaucaccucauuacacuccagccugagcgacagagcgagaccgucucaaaaaacaaaaacaaacaaaaaaugacaggguaguguacaguagagaauugagaaaaucaccaaauaagaugauauucuacugguacugaagaguuaauaauacucaucuaucuuuguguuacucaccugucaggaaccucccaggaauggguugaucguauauuuuauuguacguguuuuaugaaugaagugcauuuuuauuaucgaaugaagaaagcguauaggacaauggggaauuauuuuucucuuaaucuaucuuuucagcucuccucgucuagcauauguugggcuccccaguuuuaauugugaagacugggagauuuugcuacauuagggaucacaucacuuucuuuguguagauagaaucucagucucucuugcucuuuucuuucucucguggagauaauaaucuaacucugacauccaugaugugaugauuugccaggugcucuauuucuaguuacagcuacuagggaauugcaagaagacauugggaaaugguacuuggccuccacuuagcuuuauucagauuggcuuguuucccaaggacccacaggaucaaugaugcgugcagugcuaaagggcagcugcgaggucagggcguauuuauugcuugcuggggcauguuauugaccaauaagaaguuaaacaguuccuagcuacagcuaagacauugccucuuaggcaggaagacaagagaucaccucgggcaacuuucguuuacacagagagguguguaaaguggaaccaaggcuugcaacucuaggcaucccuuguguuugucaggauuucagcuuauuugggguggcugcaaggcuuugagacaugcccaugaugcuaugcauuuuucuaaacucagccuuugucaagguagucagggauuguucauuuugaaaccucuguagauaucugcauguuugcugcaaagguuuugucuaggugagauggacuggcucauguuuccuaaugcugaugcccuucccucccuuccaucugucuuuuauacacacagaucuauuuauuacuuucuuuucuuugaaaaguauaacuuagcuuuggauaaaggaggaacaggaucacauuugauuaaacgcaagcaacaguuuaccucgcaugggcuuggaugaauaaggaauccaaaaggagcgguauucaggaaaaaauaaacuguguguguguguauguguguguguauguguguauaaaguacagauauauauauacacacacacauauauauauauacacgcacauacauauauauauauauacacucagaaauaaguagugaaaaaucuccuuuuagcuuuaugagauguucugagcucagcucugagguuuauguucugacuaugaaaaauaaaaugauuuuccuaaguuuuuaaagaaucuuucuuucuuucuagguguaaaaagaacuuuuuuugugaacuauugaaugaagaggugaggaaggagaggcaggaggaagaaaacaauacaaaucaggcugaaaggccuacagauuaaaaacuaacacugccuccccugcagugagauaguccuuucauuuuagcuccuugcauugaaauagcauugaggauuaaauuuguguaagccccacaaaauucaaaauuuaugugcuuuucugaccacuugccuucuaguggaaauuuuaagcauauuagaggauauguuucugugggagcugaucagaaugguacuaggaguacaaaagaauaucuaaaacuaaaacacagcuauauuucagaucauacugcuucaucacaucgagugcaucuacaaagguaauaaauaguauguggcugaguuagggcuugggaccauuuucuagaagauuugcccuuucugcaauucuagucucuauaaugauuggaguguaggaguuaaguuguggagcgucucauaaauuuaacuagaaucauccccucuuaaaaucuaaaucaaauauugacauauuagucggccauuauuugauuacauuuuuauugguuuaggcagugagagauguuuugugcagaaucugguuguuuucagcccuaaaguaaggcauugcauuauuucuaaauaauccuauaaagcacuaaauuaaaaaauuaaaacaaccaacuuuauaaaugauggcacuccuaguuuucuaugugccagccucucauuccggaauuucugaaaggaagaaggaaaguaaauuaacauugaucacgggccuacuccaucccuggcuuuguguuuauacaugacuuauguucccucccuucucagaacucuggcguguuagugguauuaccuugcuuuuacaagugaagaacgguuaacuaauuuggggaagguuacucaguuagggaguaauugagcugaaguaggaaugcagugcugacuucuguaaucuuucucuuucaguuuuaccaaaauggacucauucugacucauuuggggguuuuacaaguuagcccucgguaacaagugcccagcagccuugccuguauucagcucuucuauauuugugugaugggcacagaacaccuucauauguaugcuuucuuauccucaugaucagccaacagaggcaugaaucuaccaaaagaggcaaauuccuccuuaaaaaaugcagaauuuuaggcugggcacaauaguucaugccuguaaucccagcacuuugggaggugaggagggagcaucacuugaggucaagaguuggagaccuugucuuuacaaaguauuuuuaaaauuagccagacuugguggcacauaccuguugucuuaguguacucgggagccugaggugggaaagucgcuugagcccaggaauuugaggcugcagugagcuaugauugugccacuguacuccagccuggguaacagaguaagaccuugucuuuuaaaaauguaaaauaggcugggugugguggcucacaccuguaaucccagcaauuugggaggcugagacagguggaucacgaggucaggaguucaagagcagccugaccaacauggugaaaucccgucucuauuaaaaauacaaaaauuagccgggcauguuggugggcacuuguaaucccagcuacucaggaggcugaggcaggagaauugcuugaacucaggaggcggagguugcagugagccaagaucgagccacugcacuccagccuagugacagagcaagacuccgucucaaaaaaaaaaaaaaaaaguaaaauaaaaugcagaauuucuccauaugcaggaauggcaguggguuuccucucucaaagaagauagauccuuugcaaaagcauaaaacugaaccaugaaggauguuacagggaaggaaaggcugcucagucagggugauucacuggggaugaggcaucuuggggguuccuuggggagcagaggugagccccaaugaaagacagcuuuguauuaaaaccauggggguucagaguacuuauuaacuuauaaaauaucaucagaaugagcucaucugagcuaauguuucagaccaagcacagaguaggcuguuuacuauucuguaccucuacugaauaauggaaauuguauuuuuugguuuagccaguuuguuuuuaucuuucuugaucucuuucucaaagcaauuucuguuugaguuaguggcuuuaaccacuuaucccuagguauauaucaagauuaguaaacuauggaccaccagccaaaucuggccccuuagagacagagguucucaacccuggucuauauucaugauuuuggggguuuauuguaccuuauguacuuauuguaaauaaauauaaauucuuucugaaaguagguaggaguagaacucuaaauauacauccaucaacauauccaaguuggucagacugaaaauugaaaauuaccccuuuuugguguguuaugacgauuuguuaaaaaaaauuauauauauauaaaguauauuauauauaaaguauauauauauaaaguguguauauauauauauauauaguaugacaacuauaccauacggggaagggccaaucaaugccucaauuugagcaucuccacuuuaaauuguccagacaugcagaagaagacucucccucuucccuaguuaaugagcuucauugcaauugaggauuuugagaggggugccacuucccucaaaugguauucccuguuuaacgacugcuacugcuaaagguauuguggguguaacauggagaaggaacucaaggcaucuugcacuuuaucucucauugugugcgagagcuggguaacauuauagagaaguguuccagaauuaaaguagugcucugcuggccuguaccuacaagagauagugauggaaauuuuaguuguuucuccuauaaaaauguuagcugcuuggcccagaaugggcuaagauguucaaugacagagauugaguguucaauuguguuacaaugagccauuugaacaauuucuguuuguccucugccugucacuuuucucuuuccccuuuccaauccugcuuuaagaaauguaggaauagcaguuuugcaaaggaucucagcaauucuaauaugaaagauuauuuuucugguuaccgagucugcauuacaaauuacuccaaaauuuacuggcauaaacagccauuuauuaaguugauggauucuggggccaagcauuaagauaggacggugcacagaugacuugucuuuguuccacgauguauagggucucugcugaagagcucaaaggcuguggcuaaaaucaucugaagcagcguugugucugguagaacuuucugugugaugaaaauaugcuauaucuguacugaccaauauggcagccacuagccguacauggccauagggcaacuguaauguaacuagugccauuauagaauugaaguuuuuauuuaauuaauuuagauauaaauacccacuaguggcuaccauauuggacagcacagaucugaaggcuugcucacccauaucuagcaguuggugcuaggugacaguagacuuuaguuggggcucucuccauuggaacaccuuucuguggccgcuuccuguagucggcuguuccuccucauaugguggcuggguuccaagggcgagcgucuuaagagaaggaaccaagggaaguagccuuggagccagcaaucuugcuuccacuguauuauauuuauccugucuggauucaaaggcaagggcaguagaccccauuucuugaugagaaguggcaagguucugggagagcaccaggacaagaaauauugcuauaaucauaucuggaaauaaucugccacaguuguuccagguacccaguccauucguucauuuauuauucauucagcagacagugaaucccuacuugguuacuuggcaucagguuacuuagagaauggcaguugaugauaaugaagcucauaaaaaugugaaggaggugguugggaaggcauguauagguaucuccaaagcuguaugguauaugccaugauaauacaugguaagcagagaauggaugauuagcuuagacacauaggggcaucuuugaagaagcaacaugaaaacuggaucuuaaauuugcaguaaacuaaggaguuugccagagagagagaaagagaugucauuuaggcaaaaaguuaagccuacacaaagucagagaggcaaaaugguaagcuuuuccuggggaugccucaacucuacauugcuuguucagaaaagagcacuguacagcuacccugccaaccacguccuucauuuucaguguguguccccacccacgccaugcauauugaaaaccagccgcauacccagcaggucaccaauccagaaaaauccauagcccaaggggauaucauugaugaauuacagacaaguugccuaucagcaggaauccuggauuggauuagagaauccucauaccaugcuggcuuuucuaaagaagaucuggcucucagagaggaacaaagaugccugaacacauggucugcauugaaaacaaauauugauuggccccugcuggguugcugagcuagaguggguuagaaucugaugucaaaaagugcugggguguggaaaaccauuaacucugcugauugaccagaauaaaagcuccaucuauuuuuaagaucuuaaaaaaaugagggugaaaucuuuaagugggcggaagggcagaauugauggugagaacccauaguuaggcaaaaacacucucucucaguuugucuucgugacucuggacacagaucuuaggccauuugucccuaucuucuauauagcauuuuuuggaccugugacuauuuauuaaugcugcacuaaauuuacucaguugcaaauuaacguccaaauagcugauguucugugguguucagauuuaggauucagaccgucugcuggguguucuuauuacacugguagaaaaaugcucuggcuguaucugauugcauccgacaguuagauauauuucugucacugccagauguacaagauacuguaaaaggagcauuuucucuagcaaauuagacuugcuagcuccauggaucuagauugacuaaaacagcuuguugccccagggauguagcuggauuuggcuuggucauuucuuuuaaauauaggacuucagaaaccugaucuagaguccuuuucuuuuggagacaguaucuugcucuguugcccaggcuggggucuaguggcaugaucauggcucauugcagucucaaccucccaggcucaagugauccuccugccucacucucccuaguagcugggacuacagacguguaucaccaugacuggcuaauuuuuguauuuuuuauagagaugggcuuugccauguugcucaggcuguucucaaacuccuagacucaagugauccaucuggcucagccucccaaagugcugggauuacaggugugagcaacugugcccagcugauccaaguccuuuuaaugaagauuuuccaaaucugcugccuuuacuuuuaaaccugagauguguuugucuuucuagaguagcccucccaauagaacuucuuaugaugaugacguauucuaaauguacgugguaagcauuagccacauguagauauuaaguacuugaaauguggcuugggcaaauggggagcuguuuaaaauucaauuaaauuuaaauuuaaauagccauauguggcuaguggcugugucauugggcagcacaguucuagcauccgcuuuuagagaugguauuugcuuagagaagaguaagaacuuugcuagcucuguaacuuuuuagcaguaucuuaauuugagucaucucuuuccucuaacaacaaucuaggaaaagaagccauuggccauuggggaugccauuggccaacuaagggcugggauggggacuugagcaagggccacuaggcuggccauaaaaccugucacuuuggcuucuuuacucauuuuccugaaguauucuccgcaagauaaccaggacauuuuuaguagguuccauagccuaaucaaagguguuugggaaggccugguuaauuacaguuguacggguuuccuuccagaagauuuucucagccuuaacuauacucauggauugugagucuccagaugaggcugugguaucacugccaaacauauuugauaugaacagaaccccuuuucucuuucugguguuguucuguguaauaauaugcuuugggaaauguugguuuaagcaaugagacuuccugcuacaauagaugauaaacuuaaggcauauuauaggcaauuaacauaucccuuuucuggacuuugguggaauuugaaaucugcauuuauaguuugacucuguucauccuucacuguguuugcauuuuuaguuaacuuuucaaguacauaaauauccaggcuggccuggcuguauccugccgggccagagacuugugucaaguuuaguucuuauaguuggagaaaugcuaguguuuccuccaucaguaauuuuuuuaucuguugauccccaugcagcugugaguaugaaugcauacauauuucuccuuuuuuuuuaaaacuugaucagccagcaggagaugaaauagagcagaucacagcucccuguucauuuaaucauaugaguuacuaaaggaaggaaaaagaaagaaauguaaaaauggagaaaugucuccuccccuuucuuuuucucucucuuucuuuuuaaaaauuguucaacaaguuaucugcagaaaacaucugccucucaaagaaugaauguaauuuggguucugaacucauaugucccucugguuggaaggaagaguuuuuugcacaugaagugaaaucagcuaagaugcugucugugaagcugaaauauugagauuuauaagaugacaguaaaguagugaaaagugguguuuuucugcuugacacugucaccacuguggaauaagaauuccgggaagaagagacuuagauacagggucuacagcugucuguucccaugccacggaagguucuuccagccaccuuguuauggcgauccuccuggcagggaaugagagccaucuccacugccucccuuugagugguuaucuggcuuguguugcuugucuugucgggagaccaagggccuugcaaaguaggugccugugaagagugucagcugaggcccugcagggagcuggaagcuuggaaggccugggagaaaaugccuggcuaauguaugaggccuggaagacucuucuuuguuaagaagauucaugggucucugaggaguggaguaaucaggacuaggagaagauguugggccaagccuucguauccuauauccaucugcuugaacauuuuuuuuuuuuuuuuuuuuuuuuuagcuaguugaaaggaggaggucccguugaggcuuauuugaacaaauauuugcucucccuaauuauauacccagagcugcucuccugaauguuuaaugcaaaccuuaauauuuacaauagcauaaggaagaguuuauaauguguuugggaggcuuccgaaguuggggcaguaauucuucuuugcacuuauguaauacuuuucuuccuaagagaccugagccauguuuaccuuagccacuguucacauugagaugaagugaagugagggagggagaugaaaacuccagagaaaggaggagccccugugggcagcugccaacauguuuuauaggugagacacuugucuuugccaaaaguugugugccagccacaaacuuuucuuucuggucaggaauaacauguaagccugugcuuacaauugccuucugauauggacguggagagugucacagaggugccaugcuggguuuuugacccugaugguaguagacuucuugcucagugcccugcuguaugacaagccugacccauucccuuauuagacucaagauuuagugagucuuaaaaagauauuuggaggcuaggugugguggcucaugccaguaaucccagcacuuugggaggccgaggaggguggaucacuugaggucaggaguucaagaccagccuggccaacauggugaaacgcuguguccacuaaaaauacaaaaauuaguuggguguggugguaugugccuguaaucccaacuacucaggaggcugaggccggagaaucacuugagcccgggagguggagguugcagugagcugagaucaugccacugcgcuccagccuaggugacagagucuuacuccaucucaaaaaauaaaaauaaaauaaaaaaaggaaaauaacuccaguaggguaguugccaaguucaaaaggccaaagaagagacucagaaccagcaaaagauacaugggauuuuauuaagggcuuaauucaggggagaggguccaguggugguaggcuggacacgagaaccaccuuauguacagaaaugguccaguggcaaugagccggacaaaguaaccacuggcucaguggcagcaagcuggucgggaaaaccacaacugcuugcagacaucaugcacuuuauauggcauuucacaaauauaaaauuuagcugggcgugguggcaugcaccuguagucccagcuacuugggaggcugagacacaagaauugcuugaaccugggauguggagguugcagugagccaagauugcgccacuguacuccaucuagucugggugacagagcgaggguccaucuaaaaaaaaaaaaaagacaucgaagucuggagaacugaguuugaaaccuucuuccauuccguguauggaccuugggaaggcuguuaagccuccuggugccuuguuuuucucaucuguaaacaggcauaaugaacaccauuugcacaugguugguacgaagauuagaaagagugcaagucuaguaccuggcugcauaggcucuuguguuggagcaguggugauuauuaguucugucaucaccuguagagccuguugacacuugaaggccaccuuaauuuugcaguuugcauguaaggguccucuguagugauuuccagaguuuuuccuccaugcacggugccuagaacgaugcaaacugggcaguuacuugggguuugcaucuuuccacaaaacaaaagaugaaaaagagagauccugccaaaugcaagcaagaugaggaagcaugugccaaugcccaagacuucaaggaagucagguugugggcaguguuuaugcaagugggaacugcauuccccagcacuggaucugugggucuuacucuuaggcuugccggccuuagcauuauggcagcagccacuggagaggcacaagugguuccugagcauuuugcugucagggaaggcauagguucaggugaauauguguaagcacucaucuucuaggaugcuggaaugugucgagauaucgcuucagcugaguuggcuuuuccuucuucuccaacuuuuuuugugaaaucugguucuauagaugcugugcccagcugucagauugucucaguucucuggaauuaguuuaaaaugaaaguuuuuccuugucugcuauagacaguucuacaaacagaauuacucuccuuuucuuaauugcuucugucuucaagggcaggaagagauaacuuucucuauaggaagagagggagacccagucuggguucuuuucuucuuuucucuuuuuuuuuaggcggagucucgcucugucgccuaggcuggagugcaguggugcaaucucugcucauaacagccucugccuccugggcucaagugauucucgugccucagccucccgaguagcugggauuacaggcucauaccaccacacccagcuaauauuuuguauuuuuaguagacccaguguuucaccauguuggccaggcugguaucaaacucuuggccucucaaagugcuggaauuauaggcgugagccacugugcccgccuccagucuggguucuaagggaucauuugcuuuuucccauuuuccacauaagcaagugcauuuguuuuuuuggcauaguugcugucacaugaccguguaggugagaaagcaguggggcucuucuggcagggcauggcaccuguuguccuuaggcauggacagcaaaugugaguagcuaacaucucgcccagauggaucucuuuuguauaaauguugaugcugaaaacugacuuccuguucugaacuuuuuucuuuugaguggcugagugggugacuguccuaagauaccaguaugacuuggccguuugcaaaggauugcucaacagggcuuuccccaaguuguucuuccccaugagaggaacaguuagcaaacagaauggacuuuggaguuggucaguuuaaaagagcuauugaguacugcaggcuccauuaugaggucuggggccacaggaaugaacugaacacuuaagggucuuuguucucaaggagcguguaauugaguggaggcagacagacaaaaaacauggaagcagaaauaaacacaaauaguggggggcaggggcaguggaguggaagcaaggagaccccuucgcuggcuuuugauguacuccagaccauaguaauguggcuuagccgacgcaggagccaggugaggcagugggauggggguggggggaggaauuccuuuuguauuuuagagcuagagccaaugggacuugcuagguuuugccucugcuauggcuuagguauguuacuuaacuucucuuuaaaaccuucauuuguuuuccucugaaaaagggagauauuucacagaguugugguuaaaauaaaauaguuuuuuuuuuuuuuuuuuugagaggaggggucuagcuguguggcccaggcuggucucaaacuccuggccccauugauccuccugccucagcuuccugaguagcugggaugacaggcaucagccacugcaccugucagauuuuuuauuuuuaguuguuauuuaaguaguuauaaaagaaugagcaccucagacuggauuuuagaggagagcccccuagacugucucuguguggccacuuguccaauucuggguuggaccggcaggagccugugcucaucuguccacagggaccaccucaguguuuggcauuaccaggcagcgguugcguccauugccucuacuauccccuucuucgcauuggaguagacuucccugggggcagcaugggaagagguuccugcugcaccuugcaggccucucuugacauugggguugggagggugcuggagguggagggaggugggaagcucaggccugcacuguuuuccucucugcccggccgauccugaccccucucuguuccuagcagcuaccacugucuuugcugaugcugugguuaccuuuacagcagugguucucaaaguguggucugagcgucuuuugcaucagaaucaccugagauaauuauuaaaacugcaggcucugggccuuacucuagaccuacucagaaucacuuggacugggcccaggaaucuacacuuuguaaugaccucccuaauuuagugagccuugugugcucuaaauuuugagaaucucuuauuuagaaaauuugauuuuccuuuuggaguaauaauaacaaguaauauuuguuagagguuaauuaugugaugcuacucaguguuuuauaugcaauaaccgaauuauuccucaaaaauaacagugugaaagagaaacuaauauuagccuuguuuggccagugggaaaauuaaggcaaagaguauuugcucuaauguugauugaagagccaauauguauguauguauuuauuuauuugugacaggaucucacucuguugcucaggcuggagugcaauggcaccauuacggcucaccacagccucaacuuuccaggcucaggugauccucccacuucagucuccugaguagcuggaacuacaggcaccugccaccaugcucagcuaauuuugguauuuuuuguagagacgagauuuugcuauguugcccaggcuggucucaaacuccuggguccaagcgauccuuccgccuaggccucucaaaguucuaggauuauaggcaugagccacagcaccugaccaacagccaguauuuaaacccacauccccagccguauccuucaccuacucucucccagccucccuuauguggugauauuacaugaaugagucuucuuaauuuaaacugacuacuggauggcuuccuguuauguuaagagguagcaacuuaaacauagagcauuuuaaaauugagcuuuaacguacaucagagccuaagauuugacucugauuuugauacccugaguaaacuuaagcacuuuucuccuucauucacuuugguaaaugagcugugcagccaugcucuucucguaaacuuuuaccugcugugcuaggcugugagccacgaagugccugcacugcccugugccagugucuggaacauucuccaaguaauuggccagugccugcgcagauagaaugcagguagaaugccaguucuccccaacccuugccauugaucugcaucuugggaggcugugcaaggaguuggaggaucugggguuuucccagugucuggucacugaaagaaauuuuuucuuuuuagugacuccagguuagugucugagaaaaguuggccaucaaaacaggaccagcccgagcagguuugaagauaaaaaucaaucauuccguucauaguacuuucuuauuucauguuccuuugcuuccaacucccauaaggaauuugcuaaagauacaaccucagagauagcuuaagguggagagaaauuuucgaccauaaguuccuuggagaauacgaauucaaguagggugagugggaagagguuucuaccaacauuuucuccuugcaucucagguccugaaucuuccaaaaagugcugcuugugcccuacacuggcucaaauuugcauuucugaaacuaguuugguuugcauuaauuucacuggaguugugaucacauugaaaaugcaaagccuaauuguuaauuaagaaaagucauuuugagaugugaugguguuuuauacucaacaugagcagguucuauuugguuguggcaaccuuaagauuuaugacugacuguccuaucaacacuuggcaaauguuuccaugcuauggggaugcauuuuacaggcuguuaaauaagaacccacgaagugguccgguauguuuuuaaaaaaugagccuagcaccaauguauagcuuucucuagaauuuaaaucucauuguuaauuugaaguuccucucuuuauugaaagcuggguauugaauacaccuacugggagauguggccacauagagauagucuggauuaaugggcuuuggucuuauuuuuuagaccuaaauuuauucuucauuaaaagaagaguaaaauuccaggugcgguggcucacgccuguaaucccagcacuuugggagccugaggcggguggaucacucaagauuaggaguuugagaacaacuccucaguuggucaacaugucaaaaccccucucugcuaaaaguacaaaaacuuagccaggcgugguggugcaugccuguaaucccagcuacucgggaggcugaggcaggagaaucgcuugaacccaggaggcagagguugcagugagcugaaaucacaccacugcacuccagccugggcgacagagcgagacuucgucucaaaaaaaaaaaaaaaaaaaagaaaagaauaguuaagcaaggugcuuuuuauuuucacuuggaaaguuucuuuauauuuucacucagaauacuuaggguuacauacaguaauaaaauuuuuaguaacucuauuaaaggaauugccuaacacucaggagucaccgcuuuccuuaguaaaaaaaagucaagaauacacuaggguuuauguaaaacaagaaaucuccaguccaaaaucagugaaauaagaauacagcaucaaauuauauuauugaaguugaagaacagugcacagggagaaaacaaagugauaacuuaauucaaugcuauagaaaagugauuugugagucacuuuaacauuucagauuuguuuaaaccauaaaagugauaaauuagccaaagagcuaacaauugauauuaucuuaaguucacauaaauuuugauuuaacugaagcaaaugaaaucaauguaguuacucccuuccgauugcuucaucuuuguacaguuuauaaagcuaagaauaaguagcucuaaugaacaguuuuuuuuuuaagcuuuuuuguugagguuucucuaauaugugucuuuuaguaaucucuucauuuuuuuccucccaguucuucaucucuugggcucagcaucuccuucuacuuagagcacccugaacauguagacacagugguaaugcaccuuuccuuguggcuauuuugccacacuaggaacucuuuacauuccaggggucccauuccagagaucccaauaugcagauauucuacugucuaugcucagugcugugaaguucucuguuagggaccgaacuacaaggcauuaacaggcaggauuggugcccgcuagagguuuucucucugaaaucaucagggaaaacaaacaaacucaaagggcaaaugugugcauagcaaaagggaagucguggaaagaggucuguggcuugugccuuugagagcuggcagaaugagugagcagcacaggcuuggugaguguuccaaauuuauucagagaucccucagauuugguuugguauguaugggcucuuuuuauuacuuccuuuguuagcgguucgguguucaaaaguuucaaagagucgccacagaguuucuucaucauucuuggggagccaggcaggugggcaacucuuucucuuaagcagccaucugaaagaccucuuaagcagccaucugaaagaccuuaccucaggauuacacuuggagagucagagcugugagaugccugcccguccguagcguuccugacuguguuacaagucugguagccugucugcaccugguuccaagcuuuucggguuguugaucauuuuugaggugguggaaacuguuaauguuuccuccucauuuugaguucgggagagauuugcccagccaacuucuaaucagagacucuuucaaauccuguccagucucucucccuccacuccuuccucuaguuauucuccaucaggccuucagaaugugcuuuuugguguguccagucagaucauggcacucggcuuccugucuacacaaggaaaaaauccacaucauguucaccagaugcuuguucaacccgcuucagccccccagguuuccugcugccuucccauccucucccaacacucuggccucagggcuuuugucuggaccacucuucccaagguaucuuccccuuuugcucaaagucagucaugagggaggcguuccuuaauugccacaucucuuuucuuuucuuuucuuuguuuuuuuuuuuuguuuuguuuuguuuuguuuuugagacggaguuucacucuaucacccaggcuggagugcaguggcaugauugcggcucacuucagccuccaccucacccugcaccccagguucaagcgauucuccugccucagccucccaaguagcugggauuauaggcacccacuaccacacccagcuaauuuuuguauuuuuaguaaagacaggguuuugccauauucgccaggcuggucuggagcuucugaccucaggucauccaccugccucagucucccaaagugcugggaugacaggugugagccacugugcucggccaguugccacaucucuagcccacauugccacuggguugucauuugucuuucccuguagcaugugggcuuccugaaaguaggauaguucucugucuuguuaaucuaucuagcuuuagcacccagaacagugccuugcauauugugggggcucagucaauauuuguugcaucguaaauaguggguuugugaguuuuccauuucucaacuacaacucucugaagauuccaauaggagggagaaacaggguagucagagagauaauaaacaaaaucagccaacguugauaaauucagaguauggaggaccagguaggaugugucaucauaccuaagaacgcugccucugcuuaaaaauuauuguuagcucuagaaacaaugacauaucuauuuguguagcccuuugcaguaaacacauauacauuaauucauuagauuccccuaaaagauucuauuaaaaugguguuuaacuuuuuagugcugauaauguaagaucuucuuuguaggauugccucuauuuuguuguuguuguugaaggccagggaggguauuguaaguguuggaugauguuuagaacauaccugugacauuggggcuguuacuacugagcguccauguugccauuuggauuuucucucuuuuuuuaaaaauauuauuuaagaaaagauaucugucugucucccaggcuggagugcaguggugugaacacugcucacuguagcgccaaccuccugggcucaagcaaucuucucaccucagccucuugaguaggugggaccacagacacaugccaccacacccaucuaacuuuaauauuuuuuauaaaggcaggaucucaccacguugcccaggcuggucucaaacuccuggacucgaacaauccucccaccucagccuccuaaaguguuggaauuacaggugugagucacaaugccuggucucauaguuuuuauucugauaguuuaugcuguuauucaugacuccuucuucuaaccuucccuggcugguguuacuuauguagaaaaggaagacaggucuuguuaguugccuucaggaagacuaaaaaucuuguucgggagagagaaaccaugaaaugaaacuaauuuauuggccuugaagaagugucaacaacauuuaagucaagagcaggagaauggugcuggggaacaaauuuaaauugguuuuuuaucuuguaaaaaauauuaauuuugaauaaugggaaggaaugguaggcagaacucuauagucccuaagauuuucauaucaugguauauuuacaucuguuuaucuaaacuaacauuaauguaggugcugcucugaaaauauuuuugcaaauauaauuaaagcccuagccaggcaugguggcucacgccuguaaucccagcacuuugggaggcugaguugagcagaucacuugaggucaggaguucaagaccuggccaacauggugaaaccccgucuccaccaaaaauauuuuuaaaaaauuaacugggugugguggcgcaccccuguaaucucagguacucgggaggcugaggcaggagaaucacuugaacccaggaggcaggggcugcagugagccgagauugugccacugcacuccagccugggugacacagcaagacuccgucucaaaaaaaaaaguaauaauaauuaaagcccuaaauaguuggccuuaaaauagggagauuaucuuagguggaacuaccauaaucuggugagcccuuaaaaggggcuagacacuuuuuuuccagcuaaagagucaguccaugaggaagcaucuucuuugauggcuuugacgauugggggaagggagcguaggcaaggacgcaaguguccugugguagcugugagugacccugacugaugggcaggaaggaaacagauaugucagucuuacacccgcaaggaacugaauucugccacaaacgugugcuccuaagaagaccuggggcucuagacaaggacguggccgacugacaccuugugagacacugagcagagaaagcagccacacuauguccccagacuugugaccuacagaacugugagcuaaaacauggguguuguuuuaaguugcuguguuuaugggaauuuauuacagcagcaauagaaaacuaaucauugagggaaaucucauucugacaaaaucuggaaaaaaaaucuaaacuguaaaaaaugaaauuuaguuuaguuucugaaagaaaguacuuuuucccucccucccuccuucucucccuccuuucuuucuuucugccugccuuuuuuuucagucuugcucugacacccaggcugaagugcuguggugugaucucagcccaccgcaaccuccgccucccagauucaagugauucucgugccucagccuucugaguagcugggauuauaggugccugccugccugccaccaagccuggcuaauuuuuuuuuuuuuaguagaacugggguuucgccauguuggccaggcuggucuugaacuccugaccucaagugaucugccugccuuggccucccaaagagggagggaucucccaugggauuacagccaugagccaccaugcccagcagaaaguacuuuuucaagaacaaaugaccaacauacaucaccaaugggaucaagcuccaugcugcuugccuugccccuuugagaccugguuaaaugaauagauaagaaguguuguaauuaguagaucaaguauuuauaaauuaguggguagcuccaaaguacuagaauagaccuaaaauaguucuugccaaauauuuaucuauucuuggaacaaccuuacucaugcauuauaauuugcuuagcaauccuuuguucauaggcagugcaaagauuaguuacagcccuccuacugucugaauuacuguacuuucugaauuaguagaguuggcauugauaaucuuaaaaauauaaacaguaaauaaagcauuuaaaaccccccaugcugcugacuucauauaaagagauaguuguuuuugaauauuuugauguccguacacauuuuucuacagaggcaguauuuaaauggguuuguauaaauaaguucucuuucuugaagcuugugcaaagcaucuuuacacaagaagcuuauaagcacagucaauaaauucaagaaaauggcccuuuugaaaggaagccacugaugcaucugugggcugacuucugcaugaaugacagcgcaguaauaagaaagcagacaacggcuuccuccgccaccacugcccugccgugcucacgcugcaugggggugcccucgcagcgggaguguguguuuguccugguggccggggacugcggcuuggccuuuuuguuuacaagagagaggacagcagccucugcccuccagcugcugugaaaacaguguuggaaaaccagagcgaaguuuccacugaagaacucacacuggaaaaaaaaaaaaaaaaaaaaaaaaaaaaaaaaaccaccaacacccgaacaaacaaaccuucccucauaaaagaccaucuggguuaaaguacagaccacugggucagaacccagaugguaaugagaauaguuguucuucugcaaacuuuccgagugggauuuccauauauuaaguuggaagagagcccaacguugaaaaacaggaaacuaacugaagggcuguuaguguaguuuguaaggaagauuuuagcagugggauuaauuguguauguuggauaaaggauccccaucacuggaggucuccuuccaagugaaaugggugcuccugcugauuugaauugggaggugacaguggcgauggcagauggguauggauuagagcaauauuuuggaggaagucucagcugggguuggggauagauugcauccugaggggugcaaaaggggaaaagagagggggaaggacgaggaugacucucaggucauuucuuuccucucuuauccuuuguucuuuucucauauuaucacucaggcaaaaugggaaugggcaugugagaugcuuugauuagucagugccagcauccagcaauguggaauucucuguggggcaucuugaagccucuggguguugauguggagugcugacccucucugaauuaguaacacacuucuagcuaucuuagacaggaaaccacagucauuacaccauggagaucucuucauuauagcuuugcuaccuuguccauggucacauuaaugacuccugucccaguucaucauugauaacaccuacaguaacccauggugcucugggagaaauauugggggagcagacauaugaacaaaacaauuuguuuaagugguaauuuauuuucuagcuuuucucugucacucacuaaagguacaaugguccaaauaaaugcugucuuguauggauauuuccccuggcauucuguucuauugcagugcuuuggaaagacgaagagucauucuacccauucaaggguagagauuaggggccaaaauguagaacauuuuguuguggagauuacgcaucuaggauaaaugguguuuugcccggucuaguuacuaaaauguggaggggaacugacuuuuucauguucguguuacccuuuucuuuuguaacugucuaccaugauacuccugguugcuccacugucuagauuuuuuuuuuuucauuuuugauguuucguuuugaguuagguaucugaguuccagaacuuuugcuacuugaucacccucugccaaacaaucauuaaaauaugcuccuguaaucaguaaugaagacagacauaaguaauggauaaggaucuuuuuuuguuuuguuuuuuuguuuguuuguuuguuuguuuguuuuugagacagagucuugcucugucgccgaggcuggagugcaauggugcaaucucggcucagugcaaccucugccuccuggguucaagcaauucuucugccucagccucccgaguagcugggacuacaggugcacccccccagugcccggccaauuuuuguguuuuuaguagagaugggauuucaccauauuggccaggcuggucucaaacuccugaccucaugaucugucugccucggccucuugaagugcuaggauuacaggcaugagccaccgugccuggccgagcauuugcuuuuuaacucaacauaguaacaucuucuucuuggggccauggccuggaaacugauggugggacaggcaugucacuuggagucauuucuagggguccacucugaggucugcugguuuccagcucuggccuucuguuucuucauguuuaacauaauaacaauacccauccuaccuccauuacaaggucagagggaaaauuuaacaugaguuggcauuaucagugugguacagcacacugucgccacagguaguuguuaacuuuauuucuggacuauucugagagugaacggggauaccccaaaccaaagcuagccuuuguggagucuauguucuggugauaaucacugcuuucaaacaaguaccauuaggucaaaacuaaaagcgugagucacgcagcugugauacauuuguaaagaaaccuuucugggcuuuccugggaauuuuuaguuuauuauuccuauauaggucauccagagaaggacaucucuucccuacuccaccucauaauccucaaacagaaauaugacccagucuuuuuuuuuucauuaauuuagauaaguuaugaauuuuagggagaaaaguucagauaagaaguacuuuuacauaguugaaugugaccucuggauuccaaagagaugaugugcuuacuggcugaagaaagccugcagauggaggauggggagaaagucaugaacuuauuacucaguuucuauuuuguaaccacuuggaauaaauauuuguguaaaauaugagcguaacaaugugguuuuaguuaaagccagaaugugguuguucagaaauaacugagcaaaaguuugccagacauucacauuucacugggcacccuuuauugcuguauacuaauucuggccaccuuacccaggaagcaggguauaugacauuuccauuuauugcaugccaccuacaccuuucaucagcaaagggacaccuguacauccuggggacagagcagauagaagacaugcauuccauugccuucuuucaaauagauacuuuucaaaagauuuuagacccugaguuaagacaaccucacucuuaauuauuguggucaggaauucuuuucuuugaaaugaaaccugcauuagcacuguguguuuccuuauuuacauuuuuguuaaauuucuggacaauacguagcuccccuuagggacuuucuaaguuugguggagaaagaaacccuaguggcuaacuucacuguuuaguccuuaaauuuaaauucuuuauuauguacccaccaggccacuggucauggguaguggguauggagacauuuauguggaucucacucugucucaucugacccuccauggauuagauagccaggccaggcaaugauuaggaggaccccacaacccaacugagggacaccccagcauuuucuuucaugcaaggauuaauuugcccugucuagugucuauauuauucuccccuuuuauguauguucuuuguauccagcugacauauuuaaaauugcuuguggucuacugugagccccacaucaucuuuaccucuaaaaucauuaacucauucuaacuucauuucacaucugacaacuucuuuuccuacuaacacuuuauuuuccuacuuugugauauaccugaugucucugcugagugggcccuuggauauauggucuuuuuuuuuuuuuuuuauuuugagacagagucuugcucuauugcccaggcugguaugcaguggcacaaucacggcucgcuguagccuccgcguccuggguucaagcgauucuccugccucagccucccaaguagcugggauuacaggcauccgccaccacgcucagcuaauuuuucuauuuuuaguagagacaggguuucaccauguuagccaggcuggucucaaacuccugaccucaggugauccacccaccucggccucccaaagugcugggauuauaggugcaagcuaucaugcccggccagauauauggucaucuuuuuaaaaaaaaucaggauuaaguguccucauauaagccuuaacauauuauguaguaacugauucccugaaugaucaguuccaaagauuuugcuacugugccccaggaagcaaacauuaaaaccucaguauucagggccccucuccuuucaggggucaaacuugggauaccaacgcccugacaucaucuuuuuugcauagcuacucagcuuauccaaaagggucucuaccccucucucccuaaccccaccaggauugcucauuaacuacuucuucaccuccaagccccucugcuacuauuuuaggauuaaaucuucuaugagacugagauaucuaaacauauuuauuuaaaauuucauuaaaguauaagcuuacauaaaaugccaacucuuaaaugugcaaccguaugaauuuuuguguaugucuauacccauguaauuaccaccagguucauucaaaauauagaauauuucuagcacccaauaauaccccucaugcauucucucagucaguaauuucuuuugcauguuuuuugauuucauacacauggaacccuacuguauacagucuuuugucuguaacuucuguaacuugccauuaugucugugaggauccaugagguugugguuaucuguggcuuauucuuugcucuugcuagcaguauucguuuuaugaauaugccagaguguguuuacacguucuacugugggugaacauuaugcgugucuccaguuugggacuauuuaugaauaaaguuucuaugaacauucucauauguauguauuuugauggaaacaaacacuuauuucuguuggcuauauagccucaaaggaauugcugggcgguaggcuauuugugugguauuuuuaaugcaagauaauagauuuacauacugagaauugugcuucauaguaagcuuuucuggguguauuuuucauugauagagaaauagcucuaauaugggccuaaauagcucauguguacauuugcuuaaguucuuuauucugagauaaaugauuucuuuaaguuaccaaugucauuuugaagacuaauucaguuauguuuucuuguuaaaguccuggcucacuuccguagcucauguuacuguuuuguguauuagccuucuuucucuaccagcauuuagauuauuguugaaaaacuaauauaagcgucgagggucaacacuaucacaaucuuucuuguaaaauuacuccuggguugacauugaacugcagaugacaaguaugucagaucaugugagguaaaacuacagagcaaggagguuaauuuuucaaauggauuuauuugagcaacaagcauuucugaagcacuguaugaagccauugcucugucaaguaaaguaaaauauagccauuauuuucaaguagcugacaguuugguggugggggcagaaaaugaaaaccauuguuugcaauguccuuuaagcaagcauugccccgcauguuagaggggaggaagggagugggggguggugaugagagagcaugaaugagggcaucagaaucagauuggagauucagagaaggcuuccuagaaacauauauuuugauggaagaaaacaaauuagauauuuggggagauagagugagggugagggcuuugcacuguaggggaagggaccaaauagcauauuuaaaggaauggaggcaugaaauagcauuauccaucuaguagucaauuuaggggauaaaacauuuuuuauuccauugaugguguuauugccauauacauuucuggaaugccucuuuuggaaugacuuuuagagcuaauuuucaaaccacaccagaaaaucacucuugauacuuuauagcuuugacccaaaugguauuucccagcuggacgcucaccagauuugucuccuaaacacuuuuggcucauuccaaagaaauacaaucugucuucagaagguuuaaggcuuaccacuauugagaacauucaaaagccugugugugucccagaacucagaaaucaauuccaaaaggccacuugugugcaaaaagcacuuaucguuggaauaagucuguaaccuccuaacgugaaaguacagguucccaaagacuuggcuuucaaccaagguuuuauuuuagaaauuuuaugucaaaauuggaucauuuuauauggugggagccaggggaaagagaugguggggagugagugggugugcuuuauacuaagcccagugcuuuucauuaguugucuuaggauaugauaauuaacucuggguuugguuaaacuggcucauagaucauggaaacaaggguuaucugagagguggcaacaaaagccaaauccagguagugagggcugggugugguggcucaugccuguaaucccaauacuuugggaggccaagacaggugaaucacuugaggccagggguuccagaccagccugggcaacacaaugaaacccugucucuauaaaaaauacaaaaauuagcugggcauggugacaugggcuguggucccagcuacuuaggaggcugagaugggaggauugauugagcuggagaggucaaggcugcagugagcugugaucucaccacugcacccuagccugggcaacagagcaagauccugucucagacaaacaaaaauuccagguggugagaaucuguggugucagccuguuuugaccucacuguaaagcagcuuugugaagccauggagcagaugaggaagcauggaggagauacuacagcagggaagagggcuugggaaggcaggagggggaucccagagagucgggaaaccugggacagcucagacaacaaucaguuaauucuuuugccuucaguuguauauuuugaauugaucucuucuuaguucauccacuacuaugacuuuuaaacgauaauaaccugaaagcucuucuauaaucugcuaagaucaguauagagcuuaucuguuauguuucauauauuuaauuaaucaaaccuaguuauuuuugaagaugagaauaguuuugugacccaccugggugggaggggaugagaagaauuauaaccuuuuuaccuuaaaacuuuccugauaaggcacuaaaccacugggcuggucuacacugguccaaaagacauuuauuuccuuccuuccuuccuuccuuccuuccuuccuuccuuccuuccuuccuuccuuccuugcuuucugccuuucuucccuccuuuccuuuucuuuccuuuccuuccuuuccuuuccuuuccuuuccuuuccuuuccuuuccuuuccuuuccuuuccuuuccuuuccuuuccuuuccuuuccuuuccuuucucuuuucuuuucuuucaucucuucuuuucuuuugagauagggucuugcucugucacucaggcuggagugcaguggcgugauuacggcuuagugcagucuugaccuacugggcucaagcaaucuuccaugcucagucuccugaguagcuaggacuacaggcagacaccaccaugcccaggaaauguuuaaauuauuuuggagucagggacucauuauguugcccagacugaucuugaacuccuaggcucaugcaguccucccacuucagccucccaaagugacuuuuuaaaaaagauguagaggcccuguguuaaacuagugugcuuuuaauuugcacuaguauagcuguuaauuugcacauagccaucaauaccuuuggggauggagauccugaaguuugccagaguuuucaucuguuuguucacacagauuauauauucccauacaacacugguuagaaccacacugaggaucaaccaaugcccucaaaccaagaggguuuccacuagcaguuacaguggaaaaggagggacuuacugcaauucccacucuccugucauuuugucuuguaucacgugcuaccaucaguuuauuguuucaugaggaugcccacauugaaucaaggagggguauccagagagauuucacuuccacacagaaacaccagcacuuaauuucucacagaaucaaauauuuuacaaugguucuaaaauacuacaugguuuguguuugaaaauuaucauucaggcuuaagguaaggucaacaugugucuguucuugguuuucugagccuuucuuugguuucuagugaaacauauugauacgguuuggcaguguccccaccgaaaucucaucugaauuuuaguucccauaauccccaugugucaugggagggaucuggugggagguaauugaaucauagggguaguuaccuucaugcuguuaucaugauagugagugaguucucaugagaucugaugguuuuauaaggggcuuuugccccucuucacucugcacuucuuaccaccaccaugugagaaggaccuguuugcuucccuuuccgccaugauuuuaaguuuccugaggccuccccagcuacgccgaacugugagucaauuaaacccuuucccuucguaaauuacccaucuuuauuagcagugugagaacagacuaauacacguaucaaaacuaucaaaagaaagcaauugguauucgauuuugcauuugccaccauaguaugugugcgugaguguuugcauuuuuuucccacugggauggaaaaaggcacuuagaggauaaugaaguugcucuccugacaccucuucaccucuuuuaccauuugagcaagagugguuucauauacuguugucuagcaauugaccuuuccugugucuaucuaucacuuaacuaauuuuauuugugcccagcacccuugccacaaauuugcuuuucaaguagaaaacaguaaauauaccuccacgauauuuauugcccugaaaaaugcauaggcaaaagucauaaaauuuugcaugcuacacaguggauccuuugacugcacucuggaaauccugaagccuauucuggucccaauuccauuucauuuuucuguuuuucauuuuucuuuuuuuucuuucuuucuuuuuuuuuuuuuuguuggaguuuugcucuuguugcccgggcuggacugcaauggcacaaucucggcucaccgcaaccucagccucccagguucaagcgauucucuugccuuagccuccugaguagcugggauuagaggcaugcgccaccacgcucggcuaauuuuguauuuuuagaagaaacaggguuucuccauguuggucaggcuggucucgaacuccagaccucaggugacccacccaccuuggccucccaaagugcugggauuacaggcgugagccaccgcacccggucuucuguguuauuaacagcacuuuuggugaucuugaaugcauuggcauauaacuaaaaaauuuccuuuuggaaaaaugucaagaaaggggauaccauuugcaaagaguucaacccagaugaugauuaagcaucuauaauuuacgugaccacaauuaauucauggaguggguuuuuugguggagagcaggggugcugagcauucuuuagcccuucaucgccaauauuaauuugaauggcuucuguaccuccuuguaauugaauuauuaauaaucacaaagagcuuauaaacuucgaauuuaaucuucauuaauauauaaagcucaaagaguaaugucuuuugaccaugaguagacugcuucucuaauuuaucuucaaaguugcuuuuuuuucuuccuguaaguuucuguaguccccuugacuccuaaaagugagugucauggaguggcuuugaucagggaacauacaucaguaacuguuuugugaccuuagucccggcuguguuuuauggcuuggccaaaguuuaucauauaauuuccacuuuaggaauuugcccacuuacuaaggcuuugagggcaggggaggugaaguaguauugugggagaggaguaauaaauguguuuucuuuucaguuucuacagugaguggucuguuuugaaaugagugcaggugguugcaguccacucccuccccaaacaggacaaauuaagaucauuuugcucuuucgggaagcugagggcaagccugcacaggugaggucacgagaggcaagcuaugugcacaccugguguccucgugcuucuugggcaggccagcuccaugcagugcagugccccugaagggaauggggccaggagaagacauaacagggcaugaggaucuucucugugccaagaaucaugcuagguaaccccccugagauuucucauccucuugagaauccugugagaugauccugcugcccuuauuuuuccagauggaaaaacggauuacccaggauucaccgcuugugaguggcagaaaguggcagcauuagaacugcugcacuccauggauacauccagcacaugugcucuccucuagugugugauuccgguucauuuaagucagauuuuggauuccacucaaugaaguuuguaacugcuaaguugugaugugagcacuuagaucaccaagaauuucaacuaacccacuaugcucaaagugugguccauggaccaaguaccuuggaaucccuugaaagccccuguugaaaauucagauuccuggccgggcaugguggcucacgccuguaaucccagcauuuugggaggcugaggcaggcagaucacaaggucaggaguuugagaccagccugaccaauaugaugaaaccccaucucuacuaaaaauaccaaaaaaaauuagccaggcauggugguacacaccuguaaucccaacuaaucaagaggcugaggcaggagaaucacuuaaaccugggaggcggaguugcagugagcugagaucacgccacugcacuccagccugugugacagagugagacuccgugucaaaaaaaaaaaaaaaaauguagauuccugagcccugccucaaaccaauuaggucagaaguucuggggguacagcccagguguagguucucugggagagucugucaugcacuaaaauuugagagucaugccauaaaaccucuuuauagugcuccaguauaaaaaagaucuugggguuaagcuuagcuaaacaaauacgucugcaggcuggcaguucaugaauuccaccuaaagacuaucugguuuaucccucauuuuacacaaaaggaaacugugguuuagaggguugaaguaacauguuaaaauucucauggcuuuuuugugguagagcagacacuagaaucaguucuccuuccuccgguccauagcuggcugcuucuaaucuuuuaaaaaucagcuaaucaagguaacuuggauccauuucaauccugucagugacccuacguucaauauaaaagaugaguccugggagaacugccguucugauucacauucaucugaauguugaaaaagugcauuucuucagagugcucuguaggagguggaaauauucaauaagcuugcgagaaagguuuccaucucaaccacaccaugugugcaugugcaugcacauacacgcgugcgcgcgcacacacacacaccacugccaccaccacauagcucagaucugucacaacaugagggaggggacucgcaaacaugcauaauuuaugcaggauuuucacggauuuuucaguauuuggaagugauuucuuaaauuauacauugaaacagcuccauaaagaugaagcuggaguuaguuucacaauagccuuaaaagugagagaauuugcgucucugggaucaaugugcauauuucaaagugagacguuucacuuuauagaauuuagagggucucaaggcugugguugacauuuuuaguuuguugggcuaaacaaccauuugcuauacaauacuauggaaacgaaugguggaagagauugcccuggaaaacucuguucaauuccguuaagaaauauuaaauuccugaggacaaucuacuuguuuauuauuuucaauuucucuuaaaauaguauaaaaggaucuucuuggguggcaguacagggaugacaaggaagggaccaaaucucaguuguucacauuuuuacuuaguuuggauuccaaauaauggggcuucucauaaaagauuuggacccugccccgaggcuuuugguaauaaauguggccgcuuuguuuuuuucccuaauuauuucauucguaaaagucuuaucuucccaauaaagaugguaacuccucuggacugggucugcuuuucgcauuuuccuucuuuuauauaccaccaugguauagaacuuauuuuugcuuaauaaacaguuuggacaucaggaagagacagagcuguauacaauagguaguuuacagucaaauauuuacugcuuuaaauaaggcagaauuggcugggcacaguggcucacgccuguaaucccagcacuuugggaggccgaggcgggcggaucacaaggucaggagaucgagaccauccuggcuaaccuggugaaaccccgucucuacuaaaaauacaaaaaauuagccgggcgucguggugggcgccuauagucccagcuacucgggaggcugaggcaggagaauggcgugaacccgggagguggagcuugcagugagccgagaucaagccacugcacuccagccugggugacagagugagacuccgucucaaaaaaaaaaaaaaaaaaaaaaaaaaaaaaaaaauaaauaaauaaauaaauaaauaaauaaggcagaauaaguaguauuuaauuagagcacagacuuugugguaaggcaggccugaguuugaaccucagcugugauacuuauugccucauuugaaaaaaguaaauuuuggccaggcauggugacucacaccuauaaucccagaacuuuaggaggccaaggaaggaggauugcuugagcccaggaguucaagaccacccugugcaacacaacgagaccuuuaaaauuucaaaaaacuacuaaaaauuucaaaauaauuagcugggcacgguguugugugccuguagucacagcuacuggggagguuggggugggaggaucgcuugggcccccgagauggaggccacagucagcuaugaucaugccccugcauuccagucugagugacagacccugucucaaauaaaaaaauuuuaaaaaguaaauuuuauuguuuauauuuaaggcauacaacaugauguuaagagauacauguauauguagauaguaaaaugguugauagugaagcaaguuaacaugucuaucaucuugcauggcuacccauuuuuuuguauguguggcaagagcagcuaaaaucuauucauuuagcagaaauauggaauacaauacuauuaacuauaguccucauguacaucagaucuuuagacucguuuguuuuacguaucugccacuuuguucuuacacacuugugugaucuugggcaaguggcuucauuaccucuccaccuuuagauuucuguucugugaguuaaaaguaacucucagcacuguuguagcagaauccaugaguaagcacucaauaaguggcaagugcaaucauuauuagcaacaaccguaauaauagccauaguuccauuauuaaaggggaugauugcccuuguuauccaagugcucaucucauuugacuuugggccuuuggaauuaauaaagcaggcuuaguuccuggguuugguuuuccuuuuucccccaaaguuuguuuuguuuaguucaaaccauauuuuauguuuccauuuauaaacacauucucucaagugcugaacuuuuaagcauggaagucugaagauaccuccucuugugaagggaaauuuaaaaaauauuuaaugacugcuuuuuaaguuuuuggucugaggaaagagcagcauuaccuuggucauugacuaaaauaaagacauaauaaagguacuggaaacugaacagaaguauggaguuugugagugaagaguuggucacacagacagcucuccuuccucagacauucaggugcauucuggguaaguugacugauuucaaaaugcucaccuucaagugccaggcacaaaauuauaaugagcuuccuuucucauaauucuucuuuucaugauuuucucagcuggauucuucaaaggauuauuuguaaagaccuuuaugguguguuaugauuuaaucagauguagcccgaauuucccaagauguguuaauuaucauugccacacaagugcaacagaggaagcaaaauguuuuucauuugggcagguugaggguuuguuuaaaacguacuuagggccauuaggaucacaucaaaauauagugcaugguaauuaugcaugaaauagaagguuaccugcuguuuaaguagcuaguuucuugauaauguugcaauaaaguauugagagaaaauugguuucucaauagcaguggaacaccuuguuuaagggacaaagugaacugcauuaggcugaaaaacgaaaagggggaaaauaaaaauagauuuuaucaucaaaguugucaguggauauuguucucagucuuaaagaauuauuuuuagucuuucccuucaucaaaauggagaauuauuuguuugcauguagauugugguagaguugguauguuucagauuuaaugaaaugcagaacagaauaaaucccucgggaaagaaaggaaagaggggauacgccagacuuaguauaugagaguagucaaaagccuggcuuuaaaagucaaagaaaccccaaaguugacaccuggucccuaugcuaacuagcugugugaccuccuccauguuacuuaaccuuuccgaccucccaguuucuuuaguagcaaaauggagauguuauuauuaauauaacagaccuuguugaaaagaugaaaugagacauuguauguaaagcacuuuaggaggacaugucugucacauggcugugcuaaauuagauguuauuauccugucaacaggcugaauagcaagggggaaaaguucuaaacuuuggaauccugucguaauacacacagagaucucauuccuugugaaagaauccucguuuuggaaugggaugcugccuuggggaacugccaugacaaggauaugaaguuacaacugugauggugguccuuugaagaauauguggagacuuuucucuauauuggauuauuauauuuuuacuuuugggaaauaauuacacuuugaaucguuucaugauuauuuggcuaacaaaacaggugauuucugugaguauauauauguauaugugcguguguauauauguguguguguguguguguauaugcauguauguguuuauuuauuuauuuuaccauggacaugcccuugaugaaaaagaaauacuuugcuugguuauuccuccaaguggaaauuuggacauuacccuuuguucaugguggggaagauuuuuaguuauuccacauaucagaauuaucuacgugaauaguuagcacauaauuaggauuaaaaaguaacuaguugcagaaaacucauuauuuuuucuaauucuaagaaaguagcuucauuuuggguauuagagaaaagcucaagagauucacugauuaauauguauugagccuguuacauagcugacaaugugcuaguguuuucacaguuucuaucuaacuuacaaaauaacugaaagaggaagaaaaauauucuauuccauauguauuagaaaacuauccuuuaaguucuaaaguuggcuuaugaucuccugaauugcacaauauuuaucugcaaaccuugaaacuauuuaaucagagacuucugaccccaaaaugccaacauuacucuugguggucuuucaagguaauucccccuuguuuuuaguguauccauugaaacacuaaauggaaauauuuagugcccugaugcuaagggaauauuccaacuagcggcacugauuccacuccagguuauuaauuaaacaguagcaaucagcccaucugaucuuuaauauucuauugcugcugacugaugcccagacaucagacauuuuguaaucuaauacaaaauugcucugugcuuaggacuaaagaaaaacaacacauaauuuauacuauguuuuaucuuuauuuucaaguuccagaggauacgcugguugugucuuucaaugauuaacuuaaaaaaacaaacaaaaaaacaagacacuacguaucucaagcccaacaugaaggguauugagaguaaauuauaguuaaaucauuuauuucugacuuuuucauuuuuauguauucauuuuuucaacaaauauuuauugaaugccuacugugugucaggagacauccuucuaggcaccugaacuuauaacagugaguaaaacaaagauuucuggcugagcgugguggcucaugccuguaaucauagcacuuugggaggccaaggcgggcagaucacccgaggucaggaguucaacaccagccuggccacuauagggaaacccugucucuacuaaaaauacaaaaauuagccaggcaugguggcacacgccuguaauccuagcuacucgggaggcugagacaggagaaucacuugaacccaggaggcagagguugcagugagcugagaucaugccacuacacuccagccgccugggccugucucaaaaaacaaaaaacaaacaaacaaacaaacaaacaaacaaacacacacacacacagacauaaaacccacaaaaauuucucuuucugugaaauucacauuccucccaaauggagguuguuggaaaauuuuaaggugcucuuuugacuccugugguuguacuuggaaagaagaauuaaaccagaagaggagauauucuacaaaucauauuugggugauuuaauuaaccucuguccacuauccucacuccccacuccuucacugcuaccaccaacaaauaucaugcuuacacacauaccuugaggggaggaggaagggaagacaaaucagaauuugcuguacaugcaguacucuagaagccaauguggaguugaccuaaggggauccuuauaaaaacuuagcagacaagaauuauaugcacuucauuggaauuccacuaauuccagauuucagaucagcugggaggguugucuagacugaagcuuuacauuguuaucuuuaaagauaauguaaauuaaaaggauggaggggaaauagguaaaguguauaaguaaacaaaugauacaaagcacuguaauuccccaaagcaguuucuuuggcaaugcacagugguuucuacuuaauacugcauauuuuauaguuuucacuaacuuuaaucaacauaaccauuuagccaaaauuauggugacuuucaucaaaugaaccucaugaugaaaggguugggaggggauguggguugcauguaauaaaaucuccauauauuuugcauaaacaaacacacacaucauccucuugggaauaaaauaguuagcaggagcauuuuuagagauaggguguuacucuuuugcuguugugccaaaccccaauuaaccucaauaggggccgggugcaguggcucaugccuguaauucaagcacuuugggagucagaggugggcagauuaccugaggucagaaguuugagaccagccuugccaacauggugaaaccccaucuccacuaaaaauacaaaaauuagccaggcguguggugucuuccuguaaucccagcuauuuaggaggcggaggcaagagaaucgcuugaacccgggagguggagguugcagugaguugagauccuggcacugcaguccagccugggugauugagugagacccugucucaaaaauaaaauaaaaaaaugaaaaaccaccaccaccaccacaacaaaacucgaauagagaaggcgccguguucaaaaggccaaagaagagacucagagccagcaaauaagacauggaguuuuauuaagggcuuaauacaggagagagaguccagugguggcuggcuggacaggagaaccaccuuauguacagaaaugguccaguggcagcuaguuggacaagguaaccacaggcucaguggcagcaagcuggucgggaaaaccacagcugccugcagacaucauguacuuuauauggcauuuaacuuaacaccugcccuaacgaccuccacugguaaccuucauuuaaccugaaacucaacaccucaauccccuauacagccuguguuccagggaacaggaagggaaggaacaagacuauuggaugggaugggaugggauggugggagagcagcucagauguuccucauagauaaggaaagacucuccagauuugucauguccaguuuccuaccuuggaacacacauucaggugcaucugcccuagagggucauucuaaggguaugcuuaaauuaaugcuaucagggguguguacccuacagucaccuaggcuggagugcagcagugcaauuacagcccacugcagccuugaacuccugggcucaagggauccuccugccucagccucuagauuagaugggacuacaggugugugccaccauuuuuucucuuuuuuuugggggugggggguguggggggauggagucuuuccccauucccuaggcuggagugcaguggcaugaucugggcucacuguaaccucugucucgcagccccaagcaauccuccugccucagccucccaaggagcugggauuacaggcaugcaccacaaagcccagcuaauuuuugcauuuuuaguagagaugggcguuucaccauguuggccaggcuggucucgaacuccugaccucaagugacugcuggcuuuggccuccaaaagugcugggauuacagguaugagccacugugcccagccauucuuggcuaauuuuuuuuuuuuuggagaugaggucuugcuguguugcccaggcuggucucaaaccccuggccucaaaaugcuaggauucuuccaccuuagcuucccagagugcuaggauuacaggugugaggcacagcaccaggcccccuuggcuaaauuugguuugccacacuuuacagaagcaacguaagcaguuucugcuuuucauagcauagauucauagaaagaagaguauuccaaauagauaaugguuuguuuacuauagccacuggguagucugaagcauauucuucuaccaggaagugguaguuuugccuaguaccuggugacugaggaagaaaucagugaccuaaacugacaaaugagccuacugagguggcauuguuuaaaugcacaaaucugaggcaguggaaagaaggaauugauugccuugcugguauuuuuuccccugcacugacccuucuuaauuaauacaugagguaccauuuacccaaacagauuuuucagcacucacuuauggaggacacuaaguggcgaguucauaguucaggcagagagcuggcagaucaagacuccuuucaacuaugagaucugugguucuaugcaaggcgaccaugaaaggaguuguuuagaccccguuuuucaggccagcagcaggagcucagcccgccauuaagaguuuguucugugugcauguuguaagcaccugaaguuucucuugaauguucucuuuagaaagauccaucguuagggugcaagagcaauucuuauuugcugcaagaauauuuauccuuaacagcauauagcugaaucucacuuuauauaugaauucuugaaauaagugcacguauguuucaugcuugcaaauugcauccaauuagaauagcuuauuuuaaaagcuguuuuagagaauucagaaguauagacucauaaaaugucaacuuauccccuaauauuccuuuugguacauuuagauuucuaggugcugguuuugcuuacauucacuauaaaucuuaauugcaaagcauauucaagccaaugaucaauaucaaagaaaacuauuuuuuuuauccuaaggcccauaugccagaaucccccugucccccaaucuuuaugcuucuuccucauaucugcuuccaaaucaagaaaugauuggaaucugggugcagucaccugcacccuguagucccagcuguucuggaggcugaggcaggaggaucacuccuugagcccaggaguucaaguucagacugggcaacauagcaagacuuugccuguuaaaaaaaaagaaagagagagaaagacagaagggagggaaggaaggaaggagggaaggagggaaggagggaaagaaaugcuuuggcuaagaaaaugcccugaaauuuggucaaaguuggaguuuccucaaugccaaaguaaacgaccauuugcccauuuacccucuacuucccacaaaagaguuuaugacucuugcgcagaguauugcaccuuguucuucuuuuuuugauacuagaaucaccaggauaaguguguaguguagaccaucucaggcauauuucauugcugucguguuuuuccccgcuauuauuugaaaaacaaaggauuucuuguagcucuucagugcacuaacacucacacaaauugccccaggcuucucauaaguaggaaguuccaaaauuaaaugucuaauuuugcugcuuaaacauccuuuguuggcuccguguccaggaugcucuuaucacuuccucaagauggccaccuuaggcagucgauucuguuagaaccaaauuguaauuaaacuauuuuaauuuuaugcacugauuacaacauuuuucucuuuauuaugcauggugaaaguuccucacuacacagauccagguacuuauaauuauguacaaaaguagugaaacuguuuucuaagcuguauucacuuaccugauuuguuucucuauccaaucucaguugaguuccucuaagacagggugauggugguggugaauuauuuguguuuggcuuagauaaauaaaaacuggaagaguccauuaagguuggagcuuuuuauaagcuuucaaagaaagcaaaguugagguggaguuaaaauguuggggaggauugcauuuagauuacauguacaaaauaguuucaaguuuuaccaugaaaagugcaaauugcacuaaauuugaagacaaauucacaacuuuguauauuuuauuggguaucuauuuuauuuaauuuauuuauuuauguauuuauuuuugagauggagucucgcucugucacccaggcuggagugcaguggcacaaucuuggcucacugcaaccucugcuucccagguucaagcgauucuccugccucagccucgugaguagcugggauuacaggugccugccaccacacccggcuaauuuuuguauuuuuacaaaagauggguuuucaccauguuggucaggcuggucucaauuccugaccuuaugaucugccugccuuggccucccaaagugcugggauuacaggcgugagcaaccaugaccggccuggguauuuauuaugugccaaucuguuguucuauauaacguucaugacaacucugugaagucacaaugaagcuuugaaaugauaaguaacuuuacuaucuuuuagagaaaguagaggcagaaguggauuaugaacuuaggcagccacccuccuuaacuuggguuccuagaugcugacaccgggcucaagugccugauucacugugguuugagcagcuguauuaugaagaaauauuacaaugcauuuaauaugagcuugggcuguguaaucacacaaacguguguccaauauaauuaucucccuuacugucugugaucuccaguguccucaucugugaacugaggagguuaaauaagauaaugcgaagugcuuauccagcaucugccucaagcaggugaucaugaugacagugguaaggacugugccgagaacugccucaguuacauuguccucuuccuuagugguaugcuucccaugguuauaauuugaagacgcuucuggccuucaaauauagugcuagcuagcaagggcacagaagaaugaaacagaguuguuugugggaaacaugaagcagaagcgagugauggacagaggugaggccaggggaacaggcuagagcuugaucagggccggccuugugugcuaggcuagagcuugaucagggccggccuugggugcuaggcaggagaguucugucuccugcgggaaaagcugccugucccuuggccagcuuucccuaaggcaugcagcuuucacaggcacuagccauucuuaagccauuuucucuuuccuucacuuugugcacaaccuguuggaauuucucagguccaaugugaugcuaauuggaggaaguguggaguuggaccuccuaggaguucaaacaagggccccuuagugauugcaguuagaaccuggacuguuuggucaagggaaguaacuaggaucagugcagaaaaacccaaccuauugcuuguucucaguagccucagaaaggagauuuugcauguggaguaaaaugggaauguuuaguaggggagccagagaugguaagugcaagaauugugagagaaauggcauauuuaggaaagaaaaaaaggccuugaaucuguuuucaauggaauaauuuaacuuuaguaaauuacauacuuuugcuuaggcuaguugaaaagaaugcucuaguucuaugugcagguaguaaaauuagugccuuucgguacauaguaaaugcucaauaaauauuuaauagacuugauuauuguguuucucugauauuaaauuuuuagacucuaguucacuauuaucauugcuuuaauuuggaaagcaauuaagcaaccaaauuauaguagaaugauuuaaauagaaagauuauuuuuaguuuagaugugauucagauaaauauuuugaugaccuagucuuguuuucauuucuauguggauucagugucaauguuucuucauuauccaauuguuuuugguguuggaggggagaagugacacauuuaauucaaaugugagacaagacacauguuuggcucuuucgggaagucaaggucauuuuagaagguuuagggucauauaugggaagugugaugauguagcucuauagauuucauuuucuaggcucuauccauacauucuguuucuauuucuccugugaaccuucaacaucuggaugcuuuccuaugagaugaauguuguucacaaagaaauuuaugcuugagaaaaguccugaggcauucuucccuacuuuauguuagucuccauuuaaauaaguuucuaaaccuuugaagagaaagugcacuuauuaaaaaaaaaaagacuugguaacaggaacucuugagguggguauucaguuuguuaaaggcauuaaauacuguucucuucccuccuuuuccaaaauaaccauuagguuccaccuuuaccagucucauuaacucuguuuuaagaaugagcugauuguuugaguugguuaagauaagaucaccucaacaucuguuggugauaacuuuaucucaaguguaucuuuaaggaaguccauuucaacugaaacauaguuaaguaucuugaacugcacagauaugcuuucaacuuugagcuggaauuagcauuuuuaucuucuuugggaacuggacacagagaaggaaaagaauaaacuuuguuuacuccuuccagcccaaacccuccauuaaaaauuuuucuuaaaguacaaaacguuugaaugccccaugaaaacaucucaaaugauugugcuggguguguaagcaaggcaggguuuuacuguuuuaaaaacgcacuugggggaaccuugaggaguuugccuuuuuauaaaccccucugaucuucuaugugaggaaacggagguccagugagugaaagugauuacuucugggcagagccaggcccgugccaagggcuuccuguuucagugucugucucccguuggggcucccuccguaagaccugcagccuguuuauuccgggccgagaggccagggggaagggccauuaugaacucacugccauucagggaguuauuggaugcuuauuagaggccccagcaucucuuuagaggcauuaauuuaguagcacuguuucgcugguugcauaguuugcaacuuagucaaaaguaaugaauuuaaccaauccucagcuuucaucuuguuuuagcagucuuccaaaaauaucagcaauaagggggugauguaaaaaacucuuaaaacacacacaugagaucuucugcuuuuaauauuugcugugguuucucugcacuuuugaggcucuuccccucguuguguguguaacucuuggugacucuuaacacagugcugucgccaagacacaaagcaaagagaacgugccaugaacugcuuccccggaacuaucagaugguuccaguuaagaaggaaauuaugacucuguuguuacagccugggaaaagugaaacaacauguuucaaacuugccacuucauggucacgggauugaauugggcagaacauuuuccaggccccagcugguagugccuccuucacggaggcggguaucuugugcccacucugguguauuugcacucccagaaccuccuucuuucucucuccucuucccccaucaggaauauaugcucaugguuaaggaaaccuagcuuggauuuccuuggaauauauguccauuuaauuuauaauuuuaaggcuggaugcaguggcucaugccuguaaucucagcaguuugggaagucaaggcagccggaucaccugaggucaggaguuugagaggagccuggcucauguggugaaaccuugucucuacuaaaaauacaaaaaaaaauuagccagguauggugaugcgugccuguagucccagcuauuugggaggcugaggcaggagaauugcuugaacaccagagguggagguuccaaugagucgagaucauaccacuccagccugggcgacagagugagacugucucaaaaauuuuuuuuuuuagaguuuaagaugagaaagcaaagggaaccuuuuccucuauguugaaauacuuccuuggaaucauuugguagauucucauagaaugguagucagagucuuccaccaguagucaggaaauucaaguuucacauccuuuuuauaaaccccucugaucuucuaggugaggaaacugagguccagugaguggaagugauuacuucugggcagagccaggcccgugccaagggccuccuguuucagcgucugggauccccgacuuguuuuuuuuuuuuugcuguuaaaaaaaaauccguaguuaucacuuucacuccuuuuccuguguguguuguugucauucauuaauaaugcuuaaaauagauggcagaggcucagauuaucuguaaacagcaaauacucuaaaaucauuuugauuuuuaaaucugcugcugcuuuucucauuauguuaauguuccaucuuuuugaguauuguuuauuguaauguaagaaccagucaugccugggguacacucaagcuggauccuugccauaagggcaggcuggggugaauggugguacacucuugguaaaugugacaugauaagaaauauauauuugggccaggcacauuguccugcaccuguaaucacagaacuuggggaggcuaaggcaggcaaauugcuucaggccaggaguuagagaccagccuggccaacauggugaaaaccuccucucaacuaaaaauacgaagauuagcugggcgugguggcuccugcccguagucccagcuacucgggagguugaggcaugagaaucgcuugaacccgggagguggagguugcagugagcugagaucacaccacugcuuuccagccugggcaacagagugagacucugucucaaaaauuuggucucugccccuugacacccaacugcuaaaacccuuguaauuuccugagugauagaggugauaagaaugucuuccacagaauucccaaaucccuuggaauuuccugggugauaaaccuuuuguucuaaugaggugauucuuaguggguuccuggauagcuucaaaguggugaugucaucagaaagacuaaacugucauuagaagcuuggaacuucuaacccacccuaccccuauucuccagggaggagagaggggcuggaaauuguuuaauuaucuaucaugccuaugugaugaaacccccucaaaauuucuaaacuaugagguuuggagagccuccagguugauaaccauauccacaugccgggaggauggugcaccccgacuccauggggauagaagccucuguguuugggacuuuucuggacaucacacaguguaccucuucaucuggcuguucauguguauccauuauguccuuuuuaauaaaucaguaauaguaagcuguuuucuugaguucugugaccccuucuagcaaacgauugaacuugaggagggagucaugagauccccugacuuguaggcaguuggugagaaguauaggagacccagacuugugauuggcauuugaagugagggauaaucuuguggcucugagccccuaaccuguggugucugcauuaacucuggguaauuacugucagaauugaauucaaucauuagauaucaaguagguuuccaggaaguuggagaacuuguuguuggugugaggggaagaaacccauaaguuuggugucagagcauugccaguagagaaacaggucccccccacauaugaguuggaugguguuaugcucuugguagggcauuuguuuugaauaauucacagaugcagaguguuugcagaaccguaaugggguuuugaauuauauccuuguauaggugggauuacaaauaagacuccaaauauaggcugguuugaaccucaguuguauucauuguuuguaucauuuagcaaggacauauauaaucuaaauaacaacgaauagagugggaggggagcuucagaguuggcucaguccauggcucagucauaucccuagaguuuuagacacuuuaccuuucuucacuuugccaucucagcaugccaguuugggucacaaauggacaucuuaugggggcaagacagcuguagacaucacaucagaguaugacaacuucuagucuccuccuugggucuccucuuaggagcaagagacuuuccuggaacccguuaguggacuuccucucugcuucucuguuuaaaucauucacuggcagaauagcaguacccuggauagcuagggcagucaggagccauccccugaggggcagucagagcugggcuuccauuagucgcgggucaagcaaacagccccugggaagagaggagauacacaggagagauucuucuagaaaggaagaacaagaccagaaauggauuacugcagccuguuuccuuaguuguaagguggagauaauaauagcacuuaauaagauuauugugagaaccggaugaguuaauacauauaaagcaugcaagacagugccaggcacauaauaaucuuucgguaaauaacaguuuuuuuauuuuuauuuuuauuuuuucuguuguuguugagguggagucuugcucugucccccaggcuggagugcaguggugcgaucuuggcucacugcaaccuccgccacccggguucaugugauucuccugccucagccucccgaguagcugggacuacaggagaguuuauuuguuaauacauuguauguauuauuauuaugacaauauugaaggcaucauaauauauugguuuuauaagaaauguuaaagaaugggagaggugauaaaacaguugcagggaugacccaacuacauggcugcauaacacacucuaaucugaaaugggagcagaggcaucauucacucucaguaauuuggcgcugguuguuuggcacauugagucauaagcauuugagucuuccacgguggcacugucaccauacaugugacccacagauuagauacgagauagguggaguggagaaagcagaguagcugagagaguacuugaugaggcuguuugcuucauuggggcucacagugcuaagaaaaaccauuugcagaaucaugggagcagaaugaucauuucuccuauaaucuggggucccagccuuuaggauguaucccuauucaauguaaaacacuagguuuuauucagugaauggcagucuagcaugguuaugcuagcugaauggucuuauagggaaagauuauagcagauauauguauauauauguauaucuaucuaucuaacuauauaucucuauauaauugguauaguuggcuaagugacagcugaggagccagcuggaucagaguucaaaauaaggugacagucuacaaaucccuggaagacuggagcaacaaaagagggaaucguuauuuggacacaguggggaaagugaaugaaaagaagaaaggcaaauuaauuaagauaauuaaaacacagacauucuuggcaauauugaaagcuauuuaauauuuggcuuucuaacucuacuauucagucauuuacaaaauauggcuuauaauaugucaauugaugaauaaccuuuauuuuacuauaaaauucaugaacuucuuuggucuacacaaauccaucuuccauuuuccauggcuuaccucauuuaagccaaugcaaaacugaaaguggggaaaagaauauugaggcuuuauuaugaaaugccuucucauccacuuuuuuuuuuuucagucucccuguguugcucaggcuggagugcauuggcaugaucuuggcucacuguaaccuccgccuccugguucaagcgauucuugugccucagccucccaagugacugggauuacaggcaugaacuacuacacccagcuaauuuuuguguuuuuaguagagacgggauuucaucauguuggccaagcuguacucuugaccucaagugaucugcccaccuuggccucccaaagugcugggauuacaggugugagacacugcgccuggugucucaccauauuuuuugaggguugauuauauuuuccuucuaaacauagauuccuuaaaugacugucauucucaucuuccuuuuucugcuguuuagcaggcuaccuggaaggcaguacuacucuguaaauguuugccgaauaguuuuugaacaaguaugaaccaacuauauuuuaaaaguaauuugacacuaacuuuguauucagauaacauuguaguauuucauaauuuauuaccuauaccaguaauguguaugcuauuuaauaaagacagaauguggugauguguauuuaaaaacaggauuuuuaugacugaugugugcugggugauuuuccuaggguaauuaccgaauuaguucuuuuggaagccacuaggagcuguguuuuuauguguucugauacuaauaauuucugacauugguuuaauuuacucuuauguuagauaagguccaaaccaucuaaaccagggucagcaaaauaguuaauauuuuuggucuugugagccauauggucucugucacaacucuucaauucugccaugguagcuugaaaauaacuauagaucuuacauaaaugagugaguguggcuguguuccaauacaacuauuuaagaaccugaaauuugaauuucacauauuauucuucuguugauuuuuuuuuccuaaugcuuuaaaaguguaaaaaucauucuuagcuugcaggcuguaccaaaacagguggcaggccagauuuggccauggguuguagcuuauagaccugacauaguccacgucaucuauuaagugugcuaccagcagaggaaguggucuacauaaagaggauaauuucuaaaucaagaguagccagaagaguggcuuguauauagucauuugucuaugucucuaucacagucauaauuccuuugguucuuguuauuugucuuuuuccauaggcagcagguaucuuccaugaaggcagagccaugacucauucuucccuuguguucccagggucuaguuuguaugaauguaugaaugaauacaugaaucaaguuuacaucucagaaauuggugcugugguuacugaauuacaaaauaugaaaugucuuuugagaaaaucacaaaaacaggagucugcuuaugccauuaucccauuugcugugagacccugaaccuauauucucacuuucauaaacaggcuuuguauaacaugugaaagauagaugaguaaaagaggccaauuuagguagggaaauauacaaaucauuucagaaagacuuccauuccuauugacuccugguugccaaguuauuucuguucuucccuuaaaauaaccagucacgauaacacucuaaaacauuaccucuucucucacuuucuccuuuuacagagggauugauuagcucucagaaaagguuuccauaaggaaaugaucucaaauacaauuagguuuuuuaacuaauguguauucauauuauuauuucugacauugauuuaauccuuaucuuauuugggguccaaaaaucaauaaggcuccccccaaaauauaauuugccucuuugguuauaaguauagaaacuuacaacuuuuaaaaaaaaaauuuuuguuucuucauggaguacaauguagaaagccaguacaguccaccuguuaaacauaugauagggugauaugcccagucuaguuacagaaagcuccugguuaggacccaguaaaacaaucaaggugaacuugaauaacaucuuuguguacauuucauaguccaucuauucuaaugguccaauauaccuauuuuuaaaaaucucuuucugugccuguuuuuaaacucauuucuucucccaauguguuuaucccugguucuaucaggguaagcccuaaagggacaauuuggacuugacccugauauuggcagaagauagcuuuucuccuauuguggccucuuuccuuuagcccucguguuauccuaucuugaccaaguaaagguucauuguggcaggaguuuacauaaacaggaauuguacucauaccccauuucuaggaaaaaugggaacagcaggcauuaucugauguaaaauguguugaacccugaacaaaguacucaguguaaauccgcauuuggcuguuacaaccagccagcugagaaucaguuacuugaaauagcugcuggucgaaaggucuguggccuuuccaaagauguguuguugacuuuauggcaagacuacuagaacuuuccuuguuagugauuuuauuuuauuuuauuuauuuuguuugugaugggaucuugcucugucacccaagcuauagucgaggggugccaucucagcucaccgcaaccuccacuucccaaguucaagcgauucucaugccucagccuccccagcagcugggacuacaggcucacgccaccaugcccagcuaauuuguuuuuguuuuuuuguuuguuuauuuaguagagucaggguuuuaccaugucggccaggcuggucucagacuccugaccucaagcgaucugcccgccucagccucccaaagugcugggauuacaggcgugagucaccacaucuggccuccuuguuaguaauuuuagaagaauguuuggaugccaucuaauccucccuaagucccaguuaucuugucuuaaaaaugggcauaaugucauuugucaaauaagacugauauugggcuuaaaagaagucuuuuaaauaaaguacuuaggauaguuucucagauuagcagauccucaagaaugauucuuuuucucucuuucguuuucuaaauaucccuuugaaaucuuaauuaguaagaugucucuuuauuaccagguuuuauauuguugaguauuuuccaucauauuauuacuuauguaugaaauaguugagcucuaauuacaaucuauuuuguaauugugcaaaugauucacaaugaagcuuaaaugaauaacuuccaaauguuugcacaaauaugauauauaauacguauauauauuauauuuauauaucauauauacauguauauauauguauauguguguauguguguguauauauacacacacaaacuagguacugauauuagacuuaccuguggauuauaaauaugucaacuuucucucugguccauuauuauuuuuuaaugcucucaaauauuucuaaagccauaaguauguaggcuuaugauggaugcaucgauuuuacaugaauauuugguauucaaacuaaaggcuauuuaacugguuucaacugccuuuuauuuuauccagcuuaauuuuaucuuccuucugaggauaauuuuauaaacaaauuccuaauauacuuaauaaggauuacaaaauugggaacuugcagaaucaucugguucugaggguuagcaugagauuuuuggaauauuugucucccaaggauacauuaaccuaucucuuaaauacucucaacaaagaauauuagagucguuagacaacauuuaaaauucaggccuaucugcccuuccaguuucaaguuggaauagaguugucuuccacuggggaauaauuugucucuauuaauugagaacaaaugugcauggguguuuuaauuacacaguaaauuaggagaauuuaagaugcagaauaugugaaagccaagaauuaaaaaccaacaacccaaaacauaaguagauaaacaggaaaaauaucucagcauaagaaugcaagcacaucccaagauaaagagugggaaaaaaugaagaccaagacaaauuacuaggguuuuggucaaguuccuucaaguggaaugaucccauuuuuggcuacaagccauuguuggcuauacauggcaggaggaagaaaccacacucaaaggauuacuuugagaugucuggcuucaacuagugaccuuuuaugcauucagugaaaaugaguauugaggauuuccuauacaaauuucaacuuuacagagaacucccacagcaaguauucagucuagguucauggaacccugguacuauguguaaaguuguaugguuaugaguuuaugggggaaauagguccagaacguucuuagauucugaauggaguccgugauccuaaaauauaagaauacaaccugcugcuugagcagggugaacauuuguugaccuuguucucugucacuuaagauaaguaaaguuagcaucucauaaauuguuacuacuccuuuuuuuuuuuuuuuuuuuuuggcaagggcagucagaaugacuucuuucugccucucaccucgcugugcaugccagauacuuccaaccaaacuuggugcuuccuugcaagaccaaccugcuacuacuucagagcacccuccucuaucucuucuuacuauaauguauuuagauauuucuuauuuuuuuuuacauugcccuaggcauaugagccuuuacuguaagcuaccuuaaaucuuuuuuggaaagagguaggauauaaauuaaacauacaccuccccaagaucucagaguguugauggacugauuacagagacggggagcagguauuuccucauucaucacuggaggcagaaaaaucaccuccaaauauuuguucucugauagcaguugggaaaaguccuccuuaaaugagaggcccacgaagggaugaauagggauuuuggcugaccuccaaagugaagcuaagauaaugccugccuucccaguauuacuugaggcuaauuacucagauauaauuacuugcacucuguguuuuugcuuccaauaggguuguguccuugcuuuuguuuaucuuguaucccccauuagacuuugagcucuuuaagaauuaaggcuaucacuuccuuucuauucaucauuuguucuugaggcaaugcuuuucacagaauagucaggaaugccauuuaaguuaaugauuaagauguuaaucucacauuguugcaaguuaggcaacuuuugaccauccuuucuaggaaccccaaguuauccgcauugugaaggacccuaaagugagccucaggagauuguggugaaagugucaucaacuuuuggaaaguuucugaacuuagugaugauuugugcuuuuucaggacaauuuguggugccagcacuuaagcgauaaacaucccccuuuaaauagagcugaucaaguuuaauucacaguagucgaugccuaaaaauuauaggaugcagauguauauuuuucauguaaacauuaccucaaaagaaauuaaaggaaagaaagaaaaaagugacuuuggauaaaugucaaguauauauaauuuauguguuugagcucugaacaaacugcuaaaucguuuggccauaguuggagagacagaacauuuuaccugucuguagcugggaaucaaguguauuuacccacaagaguggcuuauuuccuaguuuauguggauuacacacaucuguguguaaucaugucugcccuuuccucugccucaaauccuaaauggaauuaauaacuuauuguggucccuuuuaacaagacagaacagaucucucugccucaggcuuaggaggcuccuuuauaauaauucuuggcucggguaacccauauacuccucaaaaauccgccccauaaauaucauaaaacuggccucaaagccauccacguuuuccucuguaaaaugaagaugaagcaauuguggaagaaggaagccuucucaaagagaagccagaagucaauucuguuucauuccuccauauaaguuucacuuuccccagaggaagguggaaaaucccuccgaacggugccagguggugguguaagcacugauggugaaguucacgugggaacaggagaaguuaauaauucagaggccgugggcccucccacccugcccuggaucaaugccugcuguuugcugaaacaagcuaggagcccacgacugguccucguguauaggauuggcuccauuuguggaugacgcuuuugucuguuuuccaugcucgcccaagcuacgugccugcccgcuccuguagguugcucagcgcccugguugugucuuggcaggcccuggucugucuguaccuuccuucucugugaccagcuucaggagcaggccccggagagugcugggauuaggcgccacaaaugcuuauguaggacuuuacugugcacuaagugcuuugcagucccuuuuauucguccucccucagagcguugacauaaaguaaaaaacaaaaaaccauuacucaagucuuuaugccaaggggaaaacugaguuagacacagucaaauaugccucauuagcaaaugcagauuaaaaugaagacccucuagaccccagucauacuuuugauauuagauuacaguuuccucauccauaauacaguaaucuaggccaggcgcgguagcucacaccuguaaucccagcacuuuggaaugccgaggcgggcagauuaccugaggucagaaguucgagaccagccuggccaacauggcaaaaucccgucucuacuaaaaauauaaaauuagccgggcaugguggcacgcgccuauaaucccagcucaggagacugaggcaggagaaucacuugaauccaggaggugaagguugcagugagcugagauugcgccauugcacuccagccugggcaaaaggagcaaaacucgcaucucaaacaaaacaaaacaaaaacaaaacauaauacaguaaucuuguacauugauauuuuucaaauauucuguagauguagaauuucaugggcaagucuaacaucugaaauaaauaaccacagaccaggcgugguggcucacaccuaauccuagcacuuugggaggcugagacggacagaucauuugaggucaggaguuugagaccagccucaccaacauggugaaaccccaucucuacuaaaaaauacaaaaauuagcuggguaugguggugggcgccuauaaucucagcuacuccggaggcugaggauggagaauugcuugaaccugggaggcggagguuacagugagccgagaucacaccacugcccuccagccugggcaacagaaugagacuccaucucaaaaauaaaauaaaauaaaaaccacagagcacuucaacuggaagaggaaaguggaguccccugauccuuaaacuugccccccuuugcccaaauggcaucaagagcuccguggaguccagcuugaaaagaacuagacuaaaaaaucaccagggucucuaagugcuaaaauggaaccucagagagggguccugaugauuugauugaggaagggugauguacagggguuacaagcaugggcaucaacacccagcuuuaccaacuugcugugugauguucuuaacuucucuaggccucaguuuccucaucaauaaaauggggacuguaagugagaugaucuuuuuuauuuuauuuuuuucuugagacggagucucgcucuauugcccaggcuggagugcaguggcgcgaucuuggcucacugcaaacuccacuucccggguucacgccguucuccugccucagccuccugaguagcugggacuacaggcgcccaccaccgcgcccggcuaauuuuuuguauuuuuaguagagacgggguuucaccguguuagccaggauggucucgaucuccugaccucgugauccgcccgccuccgccucccaaagugcugggauuacaggcgugagccaccgcgccuggccgagaugaucuauuuuuuuagcacugagcauagaccugguccauagagguucucagaaauggugauauuauuuucauuguugguauaacaaugucaauaauaauugcuguacuuugaauuugggggauaggcuuagaaauagcaucaguaaugaaaauugccuguucuuuuaauauguguauucuucuuuaauaagcauuucaaccauauuugaguuuuuccaauuuuaauggaauuguucugucuuaaaaccuauuguguaugugucaugccuacauagucuucugugcagaguacggucauagccgggcaaaccuguuaucuaauaagaauguucgcuuuuucacauucaucagucagaaacaaauacuaaauaaacagcucuaaagaguaguaccagaacaauuaaguuaaaauuaauggagcacugagacaauauaugcugccuuuggggcauuaacuccgauuucacuuuuuuauuuguuuuuuuggagacgcucuguugcucaggcuggaguacaguggcacaaucuugcucacugcaaccuccgccucccggauuccagggauucuccugccucagcuuccugaguagcuggaauuacaugugcccgccaccacacccagcuaguuuuuuuuguauuuuuuuguagagacggaguuuugcccuguuggccaggcuggucuccugacuucaagugaucugccugucugggccucccaaagugcugggauuacaggcaugagcuaccaugcccugccagauuccacuucuuuuacaguaguuaaaaguagaauuaggagagagacaacagauaaaaccagccacacacuuuugaucucccuucugucuuucauacggaaaugagaguuucugagaaagguaguugaaacuagacagcagauaacagccuauggcgcauacagagggggugggagggugaaaccauacagcuuggugagguuugccaggaguaccugcuggggcccuggcauaggugacccugcaaccaaaacaggaaugacacuagaagaaugaggccuaaguaaccagcacacuguuaaaggaggugggaauaucacaucccagcuacgcacuuccugccccaauaucuaaagguuauuucauauggcaagcuagaaacaaaauacacacguacauuauuacacauguaauaucaauggcaaaauuuaaaaucacugauaauuuuaccucucagauauuccuggugauugugaucugugugcucauaugcugauauguacaccacaggcauguacgugcaaacacucacauguacuuucuuuugcaggaauaucaucacugccuccuaaagugcuucuuucacccagcagucuacucuaggcaguuuccauucuacugaauauacuuguauaaacacauuuuuuuuguaugugacuauauaguauuccuuugcauaaauauacuauaauuuaucaaauaauuguaugucauuugguugcaauaugcauuguuacaaucggugcugugacuauuauaaucauagcauuucuuuacaagccuccucagguauuuccauaggauaaauugucaaauugccuuccacaaaagaccucccaauuuauuuucuuacuagcaguuuguaguagugucuguuuaccccuacucuugccauuaucaggcaauguuuacauuaaagacuuaaaaccauuuuuuaaaauugccuaaauaaaugcuuccuuagcaaauacucuuuaaagaagaaaguaguuagguuuucuggcuaaacuucuuagggcuucuacaugaauguuuucacaaacauccauuucaaagagcuacuggaaaauuggauauggacuauuuugcuuuauuauaaaugugaguagcaacaagauucuuuguauucaaaaagacguuugagaguuucuagcccaauggcuucaugugccaauaaucuauggguccaagaagcucuguauuuccccaggaucacuuugacugcuacgugucagggcugggaguagacccugggccauccaauuuauucaacuuguagaauuaggaucauagcguuaguauauaucaaguguaauuuucauuacauaugaauguuuaaaaaaacauucaacagaacuuguuggauauuugaguauaaucuucuuuuucuuuuucuuucguuuuuuggagaccgaauuucgcucuuguugcucagacuggagugcaauggcaugaucucagcucaccgcaaccuccaccucccagguucaagcgauucuccugccucagccucccgaguagcugggauuacaggcgugcaccaccaugccuggcuaauuuuguauuuuuaguagagaugggcuuucuccauguuggucagucuggucuggaacucccgaccucaggugaucugcccaccucggccucccaaaguccuagguuuauaggcaugagccaccgcacccguccuugaguauaauuuucuuaucauuuacuccuaccagccucugugcuagguucuggggguauaaagacaggggccaggucugccuuuccccuacauuauuacagucucauaaggaagaaacccagaggagugaugauaaauguaugccucaaguauguaguauauagguggugcaguuguggucugugcacacagguacaaugaggaugcagcaaaaggucugauucauuuggguuacagacuuaauagaaggaaugaagcuugagcugaguuuaaagaguagaagaauuggauuuuaauauauggauggguccuccauguuaaaauuaaugagguuggacauuacugaggcuaagacgguagcagcaggugaugggaaggucaucaguguuggggcccauuagaccuauaacuccuugaacaacuuacuuugauccucaguugucccaucugaaaauaggaugauacugugcauuccacuuguagaacuaggauuguagcauuagcacaggcagugacagucauggcauucacaguguggagugacacagcaagaggggugaggcugcccagccauuuguacguuuugccuguaggucuuaaacuggauggcaggaggcuugaaguugugauuucuaccucauguuuucauuauaaaaugaguggucacuugaagaaaagugacagugaguuuuguguuugaaacuuuuagaaggauccauucuggaauaaccaaagauuuaacaugagggugugccauguauaugaacagagcucuucugugccaggucucuuaagaaggcuggaugugguuugggcugaaaaaaugaucacucaccaucaacccuuucugcgcuguguguggcgaaugccuggguuugccuuccugacuacuuugcaaaguguguugcuuuuucugccucuguugaauuuacccuuuuuccagguuccacucucacuacccuagauccagccuuacuggaggcugcacagaccaccagcuuucugaacuaugggccuagccuauuccccccuccauauguuauaguagcaaagucccugcuuuaaaauuuugcagcuuaggaacucugauuuucuuaucuuccucuaacuguccaguggcuguguauuuccugcauaauaaagaucugaacaucuuaccaugauacgugguagagcugccggcauucaucagauauucaugccuggauugccugcacaugacaaucucccuacuuugguugcugcucccccacuugccucugacuuagguaggguucccuagaggagucccgagacgggguuucucaugcaagugacuuauugagagaauuauuucuuuguagaagccaguaaaggaaugugagaagcaggauggggcagggcaggaagcuggggaaggaugugggucuaguugaaguccaaccuccgccuuaaccccuggggaaucuguagcaugaauggcauguauggccccauggagacccccauaucagucaguaacuaacuggcuguaggcugccuuuggguggggguagguaauuacccaggcauuuccccugcaagaucccagcagccuaggggugacugcacugaccaauaaaaggaauacacgcaggaugccagcagcuuccauuguacccacaggucaaacuccuacugauccuucaagacccagacagauuucaauuuuguaaaguuuuucccagaccagaaauucucauucugaacuaaugauguuaccaucucccgagucuucuuaugccucauucuaggccuuaucaagaucaccuuguaucacuguggauuggcuuaaugucuggcuuccugcuagacuaaugaguuucuugagggugcagcguguuuuaauucaccuuuaaauagcuacuccccagaccccagggcugucccuguguagcuauuuaguaaaggucguuugaauugaaaugagcuguaacauccuuccuugaugccuagugcuuuuagcccugugggaauguuucuucaagccuuccagauacggggggcucuuccaggaaugcuagcucagcuugccacucuuuccaccccaggauuccauagccauugagauuauaccacagguucccugugccagcauuuucuuccaccugcuccccuggaugucagucuacaucaucucaccagucggccuaugucaucucacuagucagccugggcagguagccugcugucaucugcuguccacaugggcugggcccuaggguagauggcuugaaacaaguauuacuucuuggaugacauucuggcugccacucagaaucugacaguugguaaaucuuggccugugcuauugaaugccaugacuuauugguguaauggugaaaauuguucagaggaagacugggacauccaugguggacccaagaaucaugucaggggauggaaaagggccaccauguccuaguuuggucuagaacuagauucugcaaguuacagucacaauccaauagccaaauagaagcacucauucauucauucauuuucucaacaaucuucuguuucuucuuuucuauuuauugugugcugggugagggcaaaagugaauaagaugugguuuuugcguucaaggaauugacaagggaaggagaugagauugagacagauguaugcacaacucagaauaaugaaaggaauaaaggauaugcaccacaagaaagaaagugcacaggacauugguuaagaaugugguaucugaaguuagagggccuugaagucaaauuccagcuccauuaguuaucaguugugggacuuuaggcaaguaauuuaauuuucucaccuucacuauuauucuuuuuucuuuuucuuuuuuuuuuuuuuucagagauggaguuucacucuuguugcccaggcuggagugcaguggugcaaucuuggcuuacugcaaccucugcuucccggguucaagugauucucuugcuucagccccucgaguggcugggauuacaggcgcgcaccaccauacccugcuaauuuuguauuuuugguagagacaggguuucgccauguuggucaggcuggucucaaacuccuuaccucaggugacccaccugccuuguccgcccaaagugcuggcaugagccacugugccuggucacuauuuuucaucuucaaauggaaacaacagugguaccugcuucauaggguugucugugaggauuaaauaagauacugucuguguaaaguacaaauugacacacauucacagauguuggcuguuguuaugaaugcuauuauugaugggcuaguucuugcagggcugggggacaguccauggaauagguggcauuugaguggggcuuugaauuuuuacaggcaagggaggcuuccauuggggggaaaaaaaaacagcuugaaaaauaaaaggagggggcaugagauuguauaacuuacuugggaauggcaaauggccgugacugccugggauguacugauggaugcucgaaggguuuccgugggagcugaggcagugaaugugugcuaggauggagugcuuugcaaauagugauuauucaauaaauauuucuugaauuucuuugauuauuuuaugcuuauguguuaacacuuauuuaugauaaaaaugccagugggcauuggguccaaauuuaucuuauugaaaaauaaaaauaauuaugaguaugccuccuuuaacaguuauagagauuggcacacuccuuuuuaccauuguaaagaaaaauaacugcucauccucagcuauuuuuugacccuuucauuugaagauguguuaugcuauagauuauggagcuguccaggagaacuuucugugaugccagaaauauucucuaucuuuauuguccaguguuccagccauaagccacaugggacuguggagcacucaaaguguggcuaguuugacuaagaaacugaauuuuaaauuuuguuuauuauuauuauuauuguuauuauuuuugaguuggagucucgcuuugucacuuaggcuggagugcaauggugugaucucugcucaccgcaaccuuuaccuccuggccucaagcaauucucccaccucagccuccugaguagcugggauuacagguccccgccaccaugcccagcuaauuuuuguauuuuuaguggagacagaguuuuaccauguuggccaggcugguuucaaacuccugaccucaaauaauccuccugcuucagccgcccaaagugcuuggguuacaggcaugagccaccgugccuggucuguuuaauuaaauggaagucaccccauggggcuagacaagggcuaucauaguggauagcacugcagucuagaaacuguucuggaucucuguagaggaaaugugcgaaugugaagcauuggguuuggaauaguguggggcaaaugagauauuuccuauugaggugucugguacugcaguuucagaagugaauacccucaaaacgagcuguuuauuuuuaucaguuuuguuuuggagaauauucaggcaaucugugacuagagugagcagugcuccaauagagugcuuugagaaauaccaggcugauuacagacccacaggaagcaauugucauaauuaggcccuguuaauaaaccaugggcugcaauguguguacacacacacauucacacacucuuuuucuccuucucucucacugaauccagugcucucucucuggcauguagugcauaagaguuauuuuucuuccugaucucaguuuuccaacaaaugggaaaaugcucugaacgcguugcauacaggggaaaaaccuuacagucuuuauuguaugugaacagcuaauaaggaaaccguuugacaagagcuugcuuugugucauggcuucuggcuuccagccaguuuauuuucuugcugggacaacuauauucaggcagcagaguuaagcaacagggagggggcaggaugaagaaacacagacuucauaaaucagggcgauucagcaaaauuccauuugaauugaaucugggccaggggcaggagugccauggagcgucuguguagaagcugacauuuuaaugauuugauuaguuuaggaagaauauuuuuauggauuguguccucgauuauauuaaguacugagugaacuuguuacauuaugaugaacuuccauuaccuacacugguuguguacaagugcaaugauuucagcccaagacccuaaggguaaucucgugcaauccucuuaaagaaaugcuguuuaaugacuaaagcuguuaaucauauuaaauacauacagccacucugggaaaauaugccaaacaagcauaaaucuaaaaaagguauuugaaggagcuaaaugguguguuuugaggggauauugggcaggggaaguaauaauggagggagcgaagggauguagagauggaagaagucauaauagguacagugaugguguuuuccaucuccuguguggcaggugcuguguugaauggguuaaucagaaugcucugggccacaucuagaagacauuccaacucaacauaguuauuuauuuauuuauuuguuuguuuguuuauuuauuuauuuuuugagauggagucucacucuguugcccaggcuggagugcaguggcaugaucucaacucacugcaaccuccaccucccgguuucaagugauucuccugccucagccucccaaguagcugggauuacaggugcgugccaccacgccuggcuaauuuuuguauuuuuaguagagacagcguuucacuauguuggccaggcuggucucaaaauccugcccucaggugaucugcccaccuuggcauccgaaagugcugggauuacaagcgugagccuccgggccuggccccucaacacaguuuaaacaaggaaaacuuaucuuccuaaaaauagagaagauagacaguucccaaguggugauggugguguauuuuguuuguaaguuaaucagcaauuuggugauaucaggguucuagguugacuucucucugauucucuugguuuucucuaauuuggucauuuauugugauauuuaaguuaacaaguaaaaauggcagcugcacucacacuucuuaaccaauggaaauuuauuugacucacaaagugcauaggaugggagaaaucuccaguggacuaguggagucugugacagugggguauguggaguauagauccacaggcuguuggaauaggcucagguccucaucugcucagaagacaggcagggaaauuccagucuucaaggguuuuguuggugaggagaacauggauauggauguaauguccuucccuuuuguuuucuuugcacaaauuucaguggaaacauguugccaagucagaucgccauucuacuugagugaauauggaauuuguccaguuuuccaaaugcagagcuuuuugugggcugauggacugaauagaaagaggaacaaccauacacccuucuacagaugaaggcaagauuuuaugaaagcgacuucauucguucuccucugccugguguuccuucuuuguaaaccaggaccagggagcuuugaauauagcaguauauuauagaauuugguuucauuaaauauuauaccugcccuuaguguuuauauuccaguauauugacaacccagguccucucuguaccugugauugucuguguugagacuauuacagagcuccaaaaauuaaaauaaaaauaauaauuuuacagaaauacauauuugcauuggaauauuuaagaaaguugaguuuggaugccacaagauuauaggaguaauaggaagcugggcacaguggcucacaccuguaauccuagcacuuugggagguugaggcagugaggcaauaggauuguuggagccuaggaguuugagaccagccugggcaacauagggagauccugucucuacauaaaguaaauuuaaaaugaauuagcuguuggugcuguuggcauguuggugcauaccuguguaccaggcguguuggugcacaccucccaaccacuugggaggcugaggcaggaggaucccgugaaccugggaggucgaggcugcagugaaucaugaugaugucacugcaguccagcuugggcaacagcaagacccugucucaaaaaaaaaaaaaaaaaaagugauagauaacuaaccaggauuuucuggauuuggguuugggaaguggaggaaugccugugucuguguuuagaaaugacaaaccaaaccauggacaugacacuauuagcuccugucccuacagcugcuguguuguuucuugagagcccaggauggguaguaggccucuuuaaccuccguuaucacuuaauucucaccauaauccuaggagauguauauguccucauuuuagagauaaggaggacauugaggccaagagaguuuaguaaguaacagaauggauuuucaagccaggucugucuugauaagaaagcucacaugcuuucuuucuuaugacacuguuuaagcuguguucugcuaaguuccuaagauucucuaggauagaugcauguguaggaucaauucagggcgaaagggcuggaguggcuuugagauucccaaccucugcuccuaacugguuuucuauccugaguuucugcauaccauuuucuuggaagaagagauucugugcuuaaaaaaaauacguacauaaaagaagcgugcacauugcuguccuguaccgcagugccugagucagguauccauuugcauugugaaaggagccugaggugugaaacaguucuggguucuuugcgcacccagcuggcuggcuuccugugaacuggcugcauuucagauuucauucucuagccagaagcugaaaggcaggagcccuuugaagagauacagggaagcaaagaggguuauccagaugagaaggaagggaaagggggcgugacaacuccuuggagggaauuuccccagugggaacugccucuggaggagcuuacacagggcacaucaaugggaaaccacguccuggucugcucggaagcccuggggggccucuugcaacaugcaggcaggcuccccagacucaacccucucucucuaccagaggcgcauggacugcgccugcuucccccuucucuuauaaagccagcuaugggccauucuaucccucugccucccuggauccuucguccaugcuguuccugaaagcaagaaacaguccauuuuuuuuuuucauuuaauacuuuuuuuugcuaagugcugcugggaaacacauggaggagaacaaaacccgacaagccuggugcugcucuuacuguaucugugggguggggaauggggaaguucugaaaauuuacaggugugucucagacuaaaggguuucaaaacacugugcugaagcagugcguguugagguagaaggcacaggaguguuccugugguugggagagauauccuguguccagaauuugaggcaggagauagagguuuugcuggugggauuguggugagacuccuagagcuggaaccaggagagggggauccauugcucugugaagagggcaucuucacguggagcaaggcuggacagcaggagcccacuagggaccccugugagcaggcgucuggacuuguuuguuugaaaacaauuaagacgagcaaugugaugugaagcauucagaguaaggguaguggacuggauuaaauagaggggcaguuguaucaucuuucugugccccgugccuccuguuucuuccuucauuuguucauuaaacaaauguuuauugaugguuuauaaugugccagacuugccuaggugcaugggacgcagcaguaagugagaccaagaaggucccaguacucacggugcuuauauucuaguagacagugaauaaauaaacuugccaaucaaaucucugccauagcucucaucacuuucagacauagauuaaaacaucugagagugccuguaaucccaacauuuugggaggccaaggccgguggaucccuugaggucacgauuuggagaacagccugccuaacauggugaaaccccguuucuacuaaaaauacaaaaauuagcugggcgugauggugugcgccuguaauccagcuacucaggaggcugagacaggagaauugcuugaacccgagagguggagguugcagugagcugaaauggcgccacugcacuccagccugggcgacagagcaagacuccaucucaaauaaaccaaaaaaaaaaaaaaaaaaauacccagcagaacaucugagagugauaagagcuauggcagagauuuaagauaguuccaugaaugcuagaaacugacugguucuaaaagaccagaagaccucuucaagagagacuuuggaggcgaaaagugaguguagcauagagccagucuugggagguuuggggaagaacauaccacugagagagagcagccaguaucaaggcccugagacaggugagagcuuuguucaaggaacagaagggggccaguauggcuaggauggagugagcacggggaagauguuaggagcacguuaaguuugcauucccucuggguguccuuggauagguuacucagccacucugagugcugcccuggcagccagcucuaggcuucacugacuggaguuuggcuauccuuggauggaaauccaagcucuuuuuuacuuuacauuuuucauuuugauuauaaucaaauuaagaacagucauaaaaguauuuucugggucaucucgaugaaacuagcacuaagcaaagccauggauuucuuaacucugugcagguauguuccuauaauugucaugugcuaaaacgaaggcucaggaaauccaaaagauuuuugcaguauuugaauagaaaaaagagggguggagggaagugagugugggacagugaggugugggcagacccaagaacccuggugagcgggcaguacuauguuuauguuuugagugggauucccauuuuuacguaacagccuccuacauuuguuagaaguagucuuagcaguuguaugguauagcauuucccuuccugcccccagacucaguaauugguuuagaugccauuuaaugcaguuuuuaauuccucaaaacuagucuucugugaacaaaauaucuuuucagauuuaccagguaaaucuguaaaaucaguaugaagggauugcuccccagccagcauuugguuaaguugaauucugauuauccuuaaccugcaagcaaagcuuugaaguuccuaauaacuuuucuguucaauaguuuucaugcuuauguaaauagacacucuaacauuuagaaguuaaagcacccccccaaaaaccucaaauauauaacuuggccugagacucuauuuuucuacugcaaaauucaauauggacaauugaguuuuaguaaaacuacguaauuucgaauugaaauaauuuaaauugcuuuuguuuuaaaaaauuuguauuugugcauaauaaguuacauuucaauaaaaauaaaguaaaugcauucacuugacuuauuuuccgcgugggcauuuucuucuucauauaugguccauaauuacuuaagcuugagacucacugcuucgacuugcaaacagaacauuucaagugaucaaaaaucuaggacccagagggagugaaugcacaacuuuaggauucugaccuuagcugcaauagaaaccuugagugacuuuuaaggcuaugauguccugguaaagaaauauaccuaaaacauagauggauaugauaaaguaauggaauuuugcaucaugcagcuauucucugccagcauguccggcaacagacaucuuuggaagcauauuuuugaaaauagguauccucguucucuucauaucauuuuauuauugaucucugaaagacugauaaccuugguaaaacagccagcucaauguguagccaauaaccacgccuaggugucuggcuucccccucucuuauucccaccucccccuuuuccaucuccuucucuuccuccuucccucccucucucauagaccucccacacccccgccccacacaaaauauauauaucauuguaguuuauaauuuauaaagauuuaucaauugcuaauauaucaguuauuuauuuauuuauuuuuauuucuaagcaugccuccuuugaagggcauauguaugucugugugaguauauacaggaaauguauccaugucuggaaaggggccuccaucuagacgccaagugagaguucuuggaucuugugagagaaagaauucagggcgacuccauagaauaaagucaaagcaaguuuauuaggaaaguaaaggaauaaagaauggcuuuccaaaggcagggcagccccgaggacuguugauugccuauuuuuaugguuauuucuugauuauguguuaaacaaaggguggauuauucaugaguuuuccaggaaaugggugggcaauuccuggaacugaggauucuuccccuuuuuaggccauauaagauaacgucuuggcauugccauggcaucuguaaacugucauggcauugguggaagugucuuuuagcaugcuaaugcaauacaauuagcauauaauugagcagugaggaugacuagaggucaccuuuguugccaucuugguuuuggugggauuuggcuggcaucuuuaccgcaugcuguuuuaucagcaaggucuuugugacauguauccugcugaucuccuaucucgcccuaugacuaaacacaacuaaccuuccgggaaugcagccuccuaguaggucucugccuuauuuuacccagccccuacucaagauggagucacugugguucaaacaccucugacaaaucugucugccuguuggaaaggacuuugucaacuugucauguuacuuauauaaauauagaaauauguauuuaaaacuugauggacacuucaccaucacacucucuucuccucucccacaucacucuagcacugauccauuuuuagaaaagguuuuuuuggggauggggguugaccagauguggauauuuagagauaagucuauaaucuuccaacuguagaagucuuuaugucuuugagucuugcuuguguguguaaauguccuauuuuuuuuuuugauauaugaauaaaguaauuaauuugcauuuaguugcuuaagccugucuucauagccuggggagaaaugauggcugacacuugucauucuccacccuuccgcuccccacauuucauuugguacuucauuucuuccucuugaggugugaauaucucaagaaagauguugacuggucccacugguugggaugacaaugagugauagguagucuugcacuucuugaucaaugacaagaucacccauuuggcaaacucuuccucuucucuucugucuuuauuuuuuuuuuuuugagauggagucucucucuguugcccaggcugcagugcaaugugcgaucuuggcuugcugcaaccuccgccucccagguucaagcaagucugccucagccucccaaguagcugggauuacaggcaucugccaccaugcccagcuaauuuuuguguuuuuaguagagaugggguuucacuguguuggccaggguggucucaaacuccuuaccucaggugauacgccugccuuggccucccaaagugcugcgauuacaggugugaggcaccacgccuggcugcucuuacacuuuucuaugagacacauuacagauagaugcccauauugagauacauacccauauacggauagauauccaugcugagagaagcauguuaauccggcugugaaagcuuuauaguuaggaauuucugggaagaucuucaccuuuggcauacuccuucagucucauccccuaugucccuaauagaagcaguaauggggaaucugucaugaugacuuacuagaaaaaucuauugagccugcuuaugauucuuugguuuuggaggaggagggcacuaauuuucauugguucauucauucaaaaauauuaaguuccuacuccaugucuaauaacugccuuucuggcuagucugugagcauggcaacggacggaugaugucuuuuguuuucuguugugucucugaugucuuucacauugaagagcagggaggaagugcucguaucauauuugugccagagugaggaggaagagggaagcacucagagcugacacuuccugugauuuagccuucugccuguggaucaucuuuucaucuuuuuugagcucauguuaguuucucuacuaccugugcguuucuuuaccuuccuuggaguauuucuuccuugagcucaguguugcaggcacugcuuggucaggcuuagcccauagacagaaaauacuuauugaguacuuacuguauauauagcacucuuccaugcacuguacauguaugaacucacuugcucuuuccagcaacuuaggagaugugugucuucauuaucaccccaauugaagaaacuaaggaugagaaaggauucagacuuaaugcaaaugauccacuaucugggaagcuauuuaaucaaccugggcucaauuauuucuguuuucuauuuggccgugggcuuuuggguuguuuguuuuagugggcacagaacucaagguccuuggcuuuuucaugcccuuuuucaucggugucguaaguacuugcuccguaaggaaaugauuuuaauuuuacuuuucucuaaaaguaaaaaaauccuacucuguaguguagugguuucaucuuuuuuuuuuuuaauauugacugacaugucaagagaacccacaggcuuugcacauacacuuuuccagucauugcuucagauaucacauccaguggaaauuauuagaugugauaucugaaccaguugcaagcaagaucucucagccuccuucaauugcuauguuccagguaaauguuauugcugugauuaucaucaucguaauuauuuugcauucucuguuuaguauuuuuaucagaacagcauucuuuccuugaaagauaaaaacuauugaagauuuuaagaaaguuugaagcuuguuaaggaaacuaguaacuaaaaaguuuaagauucugugccuagugggacauaauuuguuguuuuauuaccuuuuguauuugcucgugcauauguacaugccugcauucaaccaaauauuuguuacaugccaggcacuguggacaggugccuacuuaagguaauaggcugggcagacagacucccacccuaguucaucacacucauucaaauagaauuucuagugguugaaagagcaauggccuugguuuuacccucuuugucaggaacuaacuguucauucucuggugagucacccaaauguccuggcucuucaccugcaaaaugaguccauuggccuagauguucucuaucaacuccaaaggucuaagauauguaugauaaaggguaugccauccagugaagaucaacaguaucauucacagcaggccuguucaauaaggaggaaguugccaucucaacuggaggcuguacuggacaaauaacauucacuauucugccuccaagguuucucauuuaaccaugggagcuaauaugaaaagaagguguuccuaagccagugagauuaagguuugcagguuuuagccugcaagcaggaccaacuaccaauuuacaggaucuagcacaaaauuaaaauguggaccuuuuguucaaaaauuguucaggauuucaagacacagcagagcauuaaacgaagcauggcacccuucugagaagacagggcucuagugucaccguaugggucacaggcaaacaaagucagcccuaccuguaaauggaucugauuaaaggcagaaguaucuuucuauuuuguaagcagauugagugguauguuacugucucacaauguguuauuauuuuugcuguuaugacuaagauuauuauuuuaagugacaguaccccugugcccaucuucucuuuugagagucugaaucccuucagauaaggacuacagcuuaccuaauuugugauuuuccccucagcuagacuacugacaugauguguuuguuaaaugcagugaauguaauagucauuuaucacaaggagaaauugugauuuuuuuuuuuucccccagaggaaucuagcuuaaagaagccaaaauaguacuuaauaagguguuugugggaacagagauggaccauuggaugaaaugcucugaaauaaaacuaggccuaugcaguguaaaaagacuaagacagugaguuucugccuuuuuucuuuuuuuuuccaaaaaaccuuuuugauguaacacaagucaguauuuuuguugcuaguuggcacuucaugaaagaugauagccggcuggggagagccaagaaaaaucagugaguggaauugacagacuugcaguguuuguaacucugccuuuauccugugugauauuuuaaauaaaugguuuucuuauguaggggacaguuauuacugugccuaucccacacagcagagaacccaaaagaggacgacacacugaaggagucauaaauugcacauguaaacagcuggacauuuggguguuggugaaaccucugagaugagacggaugaaauauguugagacauucaaggcuuuuguugcuaguuuuuuuguagaauuuuuagcagaccuuuaaaccaagagacacuggcagugcaguuauuuucaauaaccuggacucuccaggaaaauuuagaaauccauccaaauagaagguaaauaaacauguuuauaggcaaagccuuuuauauaagcguuuuuguugggucugaaucuuugaugcugacagaguugaacugucugccuucuugcuuuuccuuauccuguuugucauccgcuauguggcuucggcuucagugaccccucucuccuuccaguuuccuagaagcaaauugcccuuacgagcgaaugcauuugggucauuugaauuugcucagucauuuuggcaauuaaugacuuuuuguggauucaguucuugggcaccuccgcugcaucccacuucuagccaugacucccugcauuagugauucagccugaaagaaaaaauggcuuuuuuaaaaagugggagaaauuuaucugaagagcaaucaguuagauggacauggaagaggcccucucugggguuuuaccuggucugucuuaaaaggaacucacucgaguuuuaaucccuaggauuauaggcuguaaagcaauggucagcuuagauccauuucagggccaauacaucugucuaaaauauuuugaauacaagaggagaggaaggauagagaagcaaagaaguuuaugacucaaaugaucuagagaauaauaucaaaguuccccaugacacuugcauugggauuuuacuuugauuauagacuuuauguucuuuaugaagaucacaguucuucucagggcauacacaucaccaugcuagcggcuagcagaucuuaggccaagugcggucucuucuauggacuugauuuuagacuagaggcaaauugcuuaacccuuugggucuugguuuccuuaacuuuaaaauugagaagccaaaagagauaacaugcgaaacggcuauugcaggauaugagggaugaaaacaauuucuuguuuuuuuguuuguucauuuguuuuugagacaaggucucucucuguugcccagacuggagugcaguggcacaaucuugguucaccgcagccucaaccuccugggcucaagugauccucccaccucagccuccagaguagcugggacuacaggugugugccaccacacauggcuaauuuucuuuuuuuuuuucuuucuuucuuuuuuuuuuuuuuuuuuguagagacaggguaucccuguguuacuuaggcuagucuugaauuccugggcucaagugaucccccuaccuuugcuucccaaggugcuaggauuacaggugugagccaccacaccuggccaauuucuuguuuuuaugucaaaacuacuucagaucuguucucauaaaccuggggucauauggcuuccauaacugcaaaaggcuuagaagugcugugaggugauagcacucuuucucuguaggcuuuuugagagcaagauacuuuucuccauguacuucugcuuuaucuuugaaauaugcugccaaauuuccuccuguaauaaccguaaagguuuguuuuuuuuuuuugaggugguugcauugauucacucauucuucaacaauuaugugugugccagagaccauacuaaaugcugugaaaagagagaugaauaagagagacacagcuccuguugucacagaucuuagagccuuuuccugucauaugaggaaagccauagaauauaauccaggugagggacagugacaccauauuuaugaaagcacuucaaaugcauucccauuuccagccuaaagauacccacuuuagaaucugcgggauugggauugggauagcauuaucgugguuucuuuuuaccuaaaaaauuacaguucuauguuuuggaauuuuuuuucuccauggaaacaugucacuaaauuuauaauaaaagucauuuuagaaccaaacuuaacagaacacauaccugugaauuuuagguuguuagagaaauagguugcaggguuuggggcauucuacagggagcccauuacauaucaaaauuguaucauucauguauacauuucaagaggcauuugccuauauacacuacuaauaacucaucuagaauauaagauuccuuuugaacuggcagacuccaauauggggaauaaagugaugcucguuugccuaaucuuuauaaaacuugguuagguuuuaugccuuuccaaacuauacuggaccagaugucuccuuccucuugcuuuucugcccuccaggucugcuguaguguagaaagcacuguuccucugaauuuccuauuuaccuguuuuggccuguagugauaauuauuuuucucugaagucgcacgaugauguaaccaaggagaacaaugugaggucaguaguauccacaugacacaguaauuacaggcaacugcugauugcuuuuguacucagaagguuuggaaagauguagcauaaagguguaaacagaucauuuucuuuuagguuuuguuagcagugcaauccaaagggauucccauucauuuagcauuguucccguuggcuuuuauagcagccaaaaauaaaaccccuugaguacuacucuggaggguagcugaugacauauaaaguaaaucucuuaauuguaugugaacucuagaccagauugaucaauuccuuguauauucuaauaguccuggcccagcaccauacauauggugggcagucaguaaauauuucccuaguacaguggggacagagaagggaauuuucccaaaucaggcaguuuuagaguuggccauaugaaucacccaguuauuuucuuaaaaugcagauugugauucaguauaucuaaggaaauucuccaguucuagcaugcucccacgugauacgaauuccucuaauccaagagucuacuagccagacagagcuaaggccagaacacaccuauuuuaacucuuagucugggaguuauucucaguauaucaacgauggugaauacaugucucuguguuuuccuucucacucuuacuagacccauaacacuaauugauuggugaacucauucccacugagccaagaugcagcuuuggaauuguucucaauguggugcuccaugcagcaagugcugauucagagaguguuauuccagucacgcuuuggggaugaguggaaaguugggucaucuuuauacuccguguugcuucuuuuuuuuuuuuuuugagacagagucucgcccugucaccccagcuggagugcaguggcacgaucucggcuuacugccagcuccaccucccggguucacaccauucuccugccucagccucccgaguagcugggacuacaggcaaccgccaccaugccuggcuaauuuuuuguauuuuuuuuuuuuuuaguagagaugggguuucaccguguuagccaggauggucucgaucuccugaccucgugaucugcccgccuuggccucccaaauugcugggauuacaggugugagccaccgugcccagccgcuucuuuaagucaaguaaacaugcugagaauucaaagcccuuuucuuccuccagucuccucgagccacccacaucccccugcucacuguccuuuuuccuuccuucuuuuuguguuuuugaaacagagucucuguugcccaggcuggagugcagugguacaaucucagcucacugcaaccuccaccucccagguucaagugauucccugccucagccagcuaccuggggauuacagggacccaccaccacgcccagcuaauuuuuguauuuuuaguaaagacgggguuucaccauguuggcgaggcuggucucgaacuccugaccucaagugauccacccaccucggccucccaaagugcugggauuacaggcacaagccaccgugccuggcaguuuuaaauuuugggcuaaaugacuuuugcuaaaucacuuuccucuugcauccuccugcuucuuauaucuauaaaaugaacugcccauggacaauugcucaggauccaggcaguacuagcauuagaaaggguugccucuuuagcccaugauuaguccagugugggcucuuugcagaaagcaauggaaacugguuaacucaaccagaaaaagaaguuauuaaggaauauuggacgguacgcaguauagacauaaugguuaggacugggcuggagcugcugccugagcccuguccagacagccgagauacacuggauguugggcagugcuuuggcuggacauugaaaugcugcaucugauuggcuaauuuaguuuccauuuauaucccuaacaaggcaagggaagagagaagccagcuucucucuuguucuccuucuauaaugagagacaaaccaugccucucucagacacucacaauggagaauuccucaauccuaagaaagguggaucgguuacugacugugacagaugacugucauaacuuucauguucacggaaacuucuuuauaaaguuucuaaaugaaacgaaaacuuggcuaccaaccuacucuaguaacgcaacaacuugccccucuguucuuuugaguucuggcuucugauuguuucucaccacauugucaacuccuugggaaaguacucuguauguuuuaaagcaaauugccaggguuuuuguuuguuuguuuguuuguuuacuuagaccucgggagauaaaauuaaucgaccucuuuaaauacauggagguacccccuuucucguuuuugaagggagacacuugggaauuuagaaauugggagugugaguucuaagggcuggugugguuuagauagcccaugacaguuucaggaagguccugguuuccuuucaagcaaaaggggccaccucugaaccaaaguggauuaucuccugcagcagcaaauccaguuggcaguugaauuccugcaguuuuaugggaauuucagugaaacuuuuaaagcuguaauuuuuguaacuggaguuaaaaaaaaaaaaagaaaacaaaucugaauaaagcgacauaauccauugcagagucuguacaguucuauuucuucuaucaugaauguuuuccaggcagaugaaaaaauguuuugaauguugaauauaugcaaacauuacaaucaaggauaauugugucuaugugcuuugacucucauuuugcuuuucucuuccuucaucuucuccuauacccuauaggaaugugaucauagacauagaaauagaauuugcauuuguauaaauaaugcccaagcuguuuggaaaaaagacucccuguauuaggcacaagauuuagagauggcauuuucugccucaaaucucaguuugauuuagaucauggaaauaaugccuuuuaucuguauggacaucagaguuuacucagccccuuucccucugcccccuucauuugaucugcacucucuaaccucaugaaguugucugaacuaguguuauuauucucauuuugccaaugagugaaugagacucagaagaaagcaucuagguuagagauuucuaggcaauguuucuaauguuuccuucaguaaaauuguuguugcucuaucaaguauaugagcugguugcuguuuucugucuuugaugagugacaggauucccuuuuaugugucucacugggucugucuccuagaggccucaugagacuuaaugaguaguaucuguaaggugcuugaggauccccagauaaaaggagcaccuguuagcauuuaugauggaaguagcggggccucuugaaaagcugugcccuuguuguuaauaaugcuggcuagaggaguugcaggcgaggcuuugcccaaagccuuuauuagucauuacucucaggaaaugcagccucaccaggauguuacuuuguaagcuguaaugcauuuuugaaacagagaaaggaauauaaaaaccacccuuucgaugcaaaacauuaaaggaugaccugugaugguguauuuuacaaauuugaagauacaaacuuguuccaaauguacauccuguauguuuagggagggacgaggggagucuuguaaauccaugcuggugguggaguccugcuugaugauguguuggaggagcaaacugguggcacccaaggcucuguucugaagcagccacuccuguuaucccagcacgauuguggcuaaguuaucuucacagggguggucaacuuccacccagcacaauuguggcuaaguuaucuucacagggauggucagcuuccuccucccuaaaguaaucccgaagaugauaaugcugacccacuucuccaggaauuuggaaagaguaacuaaugagcgacuguaaggcguauuggucguguaaaggcaugcuguaaacacugauugcaauaacuaguaagaaagcagcagucccucuuccuucccaggagaguuugcaugaugauuauuuucugugguguuugcuuuguuaaaugaaaauguugcccgugcuuaggagauaaugcagggaaagaacacaggagggauuuaggaauguuuuacuuauugguaagugauuuuacuguugaagucacacuacagauacuguuaaaaaauuuaaaaauugggccaggugcgguggcucaugcccguaaucccagcacuuggaggccgaggcggguggaucaccugaguucaggaguucgagaccagccuggccaauauggugaaaccccgucucuacuaaaaauacaaaaaucagcugguguggugccauauaccuguaaucccagcuacucgggaggcugaggcaagagaaucgccugaaccugggagguggagguugcagugagccgagaucgcgucacugcauuccagccugggugacagauugagacucugucucaaaaaaauaaaauaaaauaaaaauugaauuuucccauuucuguugccucucucuuuguucucucuuuaaccucaaaccccuguuccuucucaucagcuccaccauaucaacuaucaacaugauguggcgugcucuugcuuccaguuaaacccgagaaaaagaaaucaggauuuaaaauucuucuuaacacauaguaaauacauaaaaucuacauucacuguuuguaauguauuaucugaccuucuaaauaaaauauaguugauucauuucauauaauuuggaauuuaaaccaggaauauuuauuuaaugguuagcucuuggucaggugugguagcucauggcuuuaauugcagcacuuugggaggcugaaguggaaggaucacuugaacccaggaguuaagaccagcuuggacaacauggcaagaucccaucucuacagaaauuuuaaaaauuagccaaauauaguagcacgugccugugguccuagcuacuugggagggugaggcgggaugauugcuugagcccaggaguuugaagcugcaguuagccguguuugcaccacugcacuccauccucagcaacugagcaaaaccuugucucaaaaaaaaaaaaaaaaguuuuaacucagauguuggccaagcgugguggcucauggcuguaauuccugcauuuugggaggucaaggugggaggacugcuugagccugggaguuugagaccagccugggcaacacagggagaccccaucucuaccaaaaacaacaacaaaaauagccugguguggugguguaaugccuguagugccagcuguucuggaggcugaggugggaggaucacuugagcccaggaguucgaggcuacagugggaugugaucacaccaccacuccagccugggugacaaaaugacaccuugucuccaaaaaaaaaaacaccucagaugucuucuuaauuaauuuucacuuuaaugagcaugaaaguuaagaagaguucuccuauuuugcuauuuuucuguaaaguugaauucuuuuuuucuccaaggaugugugaggcuaaaacaaaggucuccacaggagagguaagcuguauugaauucugcuaacaguagauuuuuggagagguaagcuguauugaauucugcuaacaguagauuuuuuuuuugccucaggaauauuagaggguucacuuaggggaacugauccauggauauuucucauauucuccuccaacagugugacuaacacaucaugucaguggauauucucauauguaauaagacaucugcaaaauagugccuuaaaacaacuuuuauaguuccucgagauccagugccuugacuggguugguuguuuuuccauuccauguggcaucugcuggggucacuccuguggcugcauucggcugguagcucagugggacgcucaguucgccuccaugcagccucucacgcccgcucuggacuuccuuacaguguggcagcugggucccaagaggcagauuccuaaagagcaaaagcagaaguuucaggccacuuaugggccacacuuaaaacagacacagugucaccucugcagcauucugcuggucagagcaaaacacaaagccagccuagauucaagaggaggggaaauagacuuacuucuggaaggaagaagcagcaaaugcaaucagggaagggaggaauugaugaggccaucuugggagacuagcacauucaugauaucugugcagcaugguuguuacugucuacauugagccuuauuuccaacuaaaggugaucuguggagcuccuuuggggcagaaucuauaauauuccuaaugauacucacaggaccuggcacuguguugggugcagcgcagaagcucacuauuguugagugaaagaacaugcagugaaauucuagaaaguugaauguaauagaaauccuaugaaguaacauugcugggaaauaggaaauaccaacuucacauucaguguagugacgucucuuuuguuacagcaucucgugcuguuuaaagcugcauuacgggaggcuuugaagcucagcaaggaagucauuuggcagauagcugugcuaaauggaggcuuaucccuggaaaaggcacaggacuccccacauuaguguucauuaugucaggauccuugcugucaggugccuaacagugugcugaccaaguuuugguugucuguguauuucuggaacguaacacauaccacccaaggcacauguuaggcauucagugaaugccagguuagugagugguggucagcagugccugaaugagugacaagcagaaaaggaauauagguccuguggacuaacagcgccacccaccagcuaccucugggauggaaccugugguugcuuguccaggcacaccuucaucugcuguucugucuucucuacaguggagaccauucuacugacagacagaaaaggcagugguaccauacgcacaucagaaagugugagugugcugaucauacuagguccagccagaacuuugcaucuuugaggugaaaccauucgcuuagcuaaaugaauauugcaccucaaaaaugcuggugagaauuuuacgaaagcauauuaucaaugaaaauauuaaaggagcagacguguuaggauguguuaggaugaagguuuuuuauuuuuauuuuuugagauggcgucucacucugucguccaggcuggagugcaguggcacaaucucagcucacugcaaccuccaccuccuggguucaagugauucucuugccucagccucccaaguagcugggauuacaggcacgcaccacuacgccuggcuauuuuugguagagacgggauuaagccauguccgccaagcuagucucuaacuucugaccucaaaugauccgcccgccucggccucccagagugccaagauuacaggugugagccacagcgcccagccaggaugaagguuuuuuaaaaagucuguaguuguaagaagcuauuuaugaaaagaucuuuacauugugguagcuuaugaaaauccuuuuucucaucuccuuuaauuuucuuucuaucaguauuauuacugauauuacaauuuugguaagaucuagagagaaaaauugauugugauaggcugucuucaauuaccuauauguuucuucuuaucuauuaccuucugaaguagcuuuuucuuaaacgguauuguuaaacuuuauuuuuuauuuuauuauuauuacuuuuugagacagagucucacucuaucccccaggcuggagugcaguggugcuaucuuggcuuaaggcaaccucugccuucuggauucaagugauucucgugccucagucucccgaguagcugggauuacaggccaccacacccagcuaauuuuucuauuuuuaguagagacgggguuucaccauguuggccagacuagucucaaacuccucaccucaagugauccuccugccuuggugucccaaagugcugggauuacaggugugagucacugcacccauccuuaaacaguauuguuaaacuuuaaacugaaaucugaacucucuguuaaacugccuuuuccaacuuuaauucccagucauuuuuuaaugccuucuauuauucuuucucauuacguauauguugcuauucucaaacucaguugcagaacaaguacaggccuauauccugagaacuauaaaucucuugaagaaagaggaggucuugcuggguuuucuggauaauggaugugacugugugggugcgcacaccugugugugucugcgcuggugcucugggcccuggagacugguaucagaauuacucugaccuaaaaaugcacucuagauuuuaacacaccucugguagaagagaggaggaaacauuugcagcauggaauuaucggucccauuaccacccaggugucaaggaaaugaaacuuuucuauuacaagauugcaguaaaucacacaagaggaugacagcuucauuaacauggguaaaguuacuguaauuuauguauaaauaacuuuucugugucaagauauaguaucauucagucccaacagaauagcauuuuuucuauaaaagaagugaaaugccaaaaaaagcaguuucuaucaaagaaauccacaaaagacaacgguuuccugugauaaaacugacuuugacagagcccacagcaccucugcuuuauaguuuuaaguuuuuacauucagccaaaacagaauauuucagacuuuaucacaaagagugacuuuuguuuuguuuuguuuuguuuuguuuuguuuuguuuuguuugagacagagucucgcucugucacccacgcuggaaugcaguggcaugaucuuggcucacuguaaccuccgccucuuggguuuaagagagucucgugccucagccuccugaguagcugggaccacaggcaugcgccaccaugcccggcuaacuuucuguauuuuuagcagagacaggguuuugccauguugguuaggcuggucucgaacuccucaccucaggugaucugucugccuuggucucccaaagugcugggauuacaggcauaagccaccgugccugaccucaaauagugauuugauauauuguuuguuauuugguuguugaaauaaauauuuugauuuuuuuauaagaaugaaaaauuugaaauaacuuaaauuucuaucaguaggagauugauuaaaagcauugugguacauccauuugguagaauauuaggcaggauuuuagaagaaugagggagaucuaaaugaaugccuauucagguauauauauauauauauaugguuauaucuauuaagcaaaaaacaaaaauuugaacauucuaugcagaauuauuccacucaaacaauaucagcagaagaagacugaucaacuuguaauaauuagucagcauaauaaaaccauauugaaauaguuucuuaguggaauaucaggggaacccgcccccaauauuucaauguagauucuuucuaucuuccaaaaguguuggccggcugagaaauaaagagaaagaguacaaagagaggaauuuuacagcugggcugcugggggugacaucacauauugguaggaccgugaugcccaccugagccucaaaccagcaaguuuuucauuaaggguuucaaaaggggagaggguguaagaacagggaguagguacaaagaucacaugcuucaaagggcaaaaagcagaacuacuaauaaggaucuaauaaagaucacaugcuucugagggaacaggacaaagggcaaaagcagaacuacugagcacaaggcaaaggguaaaagcagaacuacugauaagggucuauguucagcggugcacguauugucuugauaaacaucuuaaacaacagaaaacaggguucgagaguagagaaccggucugaccacaaauuuaucagggcagaguuuuuccccacccuaguaagucugaggguacugccagagaccagggcauaucucaguucuuaucucaaccgcauaagauagacauucccagagcggccguuuauagaccucccccuaggaaugcauuccuuucccagggcauuaauauuaauauuccuugcuaggaagagaauucagugauaucuuuccuacucgcacguccauuuauaggcucucugcaaagagaaaaauauggcucuuuuugcccaaccccgcaggcagucagaccuuaugguugucuucccuuguucccuaaaaaucacuguuauucuguucuuuuucaagguguacuaauuucauauuguucaaacacacguuuuacaaucaauuuauaccguuaacacaauuaucacagugguccugacguacauccucagcuuacgaagauaacaggauuaagagauuaaaguaagacaaguguaagaaauuauaaaaguauuauuugggaacugauaaauguccauauuaaaaugaaaucuucacaauuuauguuccucugccgaggcuccagccggucccucuguucgggguccuugacuucccgcaacaguggaagauaccuguaugggccauaaacuucuaggagacaccauauaaauuauaguucaaaauaaagaaaucauaccccgccacccuacccuuagaaguuaaguaggauaugcugacucuucuggguccucagauuggaaguccagucccagcuuuaauguugacacagcuuugguauagaagaacuuuagagcuaaagccugcccaccaaaguucaaguccugaggugggcaaauugccuaaucuuucccauauucagcuuuauuuaaccucugagucuuaaauuccucacuggaaugaguuguucauucuuccaauguuguuauuaaaagcaagugagauaauguuuguggaauuauuuugugaauuguaauguguucuacccuuauuacuuauuauagagucauugaugaaguaaauccaaggaauuauccuuaccacuuccuacuucccucccagaguaagaagcugagaguagcaggccaccagauccucucuuugcugaggaugacauuuauggcaugaaucauggagauggaaaccagcucaggaccaaacuggguuagcgucuccuuggcauucucuggaaaagaggcuguacugguuaaagagagucucugcuuuugauuuuauacuuaacuaaugacaauaggaaagaagauucuccacaugguuuaaaaaagggagauuuugcccaggucuuuggaacaguugaagugucugaaaaacagaaggagauacccugaacugccacuauauacuggggccccuagacuggagaugagcugaagaaguaguuacugaggcauuuucugugguuugauguuaauuucuagcgaaggggacagggaagcuaggggaaccagaacccuggcaugcauuguguucucuuggacugucugacaccuuuuaaaaaaaauggagucucuuucugucacccaggcuuggggguaguggugcagucuuugcucacugcaaccuccaccucccggguucaagcgauucuccugccucagccuuccaaguagcugaaauuacagguacacgcgaccacccagcuaauuuuuguauuuuuauuagagacaggguuuuaacauguuguccaggcuggucucgaacuccugaccuucagugauccaccugucucagccucccaaagugcugggauuauaggcaugagccacugugcgcggccacauuuuaagaaaugcucaguugucccauuguuagcucuaucacauaaauuuauccuugucuuauuuaguucuuaugcaccaauuaccuggaaccuagcucaugguuuccagcauagccucccuacuguuaugagaaauaauucauaaauugugggaagaaauuuuucuucagauugcucuugacuuugggacauuauauguauaugcuuucugguggucauguuguaaaauuguagaugauucacuauuaggggaucaggauccacucuagccagaauaaacucaucacacuuugucgcuccuccuuggccucugccacccagugcucugagacuguugaugugauccaggaagcugaaugaacacuggcccccaaguuaggaagccugcaucccagacucagcuugaucucuuguaagcccaugguuuucucuccaacaaagaagaccacugaaauuaauuauuuucaagaucucuucuaguucugaagggagauaauuaguuuuuaaauacuaaauugguaccuacccauuguaauaaauaaauaaaggaauaagaaaagggauaaaguaaaaagugaaaguucuccuaccugccccuuagguccuaaaauagaaaauuguaaaggguaaaucucagggcuugaaaauuguugaggcaaucucuaaugauggcaagaucuagcucuguuaggacuucuaagcaguauucuuuaguauacucugcuauaggacagaaccauuugcaaggaaaggauguuaauuugggucucucucucccucuugcaauauggugccauuuuugaucucagagccaucgugccucauuucuaacaccuugucuucaauagucuuuuuuucuucuucuucuucaggugccuaaaaauuagcucucuuauccucucucucucuucuacucuucuuccuuuuccucuuuuucuucuuuucucccucuuuuugugcauuucugcagggauauccuaaaaauaacuaaacauagcucccgugagaaagaagauucauauugcagauugugucaguguuuuuuaaaaauaaaauaauucuguugguguaaucaacaaauauuuacugagugcuugcucugcagaaggcaucaagcuaaguacuagaauaaagugucaugaugugauauugaaacaauauuugcagcaggccagcucaguucaaagugaaagaugagggagaauucuggguauccucgaaccuggcacuuuuugcugagcucagaagacccagguguugaagagacugcuuuuuacaagcucgcagaauaaguguuugagaaaugugaaauuuagguccaccguuggccuucuuucugaggccagucucaaaggguuccccauuugcccuuagcucuugacuugccuucucuuggugagcagggcagcucucugagcuugagugggcugugauguugguugcugacuuuugucccuuuuguaggcuucauugaugggauuuagacucaguugcucauuggauagggaaucggaacuggccauucagaaugagggaguuucaucucuuggguuauugcgguuggaguaaucacuuaucagagccucugcuuuuuugugaugguuagaguaacaugcuuccugccacccuacagcauaccaggagacaggaggccuuuucuugugccaagguuuauuuggagcuuaucuguauuuaugaucuuuuccugccauuggcuuaauuacacaacuggggaaauuuaauuaucaaagaacuuaauaacacuaaagaacuugccgugugccaggcacugggcuaaacacccacuggcaccugaggcaagugcuguuaguccauuuacagcugaggaugcugaagguuggagagcacguguuauugucagggucacuuugccagugagucuugcagucagaaaucagccuuggacagcucgacucuagaguucacgcccuucaccuugauccuucuggcaucauccaucucugcagccugacaucuaacagauuuaggccucauuggccugucugugguuacauugcauguaccaguggcacccagcagcaaagcuauuucugagacacauacagagcauuaguugacuauauuguuucuccaguucaggaucaugcggauccugccaugauuauguggaaagaguuugcaaaguagagucaaagcauuugguccuguugcuaggcuuuucuaagcuuccgucaacucauaugugaaaugaggacaaugacacuuggugcuuaaauuguauaacauaugaagcagagacaggcucacauauaauugauucucuguucauuuaauuuccuuucccuuuucccaguugacucuucuuccucccuccuccuauuucaugauuuucucucuggcugucgcaguaauucaguguaucuguucccaggcuguaguuccaaguagcaagaauaaagcaaaacuagauguguuuucggcagucucaagcucucacaggaaguuuuuguugugucuguaagcugugguuggaucccacaccggguggaccaucuuuccuggagugguggagaggaaggagugccuagccaggagacagauaugucaguaucuguaaggugaccuacuaguggaaaacacucuugcucuuauuugccuuccuccuggcagcccgguuucuucaucaucagcagcccccuuugaccuccuaugcccuuacucgugugguuuaacuggagcuugugaaaaugaugacuagucuauugugcaucuggcugaggcauuuaauccacuguggagacacccuuauuagaggaaauggaaugcaaguuaugcuuaucauggggauaguguauuagggcccauccuggacagcuuguaaaagaauuaaugcuggugcgguggcuuaugccuguaaucccaacgcuuugggaggccggcacggguggaccacuugaagucaggaguucaaggccaguuuggccaacacggugaaaccccgucucuacuaaaaauacaaaaauuagcugggcauggcagugcacaacaguaaucccagcuacuugggaggcugaggcaggagaaucgcuugaaccugggaggcggagguugcagugagcugagauugcaccauuguacucccaucugggugacagagcgagacuccaucuaaaaaauaaaaauaaaaaaaaauuaauuuacaaccuuuucugcagcaggauuuccaggaaaugaacugggaaaugguggcaaugaaugaugacaauaaaugauggcaaaugcauguaccauccaacuaugauuuuguuucuuuucaaacuauuaauagcaccagcuuucagauccaugucgggcccuccuucucaaggaacccuugcucagcuuaaaucugcuuguauuguaaacuugaaauaaauauaaaaaacaugggaacaaaaaaauacauauuuuuugaauuuauucauuauucacacaguucacuaaaucaaacuagcauaaucucugcugguccacaaacaggaucacauacauuuacaguuuuuaaaagauguugguucuccuuuuauuacauacuauuugaucucuuuaaacuccaguguucucaucuacaauauggccuaauaugaugauaaagauaacaugcuagaagugaauuuucuuucuuguaaaugaaaaacauaguuuuaaauuuccaauugcaacugaagggccugauuuggcauuucucaaugucuuacucuuaguuuagaauagguugcaauuauuguucuuuuuuagccaugacaccaaguuauucaucuauagcagcuuuucucuuuuuuuuuugagacagagucucgcucugucgaccaggcuggaguccaacggcccgaucucgguucacuucaaccucugccuccuggguucaagcaauucuccugccucagccuuccgaguagcugggauuacaggcgcguacaaccacgcccagcuaauuuuuguauuuuuaguagagaugagguuucgagguuucaccauguugcccaggcugguuuugaacuccugggcucaagcgaucugcccuccucagccucccaaaacggucggauuauaggcgugaaccaccgcacccagccgccuggaauuuuuaagccucaaguuuguuccacuuugaaugcaagaagccaccugcuccucuuucugucaucaauuuaauuguuuauaaauuggggcuaauaacgauuuccuuaggccacuauauucuuuacccagcuaguuccaaguuguuuuguguguguguguuuuguuuuuguuuuuuguugguuuuuuuuguuuuuguuuuuguuuugagauggugucucgcucuguugcccgggcuggagugcagugacacgaucuuggcucacugcaaccucugccucccgaguucaagugauucuccugccucagccuccugaguagcugggacuacaggcauacaccaccaugccuagcuaauuuuuguauuuuuaguagaggugggguuucaccauguugcccaggcuggucuugaacuccugaccucaggugaucuuccugccucagccucccaaagugcugugauuacaggcaugagacaccaugaccagcaguucuaaguuuuuaucauugucugacccuauuguaaaaugaguuuuuaagagacugauuuguaagagauacagaauaguuuuaaguuucauuuauucuuuguaaaugcaguuuugggaaauaauucuuuugagggaacauauaucaucccccuuaauccuguauuacugauagcauuuguuugcuuaaagaguuuuuuuccagcacacaguauuuaugcucauuuuuggauaccaaaugaauguuaccuaaauuagugaaacuuuaauguuuggcuaaaaugagccagaaagcuguuucuuuaaacuuuagauccuauuuaagaaauagaaauguauccgauguuuacgauugcccuuuaauuuuacaagugaugaagagguagguauuuggcuuuuucaaaaauauugcagagccaaugccaucuuacuguucaaguguaaaaacccacauguggcagguguauuuuauaggcuuauaaauaccugaacuugcucacaggcugauuacuagacuuuauagaucgcuucaaaaagugagaguuuccuaauaguggauaaauacuuacccauuaauuuuuuuuuuaaaugugaauuuaaucaggaagaccuagaauagauucuuaccaaguucaaugugguaugagaguaaaucucacagcauaauuuaugaauucauauauaauauggcagaacugauagcuauaauaaacagcaaagugagagcauauuccuaauucagaguaucucauuuuccauuauuaacaauuaauggaacuuuccauuuuuaagugucacuacugaaaguguuagcgugcucaacaguaagcaggugaauucagaauguuauuuuaaggcaauaggguucccacugacagcaaaagucaaaggauggacaggaagcacacuuccuauuaguaaggggaaccaucaugaugaaacagauagaggcuuugucgauuguucucuccaacccuuugugcaaggcucugaugcuagguaccuagagcaaauguuucacaguguuugaaagcucagaaaaguaagggugaggguggagagaaguauguuguuagggaaaauugcuaaacucuuagauggacugauugcauucguuauuaaaagacuaacaauucauuuucaccuuuuuauguuuggagaauaaucaggauauuaguagacuuugcagaggcagcuuuguuguuugaucugagaauuguuugggggauggagaaaaggaagaagggauaccuugaggaaagcuacauccuuuauagagaagucagggcuguauguaagugaaugugcauggucagccaugguuugggccaucuuaauuucguggggugagggagauaugcuacagcaaacuguuccuuuuuucuuguuugcuuucucugcuuggaauucugauucuccaaauguugaguaauagccauuccaaauuagucaagcaauauuggaugggguuugugggguggaguaagaccuguaugacaagaccucugccuucugcucugagaucugacaccugcucaugccaccaucauucuccuuaaaauagguguaaaccauacaccauucuuucccaaggagacaacugcuuucccuguaagacauuuuuaauucgugaauuuuucaaguguucaugauguacaucaucuuucgguuuugaguauacuaguuguguguuagaaguuuaagauacaggguaugaauucugugcuuuaaggaauuucguaggaaacauugcauguguuaagacagauuugggauacauuuucugaggucauaagguguuggagagcugucauacuggaggauauuuauuccugggaaugacuaauagauuucaacugauggcaacuuagauugauugguaguggcuuccuggacugcuguguuagaagaauucuaaggguuccuaaauugaaugggaaauaaaucuauuacuuuagucugucacaggcaucagucuuauuaucauuauugcuauuccugguuuguauauucuccuuacaugaaacuaguuggguagagacuuaacauaagcuaguauuuagauggguuccgaacuuguguuccaagaauuaaaucaaucaaaauuaaauuugagcauuugccuugugagagaugcugugaaaguaacacauguucaaaguuaaaguguuaagugaaauaagaccuugaauggugaggaauggucaaacaacugcuguaagaaauacgagggauagaauaccaagccaagagucaugcaaaucagggauacuaaagaaugaggaagcagaguugguuuuauguaagcaaaagcaaauagcaggaaguguagccuuuuuaaagaaaucucaguaccacagccuguugggagagauuauuugugauugggagaaaugggagccaucagcaagcggaggggcuuggaagugauggauuuuuuucauggucuuuuucuucugacuccguucgagauuauaggucccuagaagguaaaaaucuggucuuucauuccacaaaguguuuuuuguuuuguuuuuuugagacggagucucgcucuucucccagguuggacugcaguggcgcgaucucggcucacugcaagcuccgccucccggguucacgccauuguccugccucagccucccgaguagcugggacugcaggcgcccgccaccacgcccggcuaauuuuuuguguuuuuaguacagacgggcuuucaccguguuagccaggaugaucucgaucuccugaccucgugauccacccgccucggccucccaaagugcugggauuacaggcgugagccaccacgccuggccuguuuugguuuuuuugagacagucucgcucugucaccaggcuggagugcagugguacgauuucaggucacugcaaccuccgccucccccuucuacaaaguuuuaucaagcugccccccaugugccaggcaccauauuaaaacaacaggacuugguguggacucugaccuugaugauuuuucagagcagaguaggaauggggaagggaauaauacuuguugguaccuacgugccucuugaaggaaguuacucuuuacuccauuauacagaagagaaaaaccaaggcucaggaaugucagcuugcccacggucagccaacagagcuagauuugaaucuaggucucucccacuuggaauucuggcuucuuuucaccagaguuccuauaaguacacuuugaucaagugguauauuuauaggucuuuuugauuuaauuuuuuucuuugcucagagcuagaaauggaauguucuuuuaguucuuuuuugaaagacacauuuaaagucagcuuuuuuaauugaggcauaauauauauccaaaaaaaguucacacaucuuaaauguccagcuugaccaguuuucacaaagugagcacacccuuuguuaccacuuccuagaguaaauccuucacuuucuuaaagugaguagaaacuaaccacaggguaauuuuuuuuuucuucacacuuuuuuuuuuccaauuucucuguccuucuuucucucucucuccuacuucccucuccccaaccuucuccccaccaccccacuuuuuccagcuaaagcauucucuuggacuucuugauaauauaauuuagucccaagaauuuucaugaagccaccugguguuggggggcagguaguacccugagguguaccccucuucugggaaucacuugaguuauaagaggguaaauguaagagugacaugaaucaugagugucaauuuaauucuauauuaagucacauccuagcauuuaucauauauaacuacaaaguaccggcuccuaugauauuuuaaagaacauacccauuucaaucuucacaaauauucucauuuuacacauaaagcaauagguauguuuaugccuuaaagugacuuaccuaaaguaauauacaaucuaguaaaugguagacuuccuuauacucauccauuuuuccuuaaaauacaccauagcugccugcguuuaccuucauucuuuguuaaacauaaguuugcaugcuuaaaaauaaaacuaaacuaagaaggacauaggcacaucagguuuguuauaggaacugcuuuuuauuucccuuucuuuuuuagaaaaagaaauuggauuccagauaauuguaguccuggaaauaggacaaaguuucauauuugagaaguuauucucacguuuccaguuauccuuaagagcuggucuuugcagccauguuuaguaucacuguuagcuugaagcuguugcaacugauuuucuuagcagaaccagaaguuccugaagauaagacacauucuuuauguucuaguuaauuaaagaacaaauuuuaagaacuucaggucaguuacugucucuugaguaacgcguguuccuaagaaauacuuuacaaauucucugagaauuggcacaaaugaaguucaagagaagugcaucuaagaauuugacuguucccagcuucugccauuagaacauccuuuauaguucggauuuuuuggcugaaggccugauucauuauuuuuaguuauuucucauguuuuuucaaacccaguaacacuaacauguugguauugagccuguccguacauuccugauuagaggcgccauuuaauuugauauuuugauaaagacugucuguggcaaguuguuguaggacuaauuucucugggcaagcaagacugaagaaaaaggaggaaaaugggaguuuaaucauuggagacugaaaauaauuuuuaauacugucugacuccuuucuggaaugccauauuaauucauguuuaguugaauccaugauaaaucuuuaaauguacguguguuuuauuuuaagaguugauucuaacucaggggugaucugccacuuugggaaacuuauacaauguucuaauacauuaacaauaaacauagaguuuuuaaguggaaaaugagaguauuuucuuuucucccuucauuuaccuggguguuuuggcucaccaaagaguuguguucugcaaaugucugggcaauccauggagcuaaacuggcauuagagucaaguaacacuccuccucucucccuguucuuuuccuuaaaaucuucaaaggcauuggggguuuuaccuuagcaacuugcuauuucgucuucuuaguuugaaccuucaaauauagcuggauauaauaaaaugcuccucaaaugaggaaguaccagaaagaccagaugcauggucucaugcuucccuugugcugggcacagaucuaaacaaaaacaauguuguguccauauuaagagcuucauaaauacagauggagugaaugaaugauuuaugacaguguagguuguggagcuugguaguaacacgcagaauucucagaaucaugccuguccguggaauaaaaagaaaacaacuuuucuuuguaagguuagagauuugaugggaaaaucaagaacaucuaaggagcuaaagaaagaaauuccuuauacccagauuguuggauguauuugcaacauuccucucauugucugacaacgauaaggauucuauuugaagauaauguguguuaaaucaagaaucugaguuuuuccuuggcaggcauagaggagaaagugaaaaaaaugaauggaagaagaugccuaauauguuaguuuuucacccuuggauccucuuuccucuuugcacaggguuacuggagguuguagcaggucauuauauuguuuuccuaauauguuuugccauuuauuuuguuugccugggaagccauaaaagugcuggugugagcuaauuauaacaaugcauggccaagucaacaaugacgucauagaagaugcugggcuuauaagaucuuaauggaacugagaaauuccuauuagcuaguggcaucauaccuguuauacugucuuggcacaaugcauuacucacgcauuuguggugaugcugguauaaacaaaucuacuguauugccaguuuuaugaaaguauagcacauacaauuauguacaguacauaguacuugcuaaugacaauaaaugaccauguuacugguuuacguauuuacuauacuauaguuuuuuuauuguuauuuuuagagugcacucauucuacuuauuuuuuuuuaaguuaccuguaaaacagccucagacagguccuucaggagauauuucagaagaaggcauuguugucauaggagaugacagcuccaugcguguuauugucccuagagaccuuccagugagacaagauguggagauggaagacagagauacugaugauucugacccuguguaggcucuaggcuaauguguguguuuguguuuuggcuuuuaacaaaaaaguugaacaaguaaaaaaaaaaaaaauagaaaaaaguuuauaggcugggcgcaguggcucacaccuauaaucccagcacuuugagaggccaaagcagguggauugcuugagcccaggaguuugagaccagccugaauaacauggcgaaaccuaaucuguaucaaaaaugcaaaaaauuagccaggugugguggugcauaccuguaguccaagcucccugggaggcugagguaggaggaucaccugagccugggaggucgaggcugcagugaguuguuacugugcuacugcacuccagccuaggagacagagugacauccugucucaaaacaaaaaaaggaaaaaggaaagaaaauauuuuuguaaagcuauauacaauauguuuguguuuuaagcuaaguguuauuacaaaagagucaaaaaguuaaaaaguuucuaagguaaaaaacuuacaguaagcuaaguuauuauugaaaaaagaaaaaaauuuaaaauaaauguaguguagccugaguguacaguguuuauaaagucuauaacaguguacagucaugcccuaggccuuugcguuuacucagcacucacucacccagagcagugcccagucuugcaagcucuauucauuuuaaguggcccacagagguguaccauuuuuuauguuuuauauccuauuuuuacuguaccuauuguauguuuagauauguguugauacacaaauacuuaccaugguguuacaacugcccauaguaaugugauauacagauuuguagucuaggagauacaggcuacaccauauauucuagguguguagaagguuauaccauccaggucugcgugaguacacucuaugauauucacucaacagcaaaaucuccuaauaccgcacuucuuagaacguaaccccauuguuaagugacucaugacuguauucuaaagagugcucuggucccuggaaaacgauggauuugauacucuagaucucauuucuugcagaccagaaagcuggcuuuacuggaacuuuuuacugaguccucucugcuucauguaagacugagacuuuguacaggguuuacccaaguaucugccuugguaggaauuggagaaugcucuuagugcuugaacccuagaugugccaagauuacuugaggaaaagaauguaaaacacuuagcaucaagaaguaccaauaaaugguagcuacuaguuugcuaaaauuaauuuucccuuuucuucagccuuuuuuuacccuuagucccaggagccaucaaauuuccuauugcugaauguguggcacccaggcuugugagagcagagggcuuaggaacagcagccugugcuauggaagcugggucucuggcuggccccaugccucugcugacuccaagcccaaggauugaauuuacuuacuuugguagcugcaacuuggcaaauauagcagcuuagcccguuugucagugaggggagugauugcaggguagaauggagaccuaccccagaauuagacuugggguggucagcagccuccaacaaugaauuuauuucauggcaucagcccuaaggcucugugcuguaucccaccguucuuagucaugaauuggaaugaacucaggaagcauucaugcccagguguucucuggcagacaauaaucauauaauaagauuguuuugaacuugcuguuaaaaacaaugugaggagcuuccucaugaguuuucuauaugaaaagcaggugguguguauaaaaucccaugccuuuggggagaaacaguaccgacguugccuuagcaaacaucauugcucuucuucgcugggugcuuccagaccaucagucagcucaggcgucauuucuggucaucuuuccugaccucuaggcaggacuuuucugcucugggcucccacagaacacuucucuuuaaguacccaccacauuguguggaagcgaacuguuuucucauuggauuucccaccaugacacaugccccuggaaggcagggaccuccguguagucaccucggcaaauccgucucuuagaccaacaccuggcaugugaugggagcucaguccauuuugcuguaguugaacggagaacuucaccagcucaucagggggcucuuuugcucauguaacuacaguuugaguuuagauccacucuuaugagcacacgguaagauauuuugaugcccaguggcaaacagugcucaaguugccacauauggucauuuuucucagacauguacuuuccugacuccccagcccugaaagguagcaucaucuaaaacaccaacaacugauaagcuuuauuuuauauugguugcauuuaucuugcuacuccuugaaacacaggccuugagggccuuugagauguaaucuucaguuucccccaccccucuaguuggauuaauagauuuauguagcuguugaacacaagcugccuccgaaugcuuguguuuuaacucaguaggaacccagcugaucguuccgaaagcagcuuuuaagagaagcugauguccugugaacacguuagcaagcugucauugugacuuugucagcaggcuuaucucagagcaucugcagacucauuuugagauugccuaauuauuuauacacgagauuucucuccuuucuggugaugggcugagaugaagcugguucuuaaguacggggaagauauauuaugaaugcuuugucauuaaaauaggucacuuuucuguuuuccuccuauagcuaguauuaggaaauuauauuucucccaacuucuagaguuguaaaacuguauuuuuaaaaacucaccuuuccaguguuugcaaaaugugagcacaacauauacuacugccagucuaaaaugugugugcauuuagacagauaauguaaauuuaauccuaguaagugcuuauucugaagaccaucuucucucuagcguaaaugugugcuuaucaguauagaauaaauguauucaaagaauaggagaguaaauggcccuuuauucaaauugcuuucauuuauuuuuuucuuuuggaaguagugaaagcuuuauuaucaaucacuucauuuuucaccagcuucagauuuagaggguaaaaaaaggaagcauuugggggucaguguuuugaaucaaaacaaaucaggaauugauaaaaccguaguuuccugacuauuuacugaccugauuggagucauauucuuagcuuggaagagcuguguucauucauuuuuuuuuuuuuccugccgucuggguuuaguagguaauguggaaaccaucuaccauaaauacauugcugcaagauaacaaauagaauuggaaucuaugcuugcauuucccugaguuucuguuuuuuuuuccuuacauccugcucugccuggcaaggccagucacgugcuuuuuaggacguuuugugcucuaacuuaaaaaccuucaugggauccacagccauucacacauuuuaccaaaccuagaaaaguaacagugggaaaauaaguucgaauucaacuuguacaggucuaacuaaacaauggcugaaucaaaaagagccuucucaauaugaaaauaccaugauucuguuacacagacugcauuuguaguuuucuuucuaauccaaugcuuucaugcuuucaagucccuagcuccuucuguccacugaguuugcaggauugaaacuagaaaaaagagugaacaucuagaacauccccaggcuggccuugccugggacagugugccagccagcccacaggaagguacuuccuccaaagaacagguucaucacacauuacuucugagagcaaggaaauaaggguggagaccccaguaugggaucuuggaagcccccagaauguauauggcuaauuugaaacuuugguuguuaaaccaccacugugacaccucugauuuugagguggguccaugggagacaacaggaaguuauggaaagaguauacacuuuggggucaagaaaaauuaaguagccacuccuggcuuugccuucuggacaaaugacuuuaucuuuuaucuauaaaguggguauaacaaggacaauaaucacuuagaaaguauuuugugccaugccuuauguucaauaauauucuuaccuaugagguggcuucuugcauucaaaguggaacaaacuugaggcuuaaaaauuccaggcggcugggugcggugguucacgccuauaauccgaccguuuugggaggcugaggagggcagaucgcuugagcccaggaguucaaaaccagccugggcaacauggugaaaccucgaaaccucaucucuacuaaaaauacaaaaauuagcugggcgugguuguacgcgccuguaaucccagcuacucggaaggcugaggcgggagaauugcuugaacccaggaggcagagguugaagugaaccgagaucgggccguuggacuccagccuggucgacagagcgagacucugucucaaaaaaaaaaaaaaaaaaaaagagaaaagaagcccggcaaugggcuacaaagacacucuuggaaagugcugaaucugagauugaaaacaaggccugcuuuagauccagagcucaaguccuuagccaauaugaccuuucagauugcuacaaguguucauugaaauaaagcaggaacagugccuagcacagauuccagcacacaggagaccugcaguaaagauaaacccacuuuggcacuuccacucgugggggagagcagucagcccuuagcuugucccuuaacaguaagacugccacaccaucugaugcaugacuaccagcuccuuuugaaucuacucggaaggacaaugugcacgcucugugcccugcuggauaugguuuaauuuucucauuucuacaagcucuagguuacaggggauaaagccacaugcagcuaguauggacagaacaacuaguucugguugaauuauucaguucuuaacuggcugcagcuuugggaucuuagaaacacaguccuuaaccuugcauucuuuccacuugaaaaauaaaauguaggugcccagcagggaaauuccauggacagaauagcugucaaguaggggcacuucuuagagcagggaggaagcugagcaagugggggugaagggaaacauggaggcagaggcuggggggcugggacccuggguggcaagaagcugagcacagaucaucauucucccuuagggcuagaaccugugaaccugaacccuucauugaggggcacugaauuuagaaggcagcucuucuguuugucgcuuguucuuucucucaauguaauuaagaagacuuugaagaaggaauauugugcuaaagccuagauaagaaccuguucuccauccaccuccccaaaucccuaaagccuuguuugauuuuaauauuuuucuuuuggauuucacuuugcugcugugugaaggggcagcagguggggaggguagagaggaggguuccuggggaagcagaaacccuuauggaaacccauuuuuaaucuggaugauggcucgguaauguaagccgugagaguuggcagaggagugaaaacuguaggauuaauggccuugggccuaauucccugauaccuuuuaaaaggccagcuaaccagcuggcuuccuccuuuugcuccauauacacucccuccucccuuaucuucauuguuuuuugcuuucuuuuuuggcugauuuuuaacuccuucucugaaucugaaagagagaguuguauguauaugaugauuuguguuaaagaugcuuagaaauuaauauacuaaaggaagcucguaauaaaauacaaaagaugaugauuugcauuguaaaguaaucuggauuuuuuuggugcaaguugucuuuaaauagaaacucuucuugauuugugcaugcaugugcacacaugcacacacauccauagacaggcauaagcaugugugccugaaugugaguuuucaaguuuaaacccuuagaauauguguuuucuguguagguagaaaugaaaucccacaaauguuaucaauucuugugagguuccagguaaaauauacaugcaugaccuucucuacguuuuacaacauuacugcuuuccccaagugcccguuuaucuguauuucagaaacccaugugaucuguaaaucagguaggccaauguggaaugauauaucugugugcugggaucugcaugugggcugcuggaaguuugaguuugcagguaaugagcguuacuuuggaugcgaacggaggcacuaggcagggagcaaaaaggaggguaacuuacuccagcaaaggaggacaugauuaguguuuccagcaugaaaccuuugaagugggucagcaggaaaggaagaaaaagcaaaaacauccagacaugggagaaucagaacauuucuuguugccuagguuauucugguagacuuugaaaugccagucccuauuaguuugguggguaaacauucucauuauuuucuguaauuggcauuauuauuggaagguaauuaacgacaguaacauuuucguauaacacucagaccuggaugggucuuaaugacuucccuucagucuugcgugaaguuguuuucuguuugauuuuugagugcuugaaacuacuuaggguucuggcugugaguggacucugcuggcccugcuauguuuuauaauauaauugcauugaccaugccugucaaauugucuucauucuuucuguccuagccuaaugccuggccagaacaggugcccaauaaaguguagcaguuauugcagcauuugucaacuaaaacauugaaacccguuuauaacuccuauggucaugacugguuuauguccguagacaacgcuugauauuuuuggauuguagaaugcuuuuaccaaaucagagguaaaccccacagagacccuauuagagccgagcccaagcaagccagauguuaucaaaucacucacuguaacuucacagccuucccugguucacgaccauuuugaucaugucaucuaagaugacaucaugaucgaauugacaguggauuauuaguucacccaucagagguugugacaauuugauacagcaaacccagaagcuuauagacauuguauuugccaguugaugcuuaaucuaaucagccuauuuauauucagugaaacucucauaucuacacauuuccacaucuauuuuuagcuccuuuaucacuuccugucauuuccucuugcugucccucaccuccucaaaugaggugccaggacuaaacuggacauugcgagaagggaggcggccuuauuuagaguguguugccuauaacacauuuaauuugccgcaguccagaucagucgcagccucucuaacuacaaguggcagagguggcugucuugggaagaggcacuuacacuguccauucucugcuuuuaaacagggccugguugugguuggaaggauguggcauaacuaauucauagucacuuuaaauucaguccccaaagggacguaucucucccggguuacuuaaagaggaauuaaaggcagggagcugaugggggugguguugggggaucaagugauacuaggaauauagguacaaguaagacugucguuuucauuguuuucucuuuggacugauucuguucauuauaacagcguugugaaguagaggugggauuaggaaccuucugcuguaaucaacucccuugcugcccaaacaccagccucauacacaacaccaacaggaccagcauggagggaaauauuccaagggguauuuacucugcuggugucaaagaaaaacacaccuguaaucucagccacucaggaggcugcggcagaaggauugcuugaacucaguuguucaagaccagccuggacaauauagcgagaccucaucucaacaacaacaaaaaaaguaaaagaaaagagaaaagaaaagaaaagaaagaaaaaccaaaaccagagagugauuagaguaguaaaaacagauuuuagucaggaacuauugcaguaggggcccaauucugaacauacuugaacaaguggggauauguagccaaaaggcaggguuaggggucaguggguagauagccccuaaaagggagcaucagaaguaaggaagauucuugcuaaacagaccuaacaggagucgugcugaaggcaggccagggugaucagaucucaccuggggaauggugagagaugaugaauuuggugagauaaccagcguggggauucuuucucaagugauguaacaagauuuuugcuaaaacuaggugauaacgggucuggcaaggauggacuuguaagaucgagaccuugaggacuuagaggaaccugauuucauuuaaucaaggagggagucuuguuacuggucacugucucaucucagugacucagaaguacagcaacaguggcaagcguuucacuugcucaaagcgugguuaguccaggcugcagcgaaaggcggaaggcaccagggauugggacaagcucaaguguucagcaucacggggguuuagcagccugcuugagugcaaauaucuugaauugauguuacugugcccuauggaggucagccuggauccuucuugccucacugcccaaauuccauuuucacccagcaauccucagagguuuccaaaggccuuuuguuucuucgugccauucucccuguaagcuuuccauauggccuuggcauggaacagguuuauccaacccugugguauuaacaguguggcuuuuguuguucuuggagaccuuugcuucuguccaaauggcuuuucugugccucaucuguugauagauuggaaaaugcucauguuuuucuuuuacuugauuguacuuagaauauuuucguuauuuauuuagcagagaguucacuuggaaaaggaagaugauggcauaucguggauauuucuguucugaaagaaauaaguucaaggaaagaaaaagaagaguaugaauggaagauuauucauccaucaauccauucuugccuucugugcacacgcacauauaccuauacauucauauauaauguguacuguaauguuucagcuacucucucaggaauguuuagaaaugaaacaguaaacacaauuuuaaauguagaagaucaugcugauauuuuggaauaacauucaaaaccaaguucuugauuucugucucuucacccuccccaauauguugcuucugcaguuuucccccuuaguaaaaagcgagccuuuucucugaguuccucaggccaaaaccuugccguuguccuugacucuuuucuuucucucauauacagccaacucaucugcacauccuguucauuguagcucuaagauauauccagcauucaaccaguucuuaccaccuccacugcugcuucuauggugcaagccacaguuaccucucaccggaccauggcaauagccucucucuucuucccugcuuccauuucccaccuuggcccaacuacaaacucuucuccacacagcagccaccaggggaauccuuuuaaaggauaagucagcucauaucucuccucugcucaaaauccucuguggcuuuccaucucacucacaguaauguccauauuccucacugugacauacaggguucuguaguuugaugcgaccucccaacccucuucuuccucagcagucucccaguugacaaguauucuccaaacagcagcagcagcagcagcagcaauaguagaaguagaaguaguagcagcaguuuucuuaccagauucaagcuggcuuuugcuggcaagaauccucaugucauauguauccuugugagaucauugacuuugggcauuguccuaggugaaugcauuggagccuuugcugacaaguccuuaagcaucacuuagcaguggccuguguaguucugggguguuuggaaucuuucucugcauguucaaugcucaggagguaaacuggaaacagaaaccacugucagaagaaggauggagccaaccucuaccaucaguggacuggugcuaagaaaaccuuucuugaaugggcacgguggcucacgccuguaaucccagcacuuugggaggccgaggcggguggaucacgaggucaggaguuugagaccagccugaccaacauggugaaaccccgccucuacuaaaaauacaaaaauuagccgggugugguagccugugccuguaaucccagcuacucaggaggcugaagcaggagaaucgcuugaacccgggaggcagagguagcagugagccgagaucgugccacugcacuccagccugggcgacagagcaagccuccgucucaaaaaaaaaaaaaaaaaaagcaagaaaaaagaaaaccuuucuugcccucacuccugcuuaggaugcugccuuuaaccuugguccuuagaguggguaaagcucuucugaauauuuuuuaugugaggagggauaaaaagguucaauaaacgcaaugacaaguggugcugccccugcauacaacuguguucagugacuucuuuugaguucauaggaaaagcauauuuacauauauugaauccagggccaugauuuugaucacacccacucugucuuccugacuuagagcauuuuuuuuucacucaagggcauucucaacaaaggaguauagcuuucagauuuguaaacugccaccuuauuauccuauuagucaauuacagcugcucaagagcaggguaagugacaguauggcagauuacagcaauuuauuugccauucucauagucuuguuuggcauaucaucaggcuguuuaaauuuaaugauaggaguuuuacauguguuuuagagcaguuaaaguuguaaucaaaauguuuaggaaaaccccuacugaccugcauaaaugcucccuucuucaacguugcuuguaaagccucauuguaaucuugauuaguaaaacugacuccaauuaggaaaaggaacuuauuuuccaaagaaagaaaggccuuuugguguucuuguguacaaagcucaggaaagauggggcugauggaaauuauuuuccuugaguuggcccuugugggcaaaucaguugcauuuaaauaagucaccauaaauccccugagaaacuugguagagucugugggaacagaagggccugcaggccuggucacaggauggggguguauagcauggcacugggaguaguuuggaggaaggaggaaggagagcuguggguaaaagaggagaaaauaauugcccuccauuaugucugguucucuuucaagcuaacggugauaguuauuguaguagcggcugcacugaaacgaaaaacaucucuaaaaagaaaaguugagugcuuuuauagaaucuuuagaucuuacaagaugggaugagaucuuggaggaccugcuaccuugaacuugcucacaccuucaccuucacugguggaaaugaaggacuauuguuauuaauggaaugaucaagagacccgaaccugggaauacccaguuuauucuuugcuucccuaugcuaagaagcuaagaauacugucauugucaacaacuauagacucucuucaucuuuauugaacucucaaggugcuaugucauuuggaaagucaacauugcccugccuacuaugaguuuaauaugcauugcuucaagccaauguaagaccagaguuucucagccuugacauuguugacauauugggccagaaaauucuuuguugugggggcucuucugcgcauuguaggauguuaaacagcaucccuggccucuacccacuagauaccagaagcacccacccauuccccaguugugacaacugaaaauaucucuagaaguugccaaagguuucuugggaagcaaaauugcuccugguugaggaccacuacuauugacugauccaaacuuuauauuaucacuugcaaauaacuuuugauauuauucaaauaacuuuugaaucauacaaacuuuugguauauguuaaaaaauauuuagugaaucucuacuguauguaagucagcacagaaaccacugaaauaaguuacuauucuuacucuguuguccagcauagacaguauguauugcauguugauguaaaagauacaaugccaauuuuauaguaaauuuggggggacaaauuuuucaugcauuuugaucauauguuuucugaaagcuauucuaagugguuuugucagggaaauuaucauuuuuuucauauaaaaacuguacauugugugccagaacccagcuauagguuuuucagaguuggcagaguaauuaaaucgcaugguuauucuaugcuguaaagugaaauaauggagauguuguucgaauuuuccuauguaguuagaucucacgaugauuuuauaacuuuggcacauugcuuuccuuccauaauauagugccauuguaugcaaaguaauuuuuggauacuguuuucugaggauagaaagggaggaugaacacaucuaaucugccagcaauaucaaaacagguauaugaggcacuuuuucuguguauagccaugcugaugacuaaaauugcugaccuuuagguacuugcauaucauuguggagguaaaacacauaucuuucuauagucaucaaagauuuauugggcuccccugauccaggcucuguacaaguccccuaggauaugaaaucacaugagaaauaacucuagcuuuuuaaggaaaauauggucuagugcuuauagauuaaaaaaaugcuaacaccguuacaggcuauagagcagagagucccugagcuaaauuuguugaauguguuuuaacucacgguguauauuuuaaaaacuugaauuaguuacgguguggauuagggugauaaauagcuaggagugacagaaaacucaaggaaauaguggcucaaacaaaauagaaguguauuuuucacucaccugaauuuagguagcucaggccugguaacgaggcuccgugaucaucagggacccaggcuccuucugcuuuguugcuccaccauuuuaaacacauaucuuacaugcuggaguccaagauagcugccccagcuccagcuaucacaacugcauuccaucucauagcaaaggaauggagaagggccucucccuuggaaauaacacuuucuauacccucuuacguggcugcaggagcuccuggugaaccaccaucagggcuuggaaugugcuugguugaccguaggaauaucaucagauuagguuuuugcaucagcgagaaagauugaguacauuaauagcagaaagagcacaggcaugggcaggcugagguuugaagauaggcagcauuacuuacuauaauaguuaagggagcagaagguaagugcuaaaugacaacauguauuagcagaauucagacaaaggaugauagcaggggcuggagaugauauggaaggcaaauggggaggagguggaacucgaacagaucuugaauaagcagagaaauagggaaucccaagagaguccaccguaaagagaaacaucagcuucuggcuuccuuagaugccauguuuuaagggcauuuagcuaaaaucugagaucagaaaauggugagguuccuggguguccagcaagcauucagcuuucucuaggccauuuauagaacacuuaacuaacccauguuguccuuucuaggauauauauauauauaguggugugacucuauguggcaauggccuuugggguuuugcagaaugagaacuauuauauuacuuuauucagccgauuucccaagcuguuaagcaaccaauuuugaagaucugaaacucaugcugucuccauccacaaggaccaugaaucuauaugaauguaauuguuuuauuuaaucuauuauuauaucaucuaucauuuuuauuuucaccauaaucuugacacaguucauuauagcauaaaaugauaaccucugugaaaaugacuucauguguauuucuaugaacugcauguuugucuggguucugcaagucugcagacuuuuugcuuuuacuauguucuuaaaaauuaguggucugagaagaggcauuauauuuauuuauuuauuauuaauuauuauuauuauuauuauuuuugagauggaguuucaucuuguugcccaggcuggagugcaauggcgugaucucagcuuaccgcaaccuccaccaccuggguucaagcaauuauccugccucagccucccgaguagcugggauuacaggcaugcaccaccacacccggcuaauuuuguauuuuuaguagaggcaggguuucuccauguuggucaggcaggucucaaacucccgagcucaggugauacgcccgccucagacucccaaagugcugggauuacaggcgugagucaccgugccaggcccgagaagaggcauuauauuuaaauauaauagucuuauuguauuuuaucaguuucuugauaauaauccuuuaaauuauggauauuugaucaaaaagagaggucagauaagcaaugagaaagagagaaacuaaugaauagaaagaguaagaaagggggcugggcauguuggcucacaccuguaaucccagcacuuugggagaccaagcugggcagaucacgaggucaagagaucgagaccauccuggccaacauggugaaacccugucucuacuaaaaauacaaaaauuaucugggcgugguggcacgcaccuguagucccagcuacucaggaggccgaggcaggaggaucgcuugaaccugggaggcggagguugcagugaaaugagaucgugccacugcacuccagccuggcgacaaagugagacugugucucaaggcaaaagaaaaaaggguugaagauguuccuggaaacauguuuugcuugaugcaaacuccuuacaaaauauuuuuggaaaauuucuccugccuuagucaaggagaaggaaauaucucagagucacguaaauacuauucugaaagaccuaccuaaaaaaauaauuggccaauagauaucuuagaaaauuaagguauggucuagaacauaaacauaacaauauuuguuauauauuacaaauaaaagacaaaggugaucccauuuuaugacaagaaagcuuucuugguugaacuguuaaacagaggcuauaucgucaauggcaugccuacuaugauuuauuucauuccuguuauauagaugcauauuaagguacagaaagaucaguuauccugccaaaagucaccuagcugggaacucauaaaacugggauucaaacucuggccaucugacuucagauucuaagcuuuuuuucuuuuuuuaaaucuuaagcuuuuaaccucuguccuauauuauuuggguuuuccagcuaggaagauugaagcccuugaauaauuuugcccauuuaagcaccacuucauagcagguagaaaccaccccuucugaaauugacaaaugggaauggacauaauugccuugaacauggaaugagacgaacaggcagauggcagagaucuaggaguuucugcaggauuuugcccagugguggcugaugacuggguaaauaucuaguuuuuaucucuaaaguguagcuuuucuuuggaauuugacauuuuggugcuuagccaacuugcaggagaaucauccgucacauaaguugaguaguguggcaauuuguuuuaguagcuauuuacuaagucaacaaccuaacugcuuugucuuugaaaguaggaguauucaugcucauuuauauuugggggacauagcagguagcaccaaguauuugugucaucaaauugacuggcaugccacuuguguaguaguauuucuaguagagcucccacuggaauggaaagaaacuaacagaacacuggaacccuagugaauagcauucaccaugagaaugaauucagugcaguauaaggugguuuccauuuuguacuacaucaaagaggauuuaauuccugaaauaccaaaaaacaaaacaaacaaacaaaaacuuuauucugaagccagcucauuuacaagguacaauuuuauauauacugcuauuuuugcuauuuuuugcuauuuuuugaucuuuauaugucagguauuuaguaaauauauucaucucauucgugaaguguuuauuauuuguuccaucguauacauuuuaaaacugagauucagggagaggucacacaauuggcuugcacacagucaugcaacuuuuaacugguauuugaaaccagguucaauaggcucaaaauucuaagcucauuccaccauacucuaggaucuccugccagcccuugauuaaaggucaaagggccaauguccacuggagcaguccacagaaaugcuggcuuuuacagagauaauggaguugggaagcccccagguguacauguggauuauagugacauaugagagaaggaaaaagauuaaugaauucuuucauaggauaucuacuagggagaagcucuaaauuuccucagaauaugugaauggcuaucaaaaauacagagacaggacaggaagaaaagucuugguggaacaaguugguaggagucucuugaagaacuucaguaucacauuuuaagccaagaaauaguuuccccuccucuaaugguauguuaccauuuuguaccuguaggaggcacugacaugugucuucaucacugugucucaaagaugacauucuagauuucuuucuuucuuuuuuuuuuuuuuuuuugucuguuacuuuccauuuucagggaaaaaaaaaucuauuuuaggguuuccuucuccuccccugccaguacgguuaauauugccagaacaacuuuagacuuuagauauuaagaaacauuggcuuaauaugacaauuugauuuugcuguuaaauuuacauguaaaucucuaggcaaguucccaucuuuugauauuuacuuaaaauauuuacuuucacauguauacauggcacuuggaaggaaugcauuaagaugaguguugauuuauuugcuuuauucuuuaguaccuaauacuuucuguccugaaaugaauuagagggaaguuauuauauaaguaauuauuuaucuugaagaguauauugauagguaggcuguaccuugacaccauuuucucaccuucaacaguguaugguagcuggauguuuuggauguuuucaaaauaaacaccuauuuguagcuauguuuuuagauucaucucuaaugcugcacucacgggaaaaaaucagcaggccuguauuaacuagaaaaccacuuuuauguuguauuucgauccauugaaacuaaagcugauuagcacuuuuugaaaagugauucuaaaucuuugugcuaaucaagggaaauugagccagguugcugcuacagaaagcuggagagaagacgggaugugauggcaaguuccuuuuucauucauccugcagcauguagcugggugcuauacccaccccuuucccaacaaaccacucuccuaagugcuuguuuaauaaagcagcacagcaggugaauauuuaaguguuagugggauucacacaguuucauuucagugcaaugaacagaauagaagagaauuugaggggcggggggcuuuuuucuagcaugcuguuaagaaaaguauagagacuguugcacacuaaugauacaacgguaauuugaagcaggauguguuugaugugcauuugcugugcguguuuacuguaaucaguggcuguuuauccuugggugguaugaagccgacugcccaccuucuacauuuggcaguaaugauugcaucuaagaaaaagcucacuuaccuccagcaccuccaaguggcugcagacuuuaacagcuggacagccugaagguaggcuugacuugucacagauuucuacucuuucccaagcaaugacaccaaagggauauuugccaaucccuuucccccuucauucuucuuugggggcuuuugggaauggaagacucuuucuuguuuuccugcugucugggauggaguagcagaugccaaggaauggcguggagaaaggagaggaagguaugauaauauuuaguuuucuucuuuucaugcuuaaacagauagaaggaauuuucagagcaaaaucuuguuucaaguguauggccauuuuucaauuaaagucacuuauuaaccucuauguacauaagcagaaucuccugagucucucugaagacacaaagagaaaagauuuccuuccucccuccgacucucuccaaauccccaagugacacucauaagcugguugagagggugaaaagcucacaaaugugaaggcagaagucacuuugcaccuuucuggcacgaaaacuuugaagucuucuuacagaggaacuacacuguguaauucaaauuuuuaaaauguacauucaagucggacugcaguuuaccugcuaaugcuguuagacggcugccuggucuaagcuccagcugaucuguggucucugaaaagacagccacacaaagcugcuugcauaguucccuaccacuccaaagggcucuccaggugcacuucguuacaaggauugcuucgcuaguggacuuugcugacauuagcucuaguuuggguuugucuguuugccugcuaugaagguauugagggaucuuagaaagccagaaagaaaagaguugucaacagaugugccuuuaggagagagacugaguggacucaaggauuagucccagccuuucggaauugucuguggcuguuucauagcugugaugauuuugaugagcuuuuaucauugcuuuuccuggcagcaccauccagggcaauaaggauaagccuugucggaugguuccugaaauuacuuagaaauaaguuguaaucucaagaauugcaguguagcggccaaagaaguuuuacaagaaguugaccaggggaugaugucaaacaaauggaaccuuaaaaguugacuuuuuccuccucaaaggcugggugcccaggacuaguuuuaaauguuccgauacucaaaagaaaaauucaaaucacauaagugaacccucuuauuuauuggugaugucagacaagacuuauaccucuggggugugcuagcuggguuagaaccccucacugaauauugaguaugcauuaguauucgaacauaauuucuuuucauuuuuuucaaccuugauauuacaugggcuuaggccuuucuuucucccagacaacaaauucucuuugaacaaaaguaugaugccguaucauuuuuuuucuuucuuuuuuuuuuuuuuuucuuugagacagagucucauuuugucgcccaggccggagugcaguggcaugaucuuggcucgcugcaaucucugucuccccaguucaagcgauucuccugccucagccucccgaguagcugggauuacaggcccccaccaucaugccuggcuaauuuuuguauuuuuaguagagacaggguuucaccauguuggccaguaugguaucggacucuuguccucaagugauccaccugccucagccucccaaagugcugggauuacaggcaugagccacugugccuggccgccauaucauauuuuuauacccagaauaccaaaaaaaagugauaggcaccaaggacugauuuaguguuccugcuuuggagaaaaugaguugacuuaggguaccccuacagcuucauaguaaugauuuguguccuuguucuacccuggggaauuuuacugagaugaauuaggaauuaguauggggauggggaggaaaggagccuuaaucauaguggcauuaacaggcaagaggaaauuaaaguaggacugcuagacaccucucaaccaaccaaucaaccauccugccacuugccauucaaaguuaacuaaacgagcuggacgugauggcucacgacuguaaucccagcacuuugggaggccaaggcgggcggaucacuugaggucaggaguucgagaccagccuggccaacaugguaaaacccauucucuaccaaaaaagacaaaaaaguagcuggguaugguggugcaugccuguagucccaacuacucaggaggcugaggugggagaauugcuugaacccaggaagcggagcugcagugagcugagaucaugccacugcacuccagucugggcgacagagugagaaccugucuaaauaaauaaauuaaauuaaacaacaauaaaauucuagcucacuugguuuugucugguuacagguuccuuaacagguguuaaauggcagaaaauucccaauagauugaucagcacuugacuuuuucguaguauuucccaccagaauaacgucuguagaagcuacucuauccaggauaguccugggggaucucuggcagaauauaaauauuucugcugugugcagcagcagcuguagcuuaggaggagcaaugggcguggguuuugugguuuccuucugacuuuucaggguagcucaucacuucgaccacaaaaucacugccaaccuucagaagagggaagaaggauuggccaaccuacauuuucuuuucuuuuuagggacaaacagugacuugaguuuuugcagaccagccggcuuaguuguguuuggaguuucccaauauagucuuugcagaaaugugaguugguuuuuacguugccgcaaaccaaucaucugcauuacaauuggccuuaguccuggaaccacagaggugguuugcuuuaccccuugacucaaguugccuaauuucugugucacuaggaagaaccaacaccucucaccagcccaugaguugugagacaguaagcacugaaaugagugaugaaugcgggguagccauuuguuaaaaaccaggagucauuuauucauucauucaacugguauuuauguagcccuccuaaaugagucaggcauugcuccaggagcuguggauacuguaauaaacuagaucccuagucccaaauauucuuuuuuuugaaguuccagauaguaaauauguuaggcuuuguaggccucaccauuucuauugcaaccauuaaacggugacauuuuuucuuuuucuguaguagcagccacagaaauacauaaaacaaguucaagcugcguuuuuuaaaaaaucuugauuuaugaaaacaggcaaugcaugaaccauaguuuaccaccucugaacuagaccauaacuugcccuuguugagcauacauuccagucaccugcacuugauuucuacuagauggcuuuauuguauaaggaagauauguucuuaaauacuacaccuaauccaaaacaagaguaaugcaaaagcguuaaaagaugcauaagguaaaaaaauccuaaaaagguuaauaggucgauaaacccaacaaacaaaagaguucauaaaagagucaaaacaggccgggcacgguggcucacaccuguaaucccagcacuuugggaggccgagguggguggauugccugaggucaggaguucaagaccagccugaccaauauggugaaaccccaucucuacuaaaaauacaaaaauuagccaggcgugguggcgggcgccuguagucccaccuacucgggaggcugaggcaggagaauugcuugaaccugggaggcggagguugcggugagcugagauugugccacugcacuccaaucugggugacagagcaacacucugucucaaaaaaaaaaaaaagaaaaaagaggcaaaacauagcaauauauauuuuaaaacuuucuggugacucauugguuacuaauuauggaauacguuuuucuagaucuuaaacauucauaagaaaacaaaaucaucuuuagcuuuugaugaauugaccauuccuuuaauacuaugaaggcaguaggaaaaccugucaugaacuucagaaaucuaacaauuuuaagaacacuccaucccauuauauacaaacuacugcaaacuccauaaauaauuuaaaggaacaaguucauaaaccuggugaauuuagaaaauuggucauucagcacgcugucuuuggugaauugaccauuuguugauuugguagcuuggcauguugcuugaagcaaaugaaucuagaacugguaagcagaguucuacacacauguuguaacuuaaaaugcucuuuggaugaauggccgaauacaugccugggaccaaacuugcuuguagaaugguauuuauuguuuagguuauagagguugucaaaaauucccacaugguaagggaauuucauucaugauuaugcauagagaauuauugcuccugggguucaaaggcuaacucauuauuuucaggcuuacugaagguccaggcuuacucauuauuucccccuaauguuuuauuuauaaauuaacauaaauguuuaaacauguagaaaaguugaaagacucauccaaagcacaccuuauaugguguauggauuuugaaucauaagugguaggcuguuuccaaaguggcugaaauaauaccaacucaaaucuguuuuaggaccacaucuuuuuaggagugaccagagacugaucugaacuauuucuaguucucuuuuguguuuuggggggaaaaugcauaaaauacuccuuaacucuagauugugcauguucuuguaguugcuuggucacucuuuugaaacaaaggccagugaugcccauugcaauugcuaagguaugucuuuccuguauucuaauuucaucuaauugaugcauaacaaaaauucaagagguuagugucaccauaaccugucuccuuccuccugccuguauaaaguaccauguggaucucaggaagaauuuacuagcuacaaaauaaaauauagaauguagucuuccacauuauagaguuccuuuuuuuuuuucauguggaaaggaaugauugagggggaaaaugaauuguuugacaucuaaccauagaaagaaaaauuaguuuucucuaacuucuccaggcucuguuuuuguuucacuuuacguucugugugcuacuggucuggggagaaauuaugacaugaaagggaguaguuucccuucagaagauucacucacaauuuaauaguaaucacaugucugggaaaauggaaggguuagaaauauuuuccacaucuuuuuugguagucaccugcauucugauaaaugcuacaaccuauucaucacugaguguuuuguuugcuguugcugccuguaggaugauauauucuugagcuguugacaucuagcuguauuaucugcuuuggccaaugaaaugagagcucaagucaccugugccaccuaggaggaaaagcuuuaagcgccauuuuauggcuucaccauucucauguuuccuucugccaugaaaacaguaacgucucagaggccaggugcucuacagcgugggucucaccaugaagaaguggagcauagcccacagccaacccucaauggauguguuguugaaagccauugaagugauggggucauuuguuacugcaacacagcccacuggcaugacauccucaucauacuguugugccuguuuauaguucucagguucuagaauggaaucacuggaagauucuaaaccuggacuuguggugaugaugagaauaagaaagggcauugagguaguugcauuuacagcacuggauauucuuaucugcagagauugguuguucuagaaaucuuucuccuucuuuaaugcuccucacuucagcccuuugagagauuuuaagcugaaucacaaacaacuuggccaaccuuaugccaggucaucuaauuucuacaacaugguuuguguguuuaaugauaaaauaagggcuccaugaaggcagagguuuguucuugaugguguaucucaagugccuggcacacaguagaugaccaccaaauauuuggucgaugaaaugugcuaugucauuuauuuucaaugaguuuuuccuuugauuuuauuuuacugaaguguauacucaggauaaucacauuccuuuuucugccucuaauagaaaaucugacucuggauaguagguugaauauguauuuguuuauuuauuuagagacggagucucacacucugucgcccaagcuagagugcaauggugugaucucuauucacuauaaccuccaccucccaggcucaagugauucucuugcaucaaccauccuaguagcugagacuacaggugccugccaccacgccuggcuaaguuuuguacuuuuaguagagauggggguuucaccauguuggccaggcuggucuggaacuccugaccucaagugauccgcccaccucggccucccaaagugcugggauuauacgugugagccaccgcaccuagccgaauauuuauuucucuaaauaaauugacaccacaagugaaaucaccaaggggcauagccucaguuuauuauaaccaaggugucuuuaaucacuugaaauacuaguagucuuugcguaauuuuagggagaaaaaaacauuaaaacuuguuguuuaacagaaaaaguugacugugaacuaguacuuuccuaaaauucaggauucugcuugacuuuugaauugugucagaaaggaagcauauauaccaccauauuguacucacagccucucugagccaugacauugauuuaagcgggaggggcugcuauauuuccacagacuuagcccauucacucauuuccucugcuuugucaucguuagguuggauuuaaguagcauuacuguaaaauuccccacugagaaauuucaacaugaaguggcuuucugaucucuuuaaaauaaaaugguuaaaaauagaccuugugggaacaguuuuccacuucaagaacaaaacccugcaaaaauguuuuaaugcagauuugggaccuaauuauuuuuuucucaccucagcuuggcuguaguugugcuacaguggagacaacaagucucaguguugcagaaucuggccagaaaaugcucuccacucccugugaagguuuccuauuggguuggccauugcuuacuucccuuccccucccuggagcuuuucuugggguggcggcuccaacuaugaagagccuacaucugguuccucauuaauucagcgacuucucucaugaggcuagggaaggccugaccauuucaguugcgccggccuccgguuuuugcaaacauuaaagucugcacuggguaaagaugaacugacuaaaaggaaagcagcgugcaaaagauacucugucauuaacauccagagucuucaagguacucagucauuagggcugguuuaaucacgccucugugacaugaccagagccuuaguuagcuuugaggcacauccagggguucucuguuagaaaaacggguuccuggcuggccauaucguuuucuuauuucaaugucauccuuuuuucccacagccugguagcugaaaugucuauggcauuucagcuuacuugugacauuccuuuacaauuuuguuguuuacuguuguaguucuaauaccuuagaaagauggccuccgacuuaauacgcgcuuccguaaauaucuguggaagaaugaaugguaaacaaaugaaucuccaaucacuagugacuaguaauuguuuaauuuugugucagucuucauuacuuuccugccugauaggaaaguaaugagagagaaaacacaaaguguuaagaucuuuuauaaauagaugcuaugccaugccccacaucucccauuuauuaucauuauuauuguuauuuauuuuauccuacguccuuaccucuagcagguagaaaauucuuuuuucaaaauaguaaauaacccaaauucuauuuuaucaacaaggaauggaaugcauuucuuaaaauucccauuggaccacauauguggaacauuuuaaaaaagcaguuuuauaagcauccauccuuacucucugggucuggagucuaguauguuuuaaaauaaauuuggguguuucugaaauaaauugcucuguguuucugccuuuucuguugcaaaguucuaaauuauggcauacucuuuugcauucucucuuuugacacaaguacuccuuguuucucugucucuuaaguccugucauuuaaaauucauuucaagugucauuuccucuggauauauuccuugugaguuagaugcuucucugucccaguauaccccgauacacucugaguacacuuccacauagaguauuuaucacccuuuauuguugcuguuugauuaaugguuagacuauuagacucuuagugccccuaggccaaggccugaauauuauuuaucucuacauauugggcaucucuuauaguuucuggcauggauaggugcucagaauauuuguugcaugaauucauuuguguucuuuagguucuaaggaaagcuucaguucagcuuucagucuucagcauuucucuuuucacuagccaguugcccucuucccugccuggaggguuugaauuuagaaacugguucuacccacugcaguaagcacccacggucacugcccacugcuugcauggggagaagggccagaugggcauuugcucaucuggaaaccuggaaucuuggggccugaucuauguuuuuucagcuuuucuuuauauucuucucuguccuuuuuuucuucuucccucaacuccucuccccaaagaugguacuuggcaacggauaauuuuugcuuacuuagaaacuugaauaccguggaaaucuaacaaauaaaaaugacccugaaaagucucuagaaugcauugggaggauugccuaaaacaauuuugcauguggaauuagcaguuggggcucugaaauuacaccuguuauuuuagaaacaagaggcuagaaggggcaaauacuaaggcuucuuccuuugccauccccuaccuuuauuauuuuauuuauuuauuuauuuauuuauuuauuuauuuauuuauuuauuuagagagguaguuucacucuaucacccaggcuggagugcaguggcacgaucucagcucacugcaaccuccaccucccggguucaagcgguucuccugccucggccucccgaguaucugggauuacaagugcgcaccaccaugccuggcuaauuuuuuuuuauauuuuuagcagagaugggguuucagcacguuggucaggcuggucucgaacuccugaccucaaguggucugccugccuuggccccccaaagugcugggauuacaggcgugagccacggcgccuggccccauccccuaccuuuaaaugaucaucuuaggcggcugauuuccagccuucauaucaacucacagagaagaguaccaauauuucuauugccacuguuuuuuaacgucuaauccauagaaaaccugaccaacauaacaauacuuuguuccuucaagcugcaguuuaaaaucuuuuauuuuugcaccuuauauguguagaaaggagacuaucuggcuaacacuauugucaaagccgcuaauggacaguuaggaagaaggaauucaggaaaugaaacagugcugaaaacugggcaguguuuaagaugcagucaccuguaucugugcuuugacacuaaagaagauggaaaaggaauauauuuacuaguuucuucuaucauugguauuggaauccauuuggaugaaagacuuucugaagcucacauugucaguaguaugcugccuagauuuuugugggcacaugaguagcagaguagaucaauugaggggauuauaugauagcucaucuaucaaauuacccaggauaauugaggaaaaggauuguucuuuuuuuuuuuuuuuuuugaggcagagucucacuuuguugccuaggcuggagugaaguggcacgaucucagcucacugcaaccuccgccugccagguucaagcgguucuucugccucagccucccaaguagcugggauuacaggcaugugcuaacacacccagcuaauuuuuguauuuuuaguagagacuagguuucgccauguuggccaggcuggucuugaacuccugaccucaggugaucugccugccucagccuucccaaagugcugggauuguagcuaccacguccggccaggauuguucccuuuaaaaagauauaauggaaaaaacauuaaagaucuaaauugucauacaaacuugacaauauauauucauaauuaugcauuaugacauacucuaccaaagccuuuuuguaccucucuguucauuucuauuuaaaaaagaaaugaccauuuaaaauuaggaauuucucauuguuagaaugaacuagacuggcucauuauacccaaauuuacucaccagcugcuuugcaccuacacuaaugcugaggcuaacaagagugaaaaggauuaaaguauguuagucaaaggagauaccuaagaaauucuccuaggccacuuuguagcauauuuaccacauuacuugucuuuucaaauggaggaagauagccauaguauguuauguuuuguuggcauuuuaaacaaacaaacuagaaauaccaaauaaaucuauuuugaguguugauaaacucauuuuuuauaugaauguugaaaaucaccccaauccuauugggaugcauaucuuuagaugucacuuuaacucucuccuuuaaagugagacugggcgcgguggcucaugccuguaaucccagcacuuugggaguccaaggcgggcagaucacaugaggccaggauuucaagaccagacuggccaacauggcaaaacccugucucuacuaaacauacaaaaauuagccaggcgugguggcaugcaccuguaauccuagcuauucgggaggcugaggcacaagaaucacuugaacccgggaggcagagguuauagugagccgagaucacaucacugcacuccagccugggugacagagcaauacccugucucaaaaaaaaaaaaaaaaaaaaaaaaaagucacaggacaacauuggucuuaaccauacuugcuaauuuucuccauuuucuuaaccccucucaacuucaugggaaauuguaguuucguugucagaaagaaguuugcauauauagauuacccuuuuaggcaacuauuaugaauugaccaauccacguuuuaacuguaagaacucagucuauuugggcugcuaaugaacaauagaaauuuauuuuucacaguuguggagacucagaguccgagaccagggugccaacauggucagcuucuggugagggcccucuuucagguuacagacugcgggcuugucaucguauucucauguggcugagauggugaagaaucauucugcagucucuuuuauaaaaaagauuuccacccucaugaccuaaucacuucccaaaagcuccacaucaucaucccaucgguauuuggguuaggauuucaacauaugaaauuugugggagacacacauucagaccauagcaaauacuaacacucuuucucuuuaacuucucccuaacccuugaagaaaauuuagaaucuauuuauuauguaaaaaucccaucuuggcuuccucaacccuaaacuggacaugcauuucuuucuuuuuuuuuuuuuuuucucugcuucaguauucgcuuuaauauguguuuggagaucuuugaaagugauugaauaguagaaaaauuuacauuauagaaauaagauaccaaaacacauuguauaauauugccauuucuuucuuuuccauuuugugaauaaucaaaauaauaauuugucuugaauaaaagauaaauaacaaaaucagcuuugcuuuaaugcugcacaauuagcagcuauccaaacauauuaucagaaacauauuaaaauccacauuccauauuuuuagguaacaacacacugugcauugagauacucuucauuuuguaaauuagguaaucccccuaacauuugauaguguuauucugaguucuuaucuguagcuauacagucauugagcuggauaaauuguugcaauguagcaauuaagaacauccuuuuuuuuuuuaauccacaaguucaguaaauuacaacuugauugucugaguaaacaauguuaccugcuguggcugcuuucuugaagaacagaguucugcaugcaaauuaauagcaguuaguaauucccaguaugauagagcauacucuucccauagcuuaaacuucccuucauccacccuaggaaaacagacuaagugaaauauguaucaucaucuuauuuuuucuuucccucccucccucccucccuuccuuuuccuuuucuuucuuuugaaacagggucucacucuguugcccaggcugcaguguaguggugugauauagcucacugcagccucuaucuacugagcuacugagcccaagagauccuuccaccucagccucccaaguagcugggacuacagguacacgccaccccaugcagcuaauuauuauuuuuuuuauuuuuagcagagacaaggucucgcuauguugccuaggcuggucucaaacuccuggacuccagugaucgucuugccucagccucccacggugcuaggauuacagccaugagccacugagcuggcuuauuuuuucuccaauuccuuggccccaggcaaccgugcccaccccagcccuacccuaggggauacuguggaagcaguuuuagaagacaagccucagagugccugaugaccccucugucucaccagugcauuuagcaguaccuuacugaagcacacacaaccuaaccugaccaugguaacucauuuucucauuagggaauagaagugcuuguggaccagagcccaccuagccguucuugcauugggguaacuugugguauuucagugaggucccgcucuuguguacuguauaugguucagugucagauaauuuaacacccaagaaaaucugccuugcauacauuagaauauauuugcaaauuaauugguuaauuagauuuuagauaucucuaggggacugagcugaaacagaugugugcaaaagccccucacggggaugaggauaaagucuucuuacaggcuuucugaacgaagaguucuaucauuugauccuauuguuggugccagaguauuccaguacaugcauuuauguugaaagaaacaguacugcauuuuugucuugaaguuauaggaacaugcucagaagguuccaugcucucaaaauaauuguacuguaaaauaaugaaaacacuauuaggguugauuuuuuccuugauuauaucagaaaaccaugggagaauacagcuaaaacuaaacaagggcagauuagggaaggcuuuuaaauacuucuguaagaugcaggcaaugcauaggaaaauucuauacaacagccaaagauugugcucaggacuuggaguuagagaucagcccuuuuuacauuuuuuucccaguuacaucggcuagagauuugcucuuuuaaccuuuuuucucucuauugcuuuacccuucugcagaauagaaacucaguugguauuccccugaaugcuguuuauaauacuaaggugauguuuuaaauuggaucauuaaaaaauauguuuuuuauuccuucaaucuuuugugugugugugugugugugugugugacaaagcauuuaugguauacccacugaguccugauguggauacgggacaccaaguagagugauacugucccugcuuucaacaggcucccaaucccuuuauccuuuguggaaugguaaaguucaucuguauuuucuaacacuuggaguaggaagaggccuccuacucuggagcaaguugcaugacaguaaaauaaauguggauggagcuaaggacugauuaugaaugagccauguguccacaauucacucuaggguaaauaguacagacugauggacaacuugcuagaauuuggaaacaaauggugcacccaagaucaacaucagaccccuccuugcuccuucuacuuaaugcccguugauacacugauuuuuagcucagaggaucaccuuuguauccccugugccuaggaaagucccuagcaaauaacagacuagcaucaaauguugaaugugagcagaugcucagacauaacaauucucagauguuugaauaagagagaccuacaccuuggcaaucacagaggaaaguuauuggugggagauguguuuuaaugccacugagcauccaauuuuaccaugagauuugagagauaugucauuaucacaucuaauuccuucaguuuuaguuuuguuuauguguuaagagaaaugagccaucacggaaauaauugaauaguuuggucaucuuuagaugaaguuuuuucauuuuccuaauuuuuuuuuuaaaguaaggagcaaagucuuaaaacuacagaaacaacauuuucauuugaaaucaauagugcuucaagguugggggacauugauucucgcaacagggguagcaacaucaccucauuguuuucuuccuuugucucucauagaaaaaugaguauuuuucugaaucuuacaaaguaauucaugauccaaaggacuauuugauuugauuuuuuggaacuacauuuauuaaaaguacuacucaccuaacauuaccuuauuucaaggagauauauaugugugaguguguguguguauguaaauauaaauaugagggaaaaugaauguuuauggcuaaggaauuugaacuccacccuuccuuuucaaguagaauccauuaaaauguagcuuaaugaaauaggauuauuuuaaaaucaggaauagcauuuauaugcuagagauuauugcguuugacauuaagauguagauaguauaaagugauaaguuauauugagaaugaacuuuguuccugcuacaucauccuucaauaaaagccaguauugccagaaaaagaaggaaauuuacuaaguguguuuuauuugaauuuccagucauaguuuaggacaaggagguagauacuuuggaggauuuaaaaaacuucugguaauugacuucaucaugcacuugagaccagaacauuccugugcauccuggacucagagaguugaccugucugccagccccuuagccagcucugaguugaagcugagcuuacaguuuguccuuccaauccucugcgccaaacaaauaaaucacuauuuaugggcaagauugagcuucaccaccuauuggaacuucuguuccaguauuagagauuggcacauugguuuucuuucauuaaauucuuccucaugguggauauggaggcaggcuugggcaggcucacugggguucacagagcaaacuggaggacaugggucuggagagaagccucauccgccaaaguggggcagacacugggugggggccugugggcgcuggcgggaaguccagcccgccaggcagaacacacacagcagggaacauagaguugugcaaaaagugagauuuuuggcaggcacuuggcuccggggagguccugggggccccaggccagguuaguggaggaaguccaggaggcagccuguugagggcuggcuacuccacaucagcauuaauguggccuggcaguggguaucaggcccugcucuaugggcuggaauuuuggcaggacuucaacauuuguuccgugacauauuuucauaguaacauaccccuuggucgugaggauguguggaagaauauauauagccucuaccuaccucuacugcagauacuaccggcacugacuugucucaugccucuaaucccagcacuuugggaggccgaggugagaggauugcuugagcccaggaccucaagaccauccugggcaacauagugggaccucgucucuacaaaaaauaaaaaaguagccaggcaugguggcauguacugaggucccagcuacucaggaggcugaggugggaggauuucuugagccugguagguugaggcugugguaagcuaugauugugccacuccacucuggcuugggugacagaaugagacccugucucaaaaacaaacaaacaaaacauuuuuaaauuaaaauuaaagaagcugaccagccauauuggcuucaaugauucccaacaccaucccugaaaaacuguggccugggaaauaugaugaugugcuuguggcuuauacuuagaucacaugcugcacccuaggaguggugaucagucccaccuaagccaaagggacugaguggcuccccauaagggaauaggugagggaaaggaggauagcaauuaucuaaggugggaagccacagggaugccacauacagaggguugcagcugaaaucgccuuagccucucuugaugagguuguuaacccugguguagggaucauuugcuuggagaaaagaaugaaugaacaugcugguggcugguggugaucccuggagccaaguuccugagccuggaauauaaaguuaaggacuuugugucuggaacaagggaaauuccagcuguaagaagcugagacagauaauuaaaagugcuuauggcauuagucgugugcugaagcccucaauauugagcccaaguuucucagggcuucucuauuagaaguaaacugguuucuagaaccggggguugaauuaaacuuauagaugaggcagucaugcaagcucauaugaugaaacacauaaauggugguguucauacacauugaccauuaccaggcugguugguugauagguauguuuauguucagaaaaacaaacagccuccgaacugcaaaagagcuuuuuaaggaauaaaagcaaagaaugaagagggcagggagaaaaagguauuuagaaguggguagaucugaaggagucacagucucuuuguagauugguaggagguuaucaaggcuuucaucuccaaguuuccaauccagccagguuguuggugacuaaaaaucauuuuccugugaccauuugcuguuugguggaguguuuggaaugagcuaguuaaucccaguccaauucauaaugggcagguagccaguucacacaaaccaccuugaaaauccacacuaauugguuugucuccauggaauagccaaaaauggaauugcccauggacggacauuuucuucuacccaccccauucuuucaucucuccccacucccaccacuaccucuagcaggagugauuuuacauuuaaauagcaucucuuccccacucauuuuccugggcuauaaauuuccucaagcuuuuuuuuuuuuucugagguggagucucacucugucgcccaggcuggaguacaguggugcaaucucggcccacugcaccuucugccuccuggguucaagcaguucuucugccucagccucccaaguagcuagaacuacaggcacgcaccaucauguccagcgaauuuuuguauuuuuaguagagacgagguuucacuacuuuggccaggcuggucuugaacuccugaccucgcgauccacccaccuuggccucccaaagugcugggauuacaggcgugagccacuguacccagccuccucaagcuuucuuuuuuaaaagaaggaguggcuuagaggcaaggaaaguaaacugaauguccuugagacauuuucagggucaccaauguuuuuagaguuggucuuauggccaagaguagcaagaaagaaagcuaucugugaacagaacaaaaugcacuucauuuuuuuuuuuuuuuuuuuuuuggguaggccagggaagcaaauuccuagacaaagauucauacaaccugaaaauaguuucagacagaucuacuuagacacacaaaaacuucuaacagcucacagaaucaucgucaagaauggcuaaucaugcacuacugggagauacccaacaauggauaaaauucuagguuuccguaacuuugauagcuaguuccugcauaaaucaucacacuuuacaccuguacagucaguucugugccauccccacuguccuugagcuugguuaauucucugggcauuucuaagggcaagugggauugauaguauuugcuccauuuuauaaacaaccuguucagucggcuggcugggcagccaguagcucauuacagcacguuugugauguggagcugguuagaguccuggcuguguccuucaccagcugugucaccuuggucagccacuuaacuucucugugccucaguuuuuaucaguuaucucugaggugaagucucugcuuaauugaaaauuauauuuugaauuaaaaauauuuuuaguauuuuucagauuuuaauaguuuaacuucuuuguuugagacugagucucacugugucgcccaggcuggagugcagugccgcaaucucagcucacugcaaccucugccucccggguucaagcgauucuccugccucagcuuccugaguagcugggauuacaggcacgugccaccaugcccagcuaauuuuuguaguuuuaguagagaugggguuucaccauguuggccaggcuggucucaaacuccugaccugaagugaucuacucaccuugaccucccaaaguacugagauuacaggugugagccacugcuccuggcuuaacuucuuguauguugagaauauacacaagaaagacaagccuccaugaaaugauaagcucuaauacccucuuccuuuauuaaugugauauugcucacccccuucucccuucaacugaugguaaauuaaagcaauauaacucgguguaaauauuugucaaccuagaugcauuucuagacuuucagucugugaagacaccugguuauuuacacgauuuauacgauuagugccaucaucuccagacaggaugaauauuguaauacaagcaaguuuugcuaugagucuugacagucagaaauaaauaaucuuaucuauaacuacauuugucuguagaaugaggaagauagggaacaaugagugugaaauucuccaggccccccagguuacaagaaggaugaaggaaauaaaucucucaguaaguauaagacaaaaggaagucauuucuaaguaaguccacuggauguuuuucucgcucuauaaucacaaagucuagauaccacugaauggaagaugaccucauaggcuccucuuuaccacugguuaaaaguaagggagaccagccugggcaacauagugauaccucaucucuucaaaaaaccuuuaaaaaauuaggcagauuugguggugcagaccuguagucccagcuacucaggaggcugaggugccaggauugcuugagaccgggaggucaaggcugcagugagccauaauugcaccacuguacaccagccugagcgacaaagcaagacccugucucaaaaaaguaaagaagauuuuauuugggucuucuggccucugugaaaaucuaauaagugggaagugaaauuuacagaggauucaagcaaaaucaacaaguguuuguauggagucagucagcucaucucaaacacaccuggcucugagauguucauuuggguuucugucaugguaauuaauuucugaugcaaauaaaugaauacuaguguuaugaacucuauuuuuuuaaaaaaaaacagcuucuacuuuuuugaaaaaucuguguaucuuuggagaagaggaaggaaguagggauuaucuagaccaagcuuguccaucccacagcccuugugccacaugcagaccagaacaacuuugaauguggcccaacacaaauucauaacuuuccugaagcauuaugagauuuuuuuuuuuuuuugcgauuuuuuuuuuuuuuuugaggcagagucucgcucugucgcccaggcuggagugcaguggcgcuaucugcgcucaccgcaagcuccgccuccuggguucacgccauucuccugccucagccucccaaguagcugggacugcaggcacaccccaccaugccccgcuaauuuuuuguauuuuuaguagagacgggguuucaccguguuagccaggauggucucgaucuccugaccucgugauccgcccgccucggccucccaaagugcugggauuacaggcgugagccacugcuccugaucgcgauuuuuuuuuaaagcucaucagcuaucauuaguguuaguguauuuuauguguggcccaagacaauucuucuuccauccuggcccaggaaagccaaaagauuggacacccuggucuagacuguucccaaaaaaggcaagcaaaacuuagugacagugcuguguguguaaaucacuggauaaggucaaggauacuuuuaauuuagggagaaagaaaaguguguaaaccuguuccuuagucugggaaagaaugaagucuuuuuaaaaauuuuucugauuuuuguguuuuuguuguugauuugcaauauacgcuuuaagaauuuuuucuuaacaucuuuuugcugggaccuauuucucagcguuguucucucccuuuugagaggacggaguagguauagaauugucuugcuaauaugucagugcaggaaaauuccauacaaccuguugccuauggaagagauuggaaugaauuguagcaggugacagguuaacugguagcagaaaccuuuucugcaacauguaaacaacuucauccuuuugaaaaucggguccagguaguaaaagcuggcagugauuuaugcugaccgggcuuagagcuccucauaugcauauauaaaauaccucugggcucugcggggcuucuuaaagaacuacguuaguucugcuccuuccaccuucuuccucacccugcguugcugacauaucugaagugcccgcgagaggaaggagcaggauguggagccaucuggagccgggcaggguaagcacaggacaagcaucugcuggaaacuuugcagagauaucuagugcgcugauuuacuguccuuuggggaguccauguacagaacccagauucaugaggaagccggcaucuggcaaagguugggguacacaauugugcuugauuaucaggacauaugauaaaucugucuaggcguguacucugugccagauuguggauuucuuauuuggcccgcaucagccgucugccagcaaagcaauacaaaagugucacaacaacaaacaaacaacaaacaugccaaaaaaaaaaaaaaaccuagacuuagcauagugauaucaaaauauacagagucaccuugaaauaaaacagugcuucugagaauauagaagugaagagcaugcacuuuggaaucagaccacuaccguuccagucuggguucuagugcauaguagcugugugucugggggcaagucacuucaccucucuguacuuguuuucugcucuguaaaaagaggaugauacuaauaguacuugccuuuuagaguuauugugagaaauaagugaagguuauauaaguaaaaaguuuaaaauagcaucuggaaaauuaagcaccauauaauuuuguguuuguguuuucuguggaguacaugaguaugcaucaaagcuaacaacgcccacugcccuguuagucaaauaccuuugaccauaucacuucccuuccuuccucugccaacaccuccaccacucccacccagacuggcuuaguuuccauuguuccuugaguguguccagaauguugcaaccuggggcucugcauacaugcuuuccacuucccgaauuauucuucccacagcucccuuuagggagcuggcuucuccucuguccucagcccucaguuucaaugucacuucuucagagagggcauuucugagcaccccaucuuuacugagaugccacuguccacccauaagcauucucacgcccaccuguuuaguucccugucaugauuuguagccacaggugacuggcauuugcaggacuucagugucaguaagccacagucuccacggaccacaucccauuccugucuaauuccccuuuguagaucuaacauccaauuccagcagugccuggauggaaugagcacucaguaaacacugguccccaguaagaauaagcgacucacugacuacugaaggaggugcuuuuauagaguggauucaauauauuucucccuucugagguggucaacccugauuccuccuaaucccaccagucuccacccguuuuauuuacauugucauaggaaugaaagagaaguuaaggaaauaaucaaauacuucuuuuagagaugaggugcagccucaccuucugcauuuggcuaucucuguaacucuuugguagggggcuauagagcaggaagcagggccuauucuuucccaccuggcugguucagugaggacgcuugccauguggaugugccccaucuacugguugaauugcguggcugcauucuuaaugauuguaaugcccuguccauucagacucuuuaacagcagcugagacugugcuagaguuuguaucacacuuuauuauccugcuggcaacaaaauuaaccaugaagugugauuugcuuacagagcgcaugauugagcaucucuagugucuaaauuuucaucagugucguacaaauucuuuuguguggguuuugaaaguuugaagcuguaaaguuucacacuaauguccguggcuuaaaauuuauaguuuaacaucaguuuucaccguuugguuuguccccugugugcauuauguucaccagauuugcaucauuuagggauuaccucucugcaagaugucucagagauaugagcaccacaaccauuuuuuggucuucucuugaggaucuggguuuuuaagacaaaaacuucaaggccgggugcaguggcucacaucucuaaucucagcacucugggaggcugagguggguggaucacuuaaggucaggaguucaaggccagccuggccagcaugguaaaaccccaucucuacuaaaaaauacaaaaauuagcugggugugguggcacguaucuguaaucccagcuacucaggaggcugaggugcaagaaaaacuugaaccugggaggcagagguugcagugagccaagaucaugccacugcccuccagccugggugacagagcaagacucuaucucaaaaaaaaaaaaaaaaaaaaaaaagauaaaaacuucagggagcaaauggcauuuccaugcucuccuuucauacauaccccccaaaaucgggacuuaaauugccucauaaagcucaauaaguaaauuggagaagauagacuuuauuggcuuacuuaaacauaauuauuuuaaaauaacaaacuagucccuguguugauaaauguuuuauaucuuagcugcuaugucugaaugccuuguguaaauuaugaauuagcuaguaaauggacuucgcaaaggaugcucaguggggccugucagccaagggcuaaguggauagccuuucugacauucuacugcuuuuuagcuguuguguuggggacguagaugucuguagucucauuguuagggcugaaagauauguuuccaugaggacccagcagaguaauaguuccaguggguagaugaaggccagaugauuuggaaauaagcucaaaauguccugugucgaguuuggauaauuuuauagcccacauaaaacauuucauauuaaagucaaaucguucgucccuauuuggacuaaugacagcugcuuauuucgacuaagaaagcugcuuccagcaucugagaugaguuguaucugaccuuuagccccuuuaccuguagaccagggguuacuaacucagaugccuacaggggccagguaagugauguaauaaaugaaucaagccagcucagcuucugcuaauuugccgugagggaguacagcagguccagugcugccaaaucuucccauuuuucaugagaugccugaaauccggauuuuggcaugaaaucucaugauuugaaaauguuggcaauuaauuuaagaaaaauguuuagauucaacagggacuaaaccaaauauaucugccagaaggauacugcuugugauucuccaauuugcaaccgcagauagucccuggcaaagauuaucuauguaauagauacucuuuccuuuacaaaggacauacugaaucaccaauuauuugaaauagauuuagggggcacaagugcaguugucugacauggacauacugcauaguggcgaaggcugggcuuucaguuugcccaucaucugaauaguggacauuguacccaauagguagauuucuucuucucucaucccccuuccacccucccaccuugaggagucuccaguauguguucuuucacucuguauguccauguguacccauuguugagcucccacuucugagugagaacaugcaguuuuuggcuuucucuuucugagucauuucacuuagaauaauggccuccaguuccacccauguugcuacaaaaggcaugauuucauuuucuuucauuuuuuuuuuuuuuuuuuuuuuuugagauagaaucuugcucuguuacccaggcuggagggcaguagcgugaucucagcucacugcaaccuccgccucccagguccaagcaauucuccugccucagccucccggguagcugggauuacaggugcccaccaccauauccggcuaauuuuuguauuuuuaguagagucaggguugcaccaugugggccaggcuguucccgaacuccugaccucaggugaucugcccaccucggccucccaaagugcugggauuacaggcgugagccacugugcccagccucauuuucauucuaugugugugcauggcugaguuaguaucccaugguauauacauacauaccaccauuuauuuaauccaaucauccauugauggacacuuuucauguugaaaagauguuaaauacuaugcauaugcauauaaucaaaauauauguucaguaaaaccaaaaagcuuccaaaguaacaaaauagacaguaauaucucagaagaauaagguuacuggacacauuucauuguugaguauuuuucuuuuggcucuugcuuuugauagaaaaacccagaagcaauauauguguauacaccaugaauguacauucaguuggguguguuauaccuuuaacuugcacuacccuacaaggauucaccuaacauauccaucuagaagaaucccccucauacccauaccacacuuuccagauuuccaaaucaggaguagugagaagaucaugaaaccaucucucaauuauuguuuucuucuuuuaaaaauacauauauauuguguaguugcugacuuauucuuccucauuuuuauucuacagucuccacuuagccucccaaggggaagguuuugaacuaguggcuggguuuugugccucuguuuuugaacacuaaguucuaagacacacgucagagauauuguguguuugguuccagaccacgaaaauaaaacaaagagcacaauaaagcaaaucacaugauuuuuucugguuuuccaguacauauaaaaguuauauuuacacuauauuguagucuauuagguaugcaauaacaugucuaaaaaaaccucaauauauauaccuuaauuuaaaaauacuuuacugcuaaaaaaguacuugugaucaucugagccuuuggugagccauaaucauuuugcuggugaagggucuugccuuguugauggcugcuggcugaucaaguggugguugcugaaagugaggguagcuguggcaauuucuuucuuucuuucuuucuuucuuucuuucuuucuuucuuucuuucuuucuuucuuucuuucuuuccuuccuuccuuccuuccuuccuuccuuccuuccugccuugccuugccuugccuugccugccugccugccugccugccuuccuuccuuccuuccuuccuuccuuccuuccuuccuuccuuccuuccuuccuucuuucuuuucuuucuuucuuucuucuuuuuuuuuuugagauggaguccugcccugucacccaggcuggagcgcaauggcacaaucucagcucacugcaacuuccgccucccagguucaagccauucuccugccucagccuccaagguagcuggaacuacaggcauaggccaccaugcccagauaauuuucuuuuuuguauuuuuaguagagaugggguuucaccaugcuggccaggcugaucuugaacuccugaccucaaaugaucugccugccucagccucccaaagugcugggauuacaggcgugagccacugugccuggcugacaguuucuuaaaauaacacaacaguggaguuugccgcaacgauugacucuuccuuucaugagagacuucucuguagucuucaugaaagaaucguuuucuccauagagaaugcuguuugauagcauuuuaccuacaguagaucuucuuucaaaguuggagucaauccucucaaccccugccacugcuuugucaacuaaguuuauguaauauucuaaguccuuuguuaucauuccaacaauguucaaagcaucuucaucaggaguagauuccaucucaagaaaccacuuuauuugcucauccauaagaagcaauuccucauccauucaaguuuuauaagauugcugcaauucagucacaucuucaggcugcacuucuaauuauagaucucuugcuaguucuaccauaucugcagugacuucuucugaagucuugaacuccacaaagucaucuaugaagguuggaaucagcuucuuccaaacuccuguuaauguugauauuuugaccuucucccaugaauuaugaauguucuuuauggcaucuagaauggugaauccuuucuaaaagauuuucaauugacuuugcccagauccaucagaggaaucaccaucucugucagcuauagccuuauaaaauguauuuuuaaaauaacaauacuugaaaguuaaaauuacuuuguuuuuuugagucaguuuuguucuguugcucaagcuggcaagcuggagugcaguggugcugucauagcucacuguaaccacaaacuccuggucucaagugacccuccugccucagcuuccugaauaucugggacuacaggggcaugcugccaucugggacuuuuuuuuuuuuuuggcggggggaagucuugccguguugcccaagcuggucucgaacuccuaggcucaagcaauccuccugccauggccuuucaaagugcuaggaugauauaggauuauaggugugagccaccaugccuagucuggcugaauuuuuugauuauagagaugaggucuugcuauguugcccagguuggucuugaacuccuggccucaagcauuccucccacuuuggccucucaaauugccaggauuacaggcaugagccacugugccuggccccaaaauuacuucuugaucuaugggcugcagaguggguguuguguuagcaugcaugaaaacaacauuaaucuuacacaucuccauuagagcucuuggguaacuaggugacuugccaacgaacgcaauauuuuaaaagaaauuuuucuuucuaagccguaggucucaacgguaggcuuaaaauauucaguuaaccaugcuguaaacagaugugcugucaucuaggcuuuauuguuccaucuauuuauagagcacaggcagaguagauuuagcuuuaaagcuaaauauacagcuuuuaaguuaauucuuaaggguccuaggauuuuuggagugguaaaugagcauuggcuucaacuucaagucaccagcugcauuagccucuuaaaagagagucagccuguccuuccaaaccuuuacaccagucauugauuucuguucccuagcuaugaaagucauagaaggcaucuucuuccaaucuaaggcuauuucauuuacguugcaugucuguuguuuuguaaagccaccucaucaaugaucuuauggauaacuugcugcagcuucuagaucaguacuugcugcuucaccuugcgcuauuaugauauggaaauggcuucuuuuuuaaagccucaugagccaaccucugcuagguucaaacuuuucuucuguagcuuccacauuucucucugucaucauaaaauugaaaaagccuuggccaggcgcgguggcucacgccuguaaucccaacacuuugggcggccgaggugggcggaucaugaggucaggagaucgagaccauccuggcuaacacgaugaaaacccgucucuacuaaaaaaaaaaaaaaaaaaaaaaaaauuuagccaggcgugguggcuggcgccuguagucccagcuacucgggaggcugaggcaggagaauggcaugaacccgggaggcggaacuugcagugagcagagaucacgccacugcacuccagccugggcaacagagcgagacuccguccccccacaaaaaaaaaaaaaaagaaaaagccuuacucugcuuuggcuuaaggggaauguuguggaugguuugcucuucuaggcagaccacuaaaacuuuuccaaaucagcaauaaagcuguuucucccucuuaucauucauguguucacuggaguaacacuuuuaacuuccuucaagaacuuuuccuuugcauucaugacuuggcuguuuggcaugagaggcauagcuuucaaccugucaugccuuucaacauuccuucuucacuaagcuuaaucaucucuagccuuggauuuaaagagagaugcggccgggcaugguggcuuacgccuguaaucccagcacuuugggaggccgaggcggguggaucaccugaggucggguguuugagaccagccuggccaacauagugaaacccugucucuacuaaaaauacaaaaaauuagccaggcaugguggugagcaccuguaaucccaacuacucaggaggcugaggcaggagaaucgcuugaaccugggaggcggagguugcagugagccgagaucgcaccauugcccuccagccagggugacagugugagacuccgucucuaaauaaauaaauaaagugagagacgugugacucuuccuuucacuugcacacuuguaggccauuguaggguuauuaauuggccuaauuucaauauuuuugugucucagggaacaaggaggcccaaagagagagggaggggaaauggcugguugguagcauagucagaacacacacauuuuucaaguucaccaucuuaauaugggugaguuuugugacaucccaaaacaauuacaguaguaacauaucaaagagcauugaucacaaaucacccuaacauacaauaacaauaaaaguuuugaaauauuaugagaauuaccaaaaugugauagagacaggaauugagcacguuguuggaaaaauggugccgauagacuugcuuaggguugccauagaccuucaauuuguuaaaaacaaaaacaaaaacucaagaucugcaaagugcaauaaagugaagcuaggcccauauuuacaacuagcugagcagaccugccacuuaguuugguguuuuagguuugagaugauuuccgacaacuuuacaugugcuuagcauccuaucaaagcaguggggagagaggauaugacugcuuuaucuuauccagaaugcagcaaucagaaaaccuauaaacaagccauuuuaaugucagcauagcauacauauaaguucugcauuuuaagguuuaguaguucauuauuugaauuacucauugcaaugggcaccaaaaucuuuucagugcucauugcuuugaaagauuucauuuauaccuauuucuccauauggcaucaaaacugcugguaaaaaaaaugcaagugaaguucagcagcaucuacuucagauucagagggcuauguucagguucuaguuaugcuucucuggcuauauaacucugggcaaauuaucacaucucugucagccuuggugugcagcugugaaaugggaccauaguauuaguguuacagauugugacacuuaggacgcaauacuguauguaauuagcauaguguucagcgaaugagugugcucucaacaguguggcuguuauaucaucauuaucauuguuauuucuacaugcuaagguauuauuuuauaaacauguuuuauauuauuggcaacaagccuuuccuuuaacacuuaccagcagcuuucuuuuucuaugcaggacuuugauuuaaagaugaaaaauguauuugguggucuuuaaauauauauaugguguguguguguauguguguguguguguuuucucccccuacugcccucuccaacuuuuucuuccaguuuuuuucuaagagauuagcagccuuaaaguuagagguggcaaugguuuggccuggucuaccuucacaauaugauccuuacuuugcugcaucggaggucccuggguagguccuguaaucccuaaauuagucuaggaggcagauggaugaaaauagugucuuugcuggaugaagcccaguuguggcuuuuccuuuguucccagcuccaauccaaacuaaugccuuaauaacugaaauucccuucuuuaccucucuuaccuuaacaacuauuagagucaaugggaaggacuugucaccauagcagaaagaugucaucuuagggcuucuccuggccuguaggaccucggcccaggccucauagcagugaguacuugaagaagggcugaggccagcgcuccugggcguucuuccugugagcagcuuccuccccugaguguaccaucccagcagaagcucacugcuacuucaucauaaggcugccucuuucugcaauuaagucauuucaguauuuucuaacaugguuuuccuucuucguagagaugcucaauguuaggacaaaacacaggcauucaaacugcucauagcauuuagggaguuagggaauuuggcuuuuaauuaccaucaaaaugugauuauuuagagacucagccccauuucuacagagccuguagaauuuugcggcaauaggaaaggggcuuauaaauaagugcuaaaaaugugaguugccagguuuccagggaagagcagauaagaugaacuagaacaacuugaaguaucuuucauuaacucuaaucaaguuguuaaggcucuuuucugaugcagcuuuacuaucuguaacgugggucaauguccguugccuuaguuauugcuuagcagguauguggaaucuggaaugcucugauaugaucaacauguuuaacugaaugaaaguguuuauccauccagacacgugauucuccugccucagccuuccgaguagcuggaauuacaggugcacaccaccauaccuggcuaauuuuuauauuuuuaguagagaggggguuucaccauguuggccaggccagucuugaacuccugaccucaaaugaucugcccuccucagccuccccaagugcugggaucacaggcgugagacaccaugcccggccucagacauccagucuuuaaucauuuuuccaggcagcauggaguccuaaccuuuguuuugcaaaccauccgauggauuuagucuacaucacagcaaaauauuuuugacuuuuugagaugacuaauuaugguacacauacuucguuuucccaaaaguacuuuaaauuucuugaugacuuuugcaucuacugucagcacugcucaaagcacugcauucugaaccccaguccugcuggacacuuagcgcuuagguuucagcuucguccccacccccugacuaggucaaguuccucuaccaugugugcucucacagaaccaugagucucuccuuggaacuacuauagcuguugauuuuauuauaugauuaauuauuuacuaucagucucccuacgcaagacagugaauuccauaauucugaaugguaaaggaacaggauuuuuuauuuugcccaccauuguauccugacaauagaaugccuggugcuuaguggguacguaauaagugcuauugguaaauggauggauggaugaaugaauggaaucucauugucuccugcaguauuuguuuuaugucucuucccaauuuuguccauaugggcuuaaagaccugcacacauaguagagacuccacaagcuuauuagggaacuaaaauucauguugugggucuuggcaccaaagccucaugauggauugggaaacuaagagucauauaaagucuuaggaagaggccuugaaguuucuauguuccauuggugguccuggcugagauaaauauagcaaaugaacaggcauuuauuucucaccuguucuaucaaguccccaaaaccuggaaguagugugugagauggggcugacccugggaaagauguuaucucuuauucagagccacauaaaagcucucuccccaugucaggcacaucuuugguuagaagacauaaauuagucccuugcauuucauagugguucucauggugucccucaugacagagcucacuuagcuagccaaugggacaucuccaaaaagcauuauggaaaggaggcaacgugcaauuguguacaauaacuuggguccugaagucacaaugccucaguucaaauuauacccaccugcuuauuaagugaauuuagacaaauuagguguaauccucaauuuccucuucuacaaaaugggagauauaaugcuacuuacuucauaggauuuuuggaagagcaaauggccaaauggacauaaagugcuuugcagagaguugggcauguaauaaguucucaauaaauguuagcuagaguuauuaccaccauuuuuauucauugaaggaguuucauugcaaucccaagccagucccuauggaugcccuuccauuccaacccuuuucagacuauacuggggcccauguuguccccugcccuuucagcccacaugacuuuggcccaggcuuuuacuaccagggcccaaacacaguguccaagaauggcaccaauuauacugcauauugcuguauauuauuuuauccagcacugugaaggccaaccugaacugccugaaaaaucuuugucauuuagugguuuaggguaugugcacccuccauacaaaugcauuaaauaaauuaaauaaugguguguguguguguguguguguguguguguguguccagcuaaauugcacugcuuucuuagaucauuuaagcacacuuaaucuaauggaacaugguaggauuucagcagcuucugaauagaaguuggagagaaaaaaaaaaauccgaaacguggcaccaacuaaaacccccauguaguuauuuaaggcagcuuaagcacuucuguggaaacugggcuccguugaagaaauagccacuccucuuacagaaugaaaccucacuuuuuuuuuuuuugucuuuuuaaaaauucuuccuuguauuuuuagauuuugggugagaaugggacucuaaaucuauuuucaagcuuucuuuuccuuucucugcucacucagaauuauucuuuuuaucuugguucugccccuggugauaucuuggguaaguuacuugaccucuccuggcugcuuuuuuucaucuggauauuuggacuggaugaucuuuguggugccuuccagcuguuaacauuuguuugauuuuaugauucccucccuuguuauuacagaaagcacaaguguugugccuuaagcauaagauaggaaaguaucccuugaucaaguugaaacaucuccacuuucuaaguuccaggacucuuaguuugagcuuagagaguuacaguuguuuccaggcaguuuuuugugcuaagggugguuuggguuuuauuucuguuuuucuguagaccuuauuggauauaugaccauuuggucuugguagauaauauuguguccugacacacaccaauggucuacccuugggguguuuuggaagccugcaggcaggguccugaggcugccugagucacuguuaaugaaccaaacugccugaaaugcuccaaugguugacuuuuggcacuuggcagaaaaauccuuuucauguuaguuucaagguugucagauaucauuauccccaaguauuaaaaauuucaaagaaaggaggcaguguguuugauuuauagaauaguuaucuagcuuuagcucugacuuggcuuuggaaaugguuuugcaagcacuagaaaauuaaauccauuuuuuauggcacuacaagguauuaucucacagcaaaugauaauuaaacaccugugaaaucaauuagcccuuuaagcagggaaaaaaaguuuuccaauuauguuuucacaccuccaaaacuuuuauaauuccaaaaccaacacuuguggagagggauauggucgacuggccguugcuggguuaacuuuccauaaagauuaucccuaaauuuugcuuagccuuaauccugaggaaggcaguuugugauaccagcauccuuccaaagagacugcaaucgccuuuagagcugacucuuagcagcuaucuaucugacacacagcggagcugucaacgacucaacaaaggaaguuacucacuuuguguuuugaugccaaguuuuacuugacaguuuauuuaaaagccaagauaccuuaauggaaaccaagcaacaagaauuccaugugacagaaaugcugucccauuaagggccccguagccaagaguucugagccaucuacauuacaaauucauacucuaaaaacagacugauugguuaauagcugaaacccaauacaauggaaaacugggacucauggccagccauucagccccacaguaucauguguguuuaaucaccggcuuugguaacaaauuagcuauuccagaugcuucuuuuggaaaaugaucuauacuucugaagcaguagauggauuuuggguauaugccauaauaauuugggacgcaaagaaaaggcaaaagaaacauaacaaugccaggccuuugacaucuucugcauuuuaccucauauguacaaaaacuguuccaagaaaauuuuuggccucauccuuucuaauauucauaaaugcuuuaguuauuaauuugugcaggguuucauuguaucacuuuacauaaacaucucuaaagauguucuuuaagaaauuucuucugcagacauuuuuauugggcucuugcuuucauagcagauggcauuuggagaacuugacgaaucauaccauuaacuagagagagaaagcuagcgucguauaaaacaaagaugaaagaaaacuucucuauauccuuuuagaaacuugucauaugaauuaucccugcaaacauugccagcaguucagacacuuuaugaccuaggcuuuauaaacccaugaggaauggggugaguguugaauaaucugacauagguucaacaaauauuuccuaaaagauuacugugggccaggcauaguacagggucuggggucacaguggugaauaagaacaggaacacucccuucucucaugcaguauacauuacauuuggggagaaagaagguaagccaguaaaacaaauacaugugugaauucugaccuugguaaaugccaggauggagaugaaacagggcaacagaaagagagugccaggagcacagguuggucugugcuggccucucugagaaggggcuauuugaaugcuuauaggcagcuugagagacauccuggagaagaauuccaggcagagggcacagcaagugcaagugcaagagauagaaguuagcauucucugucaagaaauugagagccggacuuuguagcuguagauggugacugaggauggggcagucagagaugugggcagaggccaguucucaugggacccagucggccaagguguagggcaugauuauuauucuaagugccaggaggagccacuggaggguguucagacugggggggugacauuugaaaguugucuuuggcugcucuauagacuauggacugcaggaagauacgauugaacucauucuguuuaaaacuaguaagaaccagaguaugguuucuguugcucuguucaugcacgcuugagcugaaggaggaaugggauuaaggagguauaggaagaagggugugaggagacucuggcugucacugaauugcaaaauccaugaaugggcagcuccuggaguacucuugcuucauggcgucccagugcucagagugcuaccugacauguagggccugcucaauacuccuuuguccagugaguaaauaucagggcaugaaggcauccuuugggccaucugguccaccucuccucaauccagugcuuaaauuuucuuucugucccacagccucuuuccagaaugagagugccagggagcuagcuggcucugucugcuucucaaaggaacugugggaagcauggccagcuggaggaggaggagggagaggugauucagcuccacagaccaucuuccccaggguacuguuguacuucugccuaaggaaauggcagaaucuagacuugugggccucucuaaucccuaaggacucaaccuucaugcaaagauauuccuguaaaucaauaauauguggcaucaaaucuucaaccauaacccaaauguuaugucccauggauacacccauguaucucuacauuuaugcauucacauacccagacgggaaagauuaaacuuuccauagacaacuagcuucaugcagcguucauaguaaguuggguguucuagaauuuuuugugaaugugcuauaucagccuacacagaguucugaggucuuguuuguguauucgguaccaaaggcucaggagugagguggcagcccugacugucaaagucacaaggcagaggcuagugaugcaacagugggagagaaaaugggaaggugagguugguggcaucagcugacauuccacaaacugucauuggauucucaagauauuuuauaaccacuuaagugcaggggccagacaaaaggauuaaacacugacaagaaugcaggucacgggacagacucugcacagugccugcccugggggugagaacaguaggaaugccaaacauccuccuaauccgaggccugauccaggcuggccuugcuggaaaggauaucuuggaucaagaagggaaguggucagacauugguucgagcucaguuuucugugcagagggagggagucauugcuuuuuggacuggugcaggguuugucauugcagaagccaugaggagguucuacagcuuuuuauucuucaguucagacauggaggaaggccaggagaagguucaguuugaaccgcacugugcaugcauuuaacuugauuuacaaauaaugcuauuugucagggcuggugaaacacaaauuuucuacccucaucagcgugcagggagaaaaugacauuuuuaacaagcugccagaccuguagaaauaaaaacagagaagggauuuuaaaauguacaaaaggaagacuaaauaaauaacacgauuuuucauuccccaaguaaauugggcuugguguaagcauaggaaugaacucauucuuggaagaacccagcauaaaucaagaguugggcauguguuuguuaaaguggacauuguuguaaugaagggcuugcaucuuaucuuuguuaucuucuugcuuccauagccccuguacacuuuaaugcaaauugguggacacugagcaccuuacauucauuuaacaacucuuuuuuugaguaguuacaguaggccggcccuuaagguaguuguugggucaacagaaaguaggaccaagguccugugucccggaauccaggggaaggaaaugagaaaaaugggcaacuuaauacagagugagcaauagagaguuagcacaggguucccaaacuccagggaucagggaagccuuccucuaggcagcaggaguggaaguuaagaaaaagaaggaaagaggggcauguagggaagaagugcucccuccacagccagccuccugggacucagauuguccuagguggggagcugacacccuuagaacagacacacugcgcugcccaccccuauccuggucuucucgggcugcuguccauacuuccuggcuccauuccacuuaaccagucccauuggcuuagagccuggcgaaagguaguuaaugguaagauaaugaccucaggcuuccccaucaccauugggccugugugugacucuucuggacccauuuauccaucugaguucacuguugcugcuggcucuuuuauuguuaauccccucuuuucccccugcacccccucccugccacuguacucagguagcccuuuauuuagcauuuucaaaaacguuuuguuuugaaccagagaauuuaggcccaugugucuuggaauugcauuucucugagaagaguuuuggaaguggguauugcuguguauaaaagcuggugcuggccaggcacgauggcucacgccuauaaucccaacacuuugggaggccgaggcagguguaucacuugaggccaggaguucaagaccagccugaccaacaugaugaaaccccaucucuacuaaaaauacaaaaauuaacugagcaugguggcacacaccuguagucccaccuacuugggagucugaggcacaagaaucacuugaacccaggaggcagagguuuuagugagcugagaucaugccacugcacuccagccugagcaacagagcaagaagacucugcucaaaggggggaaaaaagaaaaagcuggugcugcaaaaccucuccucuuucagaaagcuuccugagauuaaugucaugggcacgauguauuaaaugucucuuauuuucaccuuugcuggcaccucguuacucuuuccuccuagguagguugagagaugacagagcuggucguggaucccauccuccuugcacaaaccgaacaaaaccugugacacuuuacuucaucaucuguaaacuggggucaguagcaccuauucuccaugauggugguaaagauaaggcacaguaaagauuacagauugugcagcucagugccccacccacaggaaaugcuuaaaaaguggagguauuguuguuauuauaauuuauaucuggccaggcaugguggcucaugccugucaucucaauacuuuggggacugggaaggaugugggaggaucacuugaggccaggaguucaagaccagccugggcaacauagcaagacucgucucuauaaaaaauuaaaauuuaaaaaaaguuuuuaaaaaguuguuauuaauagcuaucuuuuauuuauuuuuuuuuuuuacuuacuuuuauauauuagccauugagcuguuauuuaaugagcaggaauucagauggucaucuuuuaccccucuugaaguaugagcuacaccugguacauguuguguucauuaauauacacagguagcaauuaccacuugggcuaaguuuaagguucugaacugucaguagacauuuaaccuaaggaugggggguggaguuuagaguugauaagagauuaugaccuggcguguucagucaagauguuugaguccaaggacucuucugacucccucaucccugugaaagacagguguaucuuuccccacguccccagugguugugaggcugucaugagaucauggauaugagagugaaugccucccauagggguuucaugccucagccccagcccacaaaauguuaucugccucccuucccuaugcugaaauggauuuuaagaggacaugaaaaggagacucucuucuguggaaagccaagaagugugaaagggugaauauaaauuccuggcccugguuuuagccacgcacugcucucugcgguggacagcuugggaucagcagccucagacugaggagcgucacaaggaaauaaauucuuaauccuuggcaugacuggggagguggggagugguguggcaguucuaacagcaggcaaugcucaaggcaaaaaacugucuugaguaaggaauuguaccaccuccaaauagcgagugccuuccugcuuggggacgccaagcaucccugaagcugcagccaaccuggucagccagucccagagccuagcacugcacauuugcauagcucauuuguacuauagcagcucauuugugugcacagagacucugugugaguaggugucauggagaaacuguggcuccuuaaguccagagaauucucaaagacaccagggaccuauacuuuuccauauucuauguuuucaagucuccuaauugagauggaacaguggccaguuggacccauuuuccagcuaaaagauugguucccacuuauauauguuucucaguucaaaucuuugccuugggcaauuccguacgacugcaugcuguaaacuucaguuuucucaaaaauaacugaaauuuuaggccagguaugguggcucacuccuguaaucccaccacuuugagaggcugagguaggaggaucacuugagcccaggaguucaagaccagccugggcaacaaagugagaccccaucucuacaaaaaguuuaaaaauuagcuugacauggugguacaugccuguagucccaccuacucaggaggcugagacaggaggauugccugagcccaggaggucggggcugcagugaacugugaucucaccacugcacugcagccugggugacagagcaagaucuugucucaaaauaauaauaauaauaauaauaauaauaauaguaauugaaauuuuaaacuguuaaaccuuuaaaggccaaggaagggucuaaggcaacaugguuaguaaauagaugacagaguaccuucuuaaacugagcuccugguagugaucuggggugaaguuuugaaugggagagaaacagcccuuuuaaauuggcaacgaauagcccaugcuugaaacuaggugaacugcuuaggaccuggcuucauaagacaugucaguuuuagacacugcauguuguaugggcugaccaaggaggcaaugugauguaauggaaagaaaaugggauuuagaaugagaaauccaggaguuggaacacaggcugguugguccuagcugugaccugcauuggaaggguuuuugaggucuccaaacuuaauugcuucucuaugaaauuggguuauaugaaguccugagaacaccauugguaccaugucauucuucugcucaagcccuucagugacaccccagucaccugcaagggaucaucucugagcucuaggagaugucauagaaagccuuccuaguggcaacccaccaguaacagcagcccacacccccauaccuuccccuccccaaacugggugguuucucucaccuuggugccuuuguuccugcuaugcuaucucuacccccaggaauucccaucaccuccucuuaccccugugccugguugcuucuuguacauccuuuaagauuuagcucagggucucacuuccuccaggaggccucccugccuacauguggccauugcuucucuucucuguauaacacccaccucuaccucauguccaauccuagcacuccucucgcugacuaaucaucauuugauaacacauguuguuuauucuggacagugagcucccugaagagugccugacacaugguagacauucaacuaaugcuuggugaaugaaugaaaaaggcgcaaggaggugcucaaaggauguuaauuucauuucucucauccccaugcacuuuagagaacuacaacagucauaaauuauuuuuauuuucuuucuuucuuuuuuucuuaagggauauuauucaaacuuguguauaaggaaagauuaauuacuuaugaggauggggacuggagggaguagaucagcuguagauguuaaguuacuuuaugaauaaauacuugagacaaacugugacaacaucauggggaggcuagaauugugugaguacagagaugagaggcuggaucacuuguuucuucccuaucgucuuugguuagcaaaaagcagguucacuuggcaaauaugcgugcuacagagggauugugggagccacaggaggaccugugagcacagugcaccagcaacauccuugucuauguagcuuuugauaauaaggcaaaagccuucaauuagaagcugcuguucuguugugauucacagcuucuguuuccauuuuacuuuaaagggucuguuccacauuugucucuuggcucugucuuugggauacugguguaguuuucauucuuuuuaauuguuacuagggguuuuaaaaauguuuauaucccucuuauucugauauaauuuaccauaauaacuugcaauugcauagugcuuugccauuuauauucaauguacaugauuucauuugaucuucaaaacuuugagguuuggagaaguugaaugauuugcugggguuacacaggaagugguagaucaagaacccaaauuccuuagcccagauuuucuaacuugaagcuggcuguguuuuccauuauguucuguuaucuuccuucagucauaaugauaauagcuaccuuuuaugguuugcuuauaauaugcucgugcuuugguuaaaauguaucacuuaauccucacaguauaaguauuauccccauuuugccaaccaagaaacuaggauuaaacaaauuaaauaacuuucucaagauuacucaguuuauaaauugaaaagcuggaauucgaacccagguuuugcugugucugaagcugccuaaccacuaagcuuuuaauuacuaagcucuuaacuauggugccagugguucugaaaauuuagggugcaucauaauuauccagagggcuuguuaaaacacagaauucugggcucuucccccagaguuucugauucagcagguuugggugaggcugagaauuugcauuucuaccaaguucccagaugaugcagauguugccacugauuggaagaacacacuuugagaaccccugcucuaugcuacacucccccaucuuucccaguugcacagaauggcugccagcaaaaauguguuuccuacagaggggcaggacuucaauugugcauuauugcauaguccauuuuaaauggggugcaucccauacauuguucaauacaacuuuaaguauaaaaugauuauggccauagagugguacuagugucuagguuaaauucaaggucaugucauuuuuauugcauuuuucuuuguagucguuugugaaaauucuucuaccuuuuguccuucuuuaccuacacguggggaacuuaaugcccaucugaaaaggguagcaaaaccauuuauuagaguggcaaauuaucugggguuaguugucucccucaccuacuuaccuucuugcuuaggauaucauauguuucuuuuaaguagugugugauuaugugauucacauuucuaaacauaagaaacgagggagaauuaguccaucuuaaaacacuguguccccccauuugaccucucaagucucccugucuuuccuccuccccccaaccaauggcaaccucuaaguguucuuuaucccuguaacuaugugauuucaugaaugucauauagaaaggauucaacaguauguacacuuucgagggugacuuuuuaaugcagcauaauuuccuugaaguugucguguguaucaauaguuugucccacuuuauugcugagaaggauuguaggcuauggauguaccacaauuuguugaaucauucacacauugaaggacauuuggguaguuuccaguuuaagguuauuacagacaaacugcugugaacauuuguggacaaguuucugcgugaaaauaaguuuccauuucucugggauacaugcccaagagugcaauuacugggucauaugguaaguccauuuuuaguuugaaaaggaacugccaaacuauuuuucgaaguggcugcaccguuuuaccuuccugcuagaaauguaugaaggguucuaaucucuuuacauccucaucagcacuugcucucaucugucauuuugcuuauagccaucccaguggguguaaagugguaucucauucauuguaguuaugauuugcuuuucccuagugacuauugauguugaauauauuuucauguguuuagcagcacuuugugugucuucuuuggaaaaauguuuauucaaauccuuagccucuuuuaaaguuugauuauuuaucuuuuuauuguugagucagaagaguucuuuauguauucuagaugaaagucccuuaucauauaugauuggcaaauacguucucucuuucuuuuuuuuuuuuuucuuuuugagauagaguuucgcucuuguugcccaggcuggaguacaauggcacuaucuuggcucacugcaaccuccaccucccaguuucaagugauucuucuuccucagccucccaaguagcugagauuacaggcaugugcuaccaugcccagcuaauuuuguauuuuuaguagaguugagguuacaccauguuggccagacugguuucaaucuccugacaucaggugaucugccugccugggccucccaaagugcugggauuacaggugugaaccaccaugcccggugguucucucuuucuguaggcucuuuuucacuuucuugaugggaccuggggggauggagagcccagccuuccugacugcacugccccagaguaaagcuccuguaaggcagagcuaguagggguuggucauggaacaggucagggaccagaugccacagacucucaugguucuugccaagauuugguagauuuucuugggugacuguuucucuauuugucauuauccccuuaggacaauucucagagacuuaaaauguuuuuaugauuguuacuaaauugcuguuuugcuggggagaguggccacagacuucuuuguguaucuucugaaaggucggccuucuauaaucuccucuuauaaugcaaauacucccaggagauguuuauaucuuaaauucucaucucaucagcauuuucucauugucaggugcuucuuugguagcuccagcaacuagagaagaccuucucuggacucuaucuguugaaaugggacagugucugaaacauaguauuucuugaaagaaugaaugaauaaaugaguggauuuaagcaucuacaaggagguugaugugcagugugaaagagcaucacaaugggcugaguaggagaggaucaagcacguggucaaacuagaauaguugucugcccacuuguggggcaucauucuuccuucagguagaacauguuaguaauucauagauugacuguccagagaguagaauagagaggcugguucacaggcugagcaugcauagaaaucugaaugaaaaucauuguucuaagguaugaguguacauguucuguaugagccucuaugugaauacacacauauguuagacaugcacugcauacauaugaacagauacguauguauauacauauacacacauauauggguauggaauugugcacauauacacauacauauaaugguauggacaccuaagcagugggauauucucaaaggacauuccucuuucuuacccaaaaaugauaagauaaagaguaaucaaguauuaaaacugaaucuauagucaucuagcccaaguaguucauuuugcagaugaggaaacagauagaaaauucauggguuuuuuaagucucacagcuaccuagugguuuccuaacuccugcaaggguauucuucccacagcuccuauuaccuauuaugugaaggaauacaagcuucgaucaugucaaucuuacuugcuauaucagcaaauaguccuucuauguaaccauuuaagcaacccacuauaacugucauuugaauuuuuccuauaaguuuucugcccuuccucuuccuccacacauucccuaaaguaaauucugcaacuaggaacuuugaaacuuguuacaaugcagaacauuaauaggauuuuacauuuuuaguaggcuaaugaugagaaugugggaccuucugugcuagucccucagggguuucuauucuggguacuuauuaaaccuugcuguagucugaaguauauucgaccuuucuguauuaaaaaaaaaucagcuuaaacuuuaugcauauauuuuugugagugugugugugugugcauauuucucucugcuccaucuauuaggcagagauuaaaacauuaucaacauuugaacuugaagauauuugucaaccauuuuccuguguuuggugaggaugaagaaaucacuaccaucuaauuuauuuuuuuuuuauauuuaacuaaauucaagccuucuuaaaaaucuuuuuuacuuugaagucuauuuugcaauuuaauuaaugcagcaaggguuuuagaaaauuuuuacucucaauggagauaaucuuaauccauucacggugaccuuuucuugugcaaauuaguuguacacgcuuguuuaagcaaaugguccuuugcaugaugucucuucuuaauggcggguuuauaauugaaaauuggcuuacucccguaugccuaguuuguaugagaauauaaaaauagauguggacuuuaaaaauauaaauguauauaccaauauacccaaaaagaagagggaagaauucagugccuuuaggcuaugauuaaauuagacuauuagagucagaaagugguggugacauaugcuacugucaaagucacaccugucugcucagcauuggaagcucuugaaaaaugagagugauuucaucuuggcucuaagaaucggggccuuuacaggacaugagccaucucuacuuucccaaguuuucuuaaacucauaauguacuugaaacugccuguguaggaauguguuugugguaaucacuuuaaaagugacaguccuaaacaaaaugaaaugcuuuuuaucuuucuuaaacuucacuggcauaaagaaacagguaacacucauauuuuguauguuuuuucgaaaagcaaaagcaauguaauaucauuaaaugguauuugaguaaaauaaauucaucucuucuguagaccaguuuccuguacccccuccuaguucagguuuuuuuuuuuucuuuucuuuucucguuauucuuucuuucccuuucuuaggcuagcauccuucucucucaccuccucuuucuccugugaguuaugucagccauucuuaaacaggaauauuuuuccuggguaacugaacguucuugguuaaguguagaaacuccaucuugaaagagaagacaaauguuguuuugugccugugauugagguuuucugaauaguuuuuaauagcaugguuuugaagggguggggaacaagaacagucuuaguuuugcugaaugccguauuguuaaaggagaaggagaagcaccaguaauuuucucuucuucuuuuuaagacuauggggcaacauauuuuaucaagacuuaaaaaucugauuuuggaagcaaagacugggcaaaccaaauuguugccagaacgaucagacuugucuuuauauauacugcuugcaaaagggauccuaauugcuuuguccaacaugaugauucauguuuacucuucaugcagcaacccaaccuccuuccucaaaauggaaaagugagagcugccugcugguggcuuucccgaguugcuuugcguaaauucaugcacaugggcgcccaccuauggucaauauccccacauucgcaaugagucuucauuugcuguuuacuccucuucucuuucuagguaugauuaucgggaaaugcugcacaaugccacuuucugucugguuccucguggucgcaggcuuggguccuucagauuccuggaggcuuugcagguaagaggcccuggagccuucccagaauagggcugaggaccgaagccagauuaaguggguuuaacauuaucaccucuccugggauagcuaaagagaaggugugguuucccuugaggaucugaaaauauuuucaagaaaaucuaaaacauuuuugacaagugagggguggagggaggauuuacucaguaauuuuagauguaagaaauuaaaugguggauucuucugggucauguuuagaaacagaaggcaaaucuaauugccagcuuggccuaccaggcagccuagcuggacucuaaaaagcagcccuacacuuucccuuuauucgugguacucucuaaaagcaaaauugucuuuucugccugcaucuucauugucucucaguuccuuucaauuuugagaaugauccccagcauggugguacuacucagaugauccagcucuuccaaggcucugcaguucagagguccuggcuccagcccuggagccuuuguggugggaguuucucagcucaucaaccucacucugcagaaauguccucuugagacagucauccacauuucccaccuggaaguugcaaccagccuucuuugauugcagagagaaagcaugcccucaaccucucucauccuccauuccuugacccuuugcuacuauguucuuuccuccucuugcccugcaccaugccuaaaucugugcuuuugcugcagugccucauaacuucuuaucucugccaucuuaacugcaaaucauucugucaugcccuccaacagaagagcuuccuucucuggaaugucuuuuccaaguugcucucuguguguguucugcauagcaugccaucacuaauguucuuguagccuccugggaugcugcauaaagaaaaauuguucucugauuuggauuaugaguuauuuggaaucaguauuuugucauuaaccuaguguuucuuggcuguuuauuucccggcacagaccauaaauugguaugacugugguuuagaucacuccacacugaaaggaacaaaguucugguuuggguguuugcagagcaagggaaaugugaacacucuauacugguuaaguccacgaacugcugccuaggaaugcugagcuucauucugcucuuuguugcucaugacauugggguaaaccacuuugcacguggacuugugggaguuacguugaccagacuguuuauauucaagguugguucuauacucagauuuuguuggugcgagcuuuuguuacgucaauaaaaacuucuccagcaaggccagucgucucuauggaaguaaggucagccaaaccauguacuagaauagaaaugggguuuuagcauucuagggcaagacuugcaaauauuaaaaucuagucuggauacguacaaccuucgugugacuugauaacucauaaaagcuuccuuuccuucuggccuaggcaguccaggauucaugcagugucaaaaaugccagucauugaguuuguacugauuucaccucugauuggaacagcuucugcugucgcuuuccucacauucacgaaguccccuuuuuugcucaggcugccugcgucccugugaugcucagcaauggaugggaguugccauucucugaagugauuaauuggaaccaagcugccgucauaggcgaugagagauuguuauuacagguaaggaaggggcuguggccuucaacacaucagcagauuauugcugcccccguccaaacuuucaaagaagaugaauccaaaaggucagcucuauaaaagaaaucuuaucaggagaaaauuaccugugucauggugaauaugaagucauuuaauaugacauuguucacuuuccaacaaaaucuccccagguccccagaauauauucugaaaagaaguugcagguaaagaaugggagcuuugauuuucaagaagaaguggaucuccaccccuuucaauaaccagaauuuuuagaaauauuaccagagaguuuuuauucuacccuacuguuucauauucuuuuccucuguuucugcacuugccuucagauuaauuuucagaaagagagaggucucuagggcuuguucuuguaauuaguguuaucguuccucaaaugauccagucugggugucugagcgaguguuaucuuuaggauuuauauuuaaaugagcagccccuaauaaaaguuugaauugcucaagagcugccuagggagggggauacgauacucagaaaaaucugagggcaggaaugaucauguauuauuuuuuuuuaaauuacuaaggauuucuaaagcccuuuguauauucauauuuuaggaucaacacaaguugccgugcucuuuucuccuaaaauucuagaacuuuaauguuuuucuuuuguuguaccauacacuuuaucuuugaauuaccacaaauauuuguagaauuuuuuuuaaugucuuugcccuuuuaguuuuuggauauucauuaaauugaguuucuaagucuguguguguguauguguguguguuuguguuuuuugagauggagucucacucugucgcccaggcuggagugcaguggugugaucucugcucacugcaaccucugccucccagguucaagcgauucuccugccucagccucccgaggagcugggaauacaggugcacaccaccacgccuggcuaauuuuuguauuuguaguagagaugggauuucaccauguuggucaugcuguucucgaacuucuaaccucaggugauucacccaucucagccucccaaagugcuggaauuacaggugugagccaccgcgccuggccucuuaagucuguuguugauucuccuucugugcugcugcccagucugcuagcugacugcugaaguaauacagcacuuucccuaaaauaacaaaugaacuaacuguaacugagagacccauggguuaagcaaacuaaagugaccacagcuccugaaacauuacuucugucuggcacucaguuugugaucuccauagucccuauuaucucagaaacaaaggaggaaugugacagaaucuguuuuugggggaauaaguuauucugcccugaauacaacuuaauuucuuagguguucauugagaaaggggucuggaguuuuugugaaagggccacuuuuaugccaaugauuucccacugugauuccuuaaggaaaagaaguccuugcagaaacacugaggaagaguuuuccccaugcagagauaguguaugcuaaaaucauuuauucaugaaaagccaaacaagagugaugcauguugugcuuguccauguagccuuuuuucuuccuuuuucaaauguuauuuuaaaaauaauacaugaucauuaaaagaaauuugagaaauaaagggaauaaaaaacaccacccauaauuuuccuuuuauauaccaaugcucccaugaauuugaugugaacaaauugaaaguuugucuuugguauggagcgcauuuuaggauacuuaauugugguugugcaguuucuuucuuuuuuuuuuuugagauggagucucgcucugucacucaagcuggagugccauggcaugaucucagcucacugcaaccuccaccucccggguuuaagcgauucuucugccucagccucccgaguagcugggauuacaagugccugccaccacacucagcuaauuuuuguauuuuuaguagagaugguguuucaccauguuggccaggcuggucuugaacuccugaccucgugauccaccugccucagccucccaaagugcugggauuacaggcgugagccagcgcgcccagccacuuguccaguuucuaccauuucaccaaacuugaugggcauuucaccuucugaagcaacuuuuuggcuugacucuaaagauuuugauuuuugucacccccacccacccagacuugcugguguuuuuccccucucauauucagucugucuuugcacagcugccuccauauugagcagcaacuguguacuaucauuaacaaugguuuuaaagaguuggcacccagcccaaaugucugcucugggaaauguuuuuuuguuauguuacaauuuuuuauuuccuguuuuagaacagcugggauguuuuuauuugcauauauucuugucaucaugucaccaagagagcuuaaugugacuuucuuguaucuauucuggugcauuccauuuguuuugcuaccauacaugaccuuuuauuaagacuucauugagcucggcaacuuccaaaacaauccagccaaauuggaauuaauuuaucacuuucccauaccugucucucaggacaagcagauuaauaaccaauagccaagugccauuaaaacuuggaacucugucuuuucaaucaauuggaguugucuuccagagcacuuugcagagugcugucagacacuuguaucauaucacaagccgguagaauacauugcacuugauguaguaagaugaagaugcauguuauuuaagagaggggaacagcauugguaggugagucugugauauuccuuuucuccuuucauaaccacagcagacucaauuuucuggagacuauauagcaaugacagcuuuaggcauuuuucuuuucuuuucuuuucuuuuuuuuuuuuaagacagucuugcucugucacccaggcuggagugcagcggugcaaucucagcucacugcaacuucugccucccaguucaagcaauucuucugccucagccuuccgaguagcugggccuauaggugcacaccaccaugcccagcuaauuuuuguauuuuuaguagagaugggguuucaccauauuggccaggccggucuugaacuccugaacucgugauccgccugccucggccucccaaagugcugggauuacaggcugagccaccgcgcccggccuuaggcauuuuucuaauagacuguuuccuuguggcuacgauaaaacagugaugccaaccuauauaacucuuagcaguuaccucuugacauuuagaagaggguaugauuaugaaaauugaacaggauaguuuuuuucuaaucuuucuuuggccaucuagguaacuuucucagugaguaacuaaaaauaaguuuccuugcacugauaaagguucuaugauauaaaugauuugucuaccuucucaaagaauguuuuauuuccauuugaccuugggcucugauuacaggcuaauguuugccugccaguauuucuccuuuacauguugccucuguuuuuucaguguugcaaauccagguauacacuuugggacacagauuuaguaucugguuuuggacauugucaaaccaagugagcuuuuccuucuguucuuacugugaagcuauuuuauugcuccuccuaaggggagugcugaauuaaaaaaugugcuaccacuuccuuccccuccaauggaaacucuguuacagucuuagucaaaugccaugggugacuuuccuauuaaagcagcuaacggagcauuucuccuucuugcucagacucccauaucugucggauuagucauauguuauggaggcaagcaugcagaaagaggugagcacaaaagggcaauugcaaaucacaaggaaucuucccuaaagacuauagacuccguaaaugaaauagaccuugaacuguaggugaaaauagggaacaagcccagaaaacuuaccagacucaggaaguacauuucagagcuccagacccaaguagguucccuugcaaacauuaagcaauugauccagcuuuuaauagcaucacccugauaccaauaaugauaauaguagugauguuacauuaauuaaguuuuccauguuuuaggcacugugcuaagcacuuauauaaucaucauuaaaaccuuaguacuuuauccccacuuuauaaguaaagaaguggagucuuugagaaaucagcuaacucauucaagaaagcacagguaguaaaugcugcuagaggcaacacuccuuccuugaucuuucugacuucugugccccugugccugaccauucaguuauacuaccauuaaaaauaaugacgucccugugguggcuucagaugguuauauucaccuccuauuucuuaauaacuacuauauaaaauccacucugcuaaccugaaaauguguagcaggauaacaagauauagguccuuccuuuaaaauuguauacccuggaagagagcagugauggcuaaucauauaugaacaauugagagauccaguuagacuuggguaaaggcugaaggcagaaagagagauauagggagcagaaaggcucaaaggugagguagaagguaugugcacauaaaagugacugacccuagcuucagauuggaugggaaggcucauagacauucucuaaaaaguccuuuuauagauauuuuauaguuccuggggugaccaaucauagaagugcuugggagauaaagucuucuggccuuuccccaagaccuauaguuaccccucuauaaaauuugguuguucaugugcaaggucaaggauuucuggaaacagcaauugugacuauagacuaaccuaagcaacugauaaggugcuacugaaucuuagaggugaacuguaacuuucauacaucaaaggccauugggguggauucccaguaagugcucuuugcagcugacacuucuuaaggucauuucaacuuaggaauugaugauuuuuaguagaucuauaugcuagaagccaaaugcuaugaagaauaaaagccuaacccaguuggguuauuuugaucaagugcaucucuuuguuuuacaguuauaauuccuauguguucaccuuguguuacagauuccuucuacaaucaggucuauucaucaggauaaaauccuagcacuuagacagcagacacaauucuugugggaggcuuauuuuucuucaguugagaagauuguauuaacuacacuagagguaagugagaccacuuggcucuugggcuugaauaaugguccuuuauacacuucucucagccuucuguuuugcuauuagggaugugugauugguccaguggggcaaaaccagauuccuguacuuggauauauugguuaaccucuuuuaccugcuuugccauggccaagaaaauacucucauuccugacaaacuccacaaaggaaaaccuacauggggagaaauuauacuuauugacacagagauugacucugucuuacaucauuucagggauaugugggucaugacugucuugucauuuacacucaauggcauccuucgaagacauauuucuggaguucauuuagaaaaaaauauuuaauggcuuggcacagcggcucacuccuguaaucucagcacuuugagaagcugaggcaggugcaucaccugaguucaggaguucaagaccuggccaacauggugaaaccucgucucuacuaaaaauacaaaaaauuagccaggcaugguggcacacgcuuguaaucccagcuacucgggaggcugaggcaggagaauaucuugaaccugggagguggagguugcagucagcugagauugcaccauuauacuccagccugggcaacaagagcaaaacuccaccucaaaaaaaaaaaaaaaaaaaaagaaaaauauauauaauggccaaguaagggcaaauccucuaccauuccaaaaauaugaguaguuuucugggcaccacaguccaauggcauugcgggacagcagaauucucaagacuuaggcaagccagccaaccagcgucaauguggcaaaguuguguuaagaggagaaucaggaucauacccauguggcacagaaaguguuaaauuugugaaagcagaaaaucuuuuaggcagaugggcgcccguccucaaguugcuuuuuuuuuaaggcaggacggaaaaagaaaaaggaagcauggagaugauuaaaaccuuuggaaauagagcagauagcauuggccugaggcuacaccgaaguagcacaaagagcuaggaaaagauucaggaaacugcacacgcaugcauuacaagcuugaagaaaggagagcagagaucuucguugaggugauucugaggugucccaaaaugaggugggggcauuguggccuuccuuuuggagaauucacucuggaagagugaugacugcucuaaaagcuaauguaauauggaaccuacacugagaaaucugaguaauaccaagaaacugaagucacccuacuugguccacaucgcuguuuucuugccauccugacuaucagagccagugcuggucaugcuccaggcacaccagggcauuuauccaccccaugcugagcuugggcuccugcucccacccuagggcgagcucuggucaguguucucuuaggcauaguguguauuuuuuucauccuggaacuggguaaaaggggcuguuuaagacccaggcccauucccaugaaggggacaggaucauaaugacuuccaagggcuuccuuccugcaagcaaacuuuuaucccuccaaaagcaaucuccucaauuaaaaucaauugaguuguuaccucuguucacaguagcuaauagaguuacccuuugcuuuuuuaauccuguccuccaucuaagauccuuccuaggcccuucuuaaagaauguugaauguuauuguuucucccuuuuuggagugcagagugccuuucuuuuuuuuuuuuagacaggaucucacucugucaccaggcuggaaugaccuuaagcaauccucccaccucagucuucugaguagcugggaccaugggcgcgagcuacugugccuggcuaauuuuucauuuuuuguggagacaaggucucguuauguugcccagaguggucuugaacuccuggcucaggcaguccuccugccucgacuacccaaauuggugggauuaaaggaguuauuauuaaagaaguauacauucauuuuagaaacuaauagaaaacacuuaaagcauaaaauauaaaauaauucauucauguaaaaccacuauugauauauauauccccacaaacauauauauucauuuuuauauguaaauuuaaaauuuguuguacuuuuaauuuuaaaaaggagucuuuauauacuugcauuguaaccuguuuuucugcuuaauaauguuaauauuuucucauguuauuacauuuuuucuccauuuaaugacuauaugauauuccauuuaugauaucaucuaauuauuaaauuaauccccaauuuggguagauuccaguuguuucuggcuuuuuuccuuuauguacaucauugcaguaaaucaucucaaggucaaauuauugugcagauucaauauuacuuccuuaggauaaauuccuugaauuugaaguccguuucaaauaauaugccaaauguuaagauuuuuuuuuuuuuuuuuuuuuuuuuuuuuuugagacagagucucacccugucccccaggcuggaguacaguggcaccaucucagcucaugcaaccuccaccucccagguucaagcauuucugaggccucagccucccaaguagcuaggauuacaagcaugcgccauggagaugggguuucaccauguuggccaggcugcucuccaaccccugaccucaagugaucugccugccucggccucccaaagugcugggauuacaggcaugagccaccaugcccagccccaauacauuucuuucuucaguguuuucucaugacguuuuuauguaucuuuggguuguuucuggccuuucaauucuauccuauuaguuguuuaccucuaauacauccagagcacauuccaguguuuuaauuuuuuuuacucuauuaugcauccuauugugaacuucuauuuacuuaaaccaauaugccauuauuuacuauuaauguucuuuuuauuuuuuauagauaacuauaucuuuaucuaagcaaugacuuucuacauguaucuuaaacuacaucucuauuucuuuaggauggaaucccugaagugauuuuaaugagccaaagagccuaggcauuucuaaggcuuauaauauauuuugccaaauuauuauccaaaaacauuauauccaccuagaaucucacaagcugucugggcgugacucucuuuugcugugcucuugucagucuuacagauccauaauuaaaacacacacaucuaucacuuugcugauuugccagaugaaagaugguaucucauuaauuacaugucuuuugcauaugguuuauugcaugaauauggucucucaccuauuaaguuagcaguucucaauuuuucuauuguaacaguugaaugucuuacauucaucagaauaggaucaaaauaagaucaagcuguuuucaucucugaaccugaaaaggccuuuucccuuuguauuuaaaccauguauuauuauuauuuuuuuuuagcaacacaguuuugggguuuuuuuaaacacuaaaaaccauacacuucauucgaauuuauagcaacugucaaaucucuuuauauaguuccaagauuggauuguaacaguuugaccucucaaccaaguugcaugacagguacuacccaguuucccaaaauacuucauaacucagauuaccccagaauucaacauaaucaaaaaaucaggggaaauagaagaaaaugccauccacagauacaaauaacacagcaaauguguuuauaagaacaauuuaaguaucacguaucaaagaugugaacuuggcuuagaacuuagauaauauacuucauuuagucacugcuggagcuacuaaggcacgagaauaauucauaguuacucacaguuacagcauagaguugaagauccugggcuaaggauguucuguacucagacucuaggucuuucuccuugcuugguauauucuaagccaugggaaugggauuauggggucuucagcaauuaugagcccuagaguuguagguagagugcuuagacucaguugaaaacaggacaucucauuuucucuucaaugccagggucagguuguuaguacguuucauuguacagaacucugucuaggauucuuuuaguuuuuccaguuugauugaaauucucuaaugcugcaucuugguaauaaggagcuauuuaaucaaacuaggcucuguagagcucaguacuuuugugaaaauugagaacuaacaaugaggacaaugaaaaaacacugcaaaaacagugcuccuucauggauuccauuauuugucagaauauugcacaauaaccugcacuaaggauugaaucauuggagcuuagucauaaucaagaugagugaaagaaagugccugagauuaugauaauaugugaaaagagccagugguagcuaggaagguauauaguuaguggaguuuuaaugaaguaugcuucauuuuccuccucaguuaucuaaucaugcacauacgaaccauaguauugcugaugcuaucauacaaugauauuuaaaaaucaaugggguaauggaaauagacaauugaucuggcuucaagugagguggcauaugguggcaucguguaucuuaggcuacagugcucugguuaaaagaugaagggcuacauagaaugacuuuaaccuauaaccaauuguccauuauuuggaaaacagaggauacauaaaaguaaaauaaggagccugucauucuucccuuugaauucacaucaauuagaaauauuguccuuaucgagggggccaucuaggaccauaacaaaaaaagucuuguauuaucuguuuguguauguguguguguguauugauuuuguuuauagccaaagaagcauccaaccucuaaugugaugucuucuuccaccacaauaaagacuaagcacuaagugccaugaaaagauucugggagcuauccaggguagugauaggaagaauugcagagggaaaaaaaugaucuuucuauauggugaaaugaauuccauauuucuuuaugcuuuuagaaggcaaguugauauaaaccuuuuagaaagacacuuggcaauacuaaugaauagccuuaaaaguauuuauacccuuugacaagguccuacagaaucaauucuggucuggagcgguggcucacaccuguagucccaacacuuugggaggccggggagaaaggauugcuugagcucaggaguuugaguccagccugagcaacauaaugagaccuuaucucuacaaaaaauaaaaauaaaaaauuagcuggguguggugacccucuccuguggucccagcuacucaggaggcugaggcgggaguauccuuugagcccaggaguuugaggcugcacagagccaugaccacaccacugcacuccagccugcguaacugaaugagacccugucucaaaaacaaaaacaaaaacaaaaacaaaaaaagaaaaagaagaagaagaauaaucaauccuaaauguggaaaauuuuauucguaaauauguucauugcuuugcauggaaaaaauugcuaaacuggucauuaagaauaaugaaucaugaauacuauuaauauguaaaaauagcuguauuauguaauaucuauacuauuaccacuauguaauaaauggaaaaaccaaugccuagaaaacgaacacaggagugaguuucuuuuuaaaggcaaaaaucaagccuuaaguauaacaacuuaggcagcuauucuuaaauucugagacguuguuauaauuaaugugguauuuuauuguuuuauuacaaaugaggaaaauaauacacaaagguggcaaauugcuugacccacguuaaauucaacauuugcuacugcuuucguaccuguccuaugucuuucugucaagauccguuggaagacaguauaaaaugcuuguuguuauuucagaagagugcuauaucuuauuaucauaucuuugaauuuuaaaagauaacaauguugugaugccgaaccaaaaagauagucuaugacaaugacaagcauaccauccaaagaccugaugggaaugaugacccauuuugugacagcugugaguuccaugauauuugucuguagguucgauuuauaaugcugucuauugucaauuuauuuucuaucuugauauccaaacuuauuuaagugaccacauccuaaaagguacauaaauuugaaaagaaaaaaacaaaaaaaggaggaucuaaagagaaacuauaaaaaggaaauaaauagacaguacguuuggaaaguacaaauaauaaaaagcaggaauaaauguuguacaaagugaaauugcuaaccauguaaaaaguccuucacaacuaugacaauuuucucauaauuaaugccaagacaacagcauuuuaacauaucccuguuguaccacaaaaaguaaaaauaaauauuuucacuagguuccuaaagucuccaccaaauuagaaaccucuauccagccauauaaaauuagcaguuuugaucugggugaaagauaagaugcagaaaucauugaacuaagauauuugaguucuuuugaauuuccuccuugcuuccuucucugucauuaggaaaauaaacauaagauuugcaaagauaaauguagcccacuuuauuacuuaucuagucaccauguggaaugagaugaggguguuaauaaccuuagcaaauaauaaaacuccauuuaaaauagucuguacuuaaaaucacauugcauuaaauggagaccuggaaaauggugauuugggucuuaaaugucuuaaaacuuacggcaggauuuuuuucuuuuuuuuuuuuaauguaaaaaaaauugcugaaaacauaaaauucuguaccaaguuaauuauuugccaaaucauauucuaaugaguggaugguauaauuguaagaguuugaaagucacagagagaaagcuauaaaguggacuaaucacauucaacugacaaaugauucgggaugggaggauguuugacucuaaauguagaauuuaaugaucugcaaggucccaaaguccaaagaaacuaaugaacuagcuuggcuauuauuagucuucauaugccaugguucuuguccuauuauguaggauguuuuaagcaauuguuaacucacuacuuuucaagaugaaauauagaaaaacuucaguaaccagcacccaaaguccuccaauugacuuugaaaggaaaaugaaauaugacaaguauacacaucuaccucuugaauuaaaggaacagcugaaaaccucaauagcuucuagaaugugucaugucuugaauaugcuuuccguuuagcaucuacaggucuacauugaccucucuuguucucugagaacagaucuucuugauaggggccuggaaccuaucuuaguucuuagaaguuuaaccaucagggaaagacuaacugcuccacacagucuauuuuggaaugagcauggacucauuauuauacaaagacaagauagaacuuaugguuuaacugaaguuuaauuaggaaauuugauuggcuauaauucauauguuucucucacucuuuuucauugcuccauuacucucucugucuugcagacauuuuuauccggagaauuaaagugggagggaggguagagucacuacucugacugccaccaucuuucgaauuuggauugagcaucauccuuuccaaauaucaucaggaucucauccucacugugugcuauguuuuauuuucuagauuauucaggacagaauauucaagcacauaucacguaacaguuuaauauggaacaaacauccuggaggauuguucguacuaccacaguauucaucuuaucugggagauuuuccuuacuacuaugcuaauuuagguaagugaauuuccuccagggaguugcccuuguuuacccugaagaugucauacagaacuaaaggccuuuauucuucuacucuaaugggguccaucuaacacccugcauugaagauugcuuuuucuagagccuuguuauaagugacauaucaaguucaaaaacagagcagagcauugcaaaauggaaaaaaagaaaaacuucuuaucugugcagcucuacuucauauuuaguagaguuauuucuuuuugagaaauaggcuccccaaauuauggaucauuuugaacauggcaauggguuagcuaucauuuuaagccucaucauauauaaaauggagagcucuccccaauuuuuuuuuucacaaucccaauaucucuauuccuuaccaaagaaaaacugaauaagaggaaaggagaaauaacuaagaaugugugacaagcacaaauuuauucauuuuuccaagguuuauuaugcuccuucuaugugcuaugcuaauguauugcuggguacuagaaauaaaaagucaaauaagauacaaucucugcuuucaagcgguuuucagucuaaucacaguagggaaaagggaauggcggagggauaaaucucuaccaccggcuacuguuauugccuuagacauuuauguauuuggacccccaguugcucucauguuagaaacaucaugaacauuucccaucaguuacaguucuaaacuugagaaagccuaggacaggaaagcaucuuccaagcugauacagcaaaaagacaagauuuuccauucagugccguuguucuccguaacacccucacccuuuuaaguuguacauguuuaguuugaaacugaugagaugaaaccuaaagaaaugcauggccugaagcaucaaccagugacaaagcaccuuuuaauccaaaccaaaccuguuaugggaaccaucucuaauucaguauauuguugacauuuggguaacagaauuuagaaauugucagauuaaggcacugguugacaagaauuucuguauauuucuuguacaauauuuagaucuuccuuuggaguuagcacauuagagguguauaaaugaugcuucuuaaacuauugcaggaaaauuuaaagacaaugacuugucguuccuguuuaaaaggcaaucccucaaucacgcuuauucuucuuacucggcaaaacuuugaauauguaucuagauauugggaagguuaacuucuuucuaacauacaauuaaagugcugcuggaugauauaauuuucucuacaaaaccuuuguauaauccuguaauacacauauagucugauucuagccuuuaucccaucaguaucaaagcguaacuugaaugucccugcacuguguugcucgcaguuaagccacuaaagugccaaauuagugggucuaaacuaaugaaguuuuaaaaggcucuuaaccugucucuaauuucuuagugaguucuuaugggaaaacuccuuggggggaagccaucucacuucugucucuuuggugacagugguuguuuugcauaucuaugauccuuuuuaaccuagggcuucagagcucacaacuggcaaaagucugccucacauacuuuuuuucucagcuauaucacugcuacacgaagaagagauucugggaauauggaggcuucuucuccaaaauaauaauguuggugagggugaugauaaugguagcugcugacauauauugaguacuugucauuuguuaaguccuguucuaagugcuuuguaugcauuaaguuuuuuuuuuuuuucuaagacggagucuugcuauguugcccaggcuggaguauaguggcaccaucggcaccaucuuggcucacugcaaccucugucuucagaguucaagcaauucuccugcuucagccucccgauaacugggacuacaggcaaaugccaccaugcccagcuaauuuuuguauuuuuaguagugacggaauuucaccauguuggccaggccggucuugaacugcuggucucaagugaucugcccgccucagccucccaaauugcugggaucacacgugugagccaccgugcccagacaaacuuacugaauuuucaagauaaccccauauuuggcacuguuacuaucaggucuguuucccagcuguggaaacacagaggguuaaguaaucuuuccaaggucccccgaccaguaagugguagaucugggauucagaccuagacagucaggcccuggaugcucuuccuuucaccuuuuuucccacuagcuaguuauuugaaauacgauuagucagguagaacccuuucauuacauaauuaaaaaucagacacaugcaaauaccaugggagagacagcacaugaaggguggugaguguuguguguauuuggacacuggguaccuaaaaagccaaagggacaucacagaaacaucaccaagaggggcaaaggaugucaaagcaagaaccuagaaguggacauugaucuggaauuuauugaggucucuagacucaggcaguagcuaaccagcagcuuuucaucuuguuucuguccugucaggacauaagaagcaaaggagaaaucauccaggagggaacauuugcuccagcaugaggcagcggagcaaggaggaguaauuuucuaagucuugcuuuccagcgcuucauuaggcucuacucuccuuuuuauuucagguuuaaagccccccuccaaauucacugcagucauccaugcggugaccccccuggucucucagucccagccaguguugaagcuucucguggcugcagccaagucccaguacugugcccaggugagcgggaaguugacagagaagccccugccugcuccagcuccagaccagagacuccgcccuccuuaccuguuaucccccgggcuccccaggcuccccgggacuucucuaacaucauacccugcuacucccuuucauucauccugccucguuacacccuuuucauccacuuagaaauucuuggaagugaaaucugcacagggaagggauggguuacagagagaccuuagcacugguauagaguuaaaaaguauauauacauacaccaacauagucucuaaagaagauacaagcacaugauuuuguuuuuaaaugucaaaaugauaaaguaacauccaaaaagccucugggaggacccagacaacuaagcuucaauagaagaagcagacuuguuggugucaugaagugucaacuuuucuuuucauagcaacuaugacuaauuauaaaauugggagcagacgauuaugccuaugguaacaauauuuuccaaaucaguguuccucccauauugaacggugguuuuucugauuugugaauuaguuuauacaagaagguuuacaaacaaggaaagaauucaauaaggaaguaugcauuuuugaacuaaaugccuuuauuggaaauuauaaagucacauaaaaucagcaaccauucuagagcaugcaaaacaugagcucaucuuaguucuagcuugaauuuuuuuauuucucccacauugccugguguagugcaaguucagagcagauguucagaugcucaguauacauuuuuauuuaauuugaucagaguuguuaucucacacaccaucauaagauaucagaauuuaggaaaccacuuuauuaagcuccagccaccguaauucuuuuuccugcagcuuuccccuauucccggacacaguugguuuuguuuguuuguuuguuuguuuauuuguuugcucuuucuguccucucuccaguuguuggggugauaauguucugagguugugugggaauggacucacuuuaaaacucaguuuugaugucugccguuuugucuugcugagauuuccagcuccucuuucucuuucugucucugagaagaggcuuuggguuggaggcauacauaaauacauccuaccccagccaucuaaugagccccaucccuuucagaucauaguucuauggaauugugacaagccccuaccagccaaacaccgcuggccugccacugcugugccugucgucgucauugaaggagagagcaagguaagacucgaaggggaccuauauguggaaccacuguggagccuugguuucuccauggggcacuuugggucuuggcccuagauaucuucucccuguuccuggauuauuuuuucuaaaacuguacuuuucucagaauauucucagauuugaccacaauaggcuuucaaaucagggaaaucugggucuugauaccaacucuuuuauagcuuugugaccuuguguguauacuuaaccucuaugagccucaguuuccucaucuacaaaguggaaacaauaauauauaccuuguaggguugcuguuaggauuaaauaaagucaggagcuggcaauaguuaucuuucuguaaaugacaaagaugaagauaaagcugauggugguggugaugguuugcuuggcugauuaaucugaaugagcuaugucuaucagaaugguguuucuuucucccauucacuuuaaaaaggacauuuucaccuuaauuuuguuuggcaucugccuguaaagauucucaugagugcuacauagccggccucucuucuguucuccaguucacuuugccuagagcugaacuaucuuucugaucaucucccggccuuuuucuccauuugcuagugcuuccaauuaacauuugaggccauguguaaccuggcccuagccagccuuccaaucuuuucucucauugcuuuccccuacagacccugcccccuacuacauuugaucauuuauaauuagcugaauugcgcugugucucuuccuaccucuaauuuugacuuugccauuuguaagucuugaccaccccucaacucaucaucucugcuugucaacauucccauauauucuuuaagcccccguuugcaugcuaccuccuccuugaaauuucuucuacuaaagagcagcuagcucuuuuuucucuagcuucugcuuguuacuuauagaucuuacgcauugugaaggaaauagucacuacuaaaugaaauugagauuggugaagcagugccaucuaaaaaacuuuccuugucaguccccaaggggucaggucauaagagaguggcucacaccuuugcgccagaaugacaaaaucaguuuauuaggcugaaccauuugauaucaucaucgacucaccaaaaguggcaauuucauaugguuugacauaaugcaauuguaacugucacaaggacaagaugaucagugcauuaucuauucaguuccauuuaugagugccuacugugugcugagcuccuuguaacaggcuuggaacacaguggggaaugugacaaauauagccauggcucucauaaggcuggagucaaacaaccuguuuguuagagagcugcuugguaagcauuuaaugagaaaagguggauguuggaauaaucacaugccucucucacaaaucaaucucaccauaagcacaguuucaugcaggcccuuauauccaucccccccauagaauagcccaucauaggaauggcaguguuccaauuccaaugccugaagccaugaacaguacucagaggcaggcaguuaauguugaacuuugggauucuuuguuuuguaugcuuccaugggucaaggagaccagcucugcuucugguggauaaugucuuucuuuggauaugucaggauauucagacacaauccagucugucugggagccauucugauuucuuuagguaguauagcauuuucaugcucugacucacugauugauuuuauauuuucauucucagugaaaagaaacuccccguuucuuucuuuauaaaaugguggugauaauaauaguaccuuucucgugggcuuuaucagaugucucuuacaagaugccucagauccucccagcugcaucuauauucaggccccuggcauuuguucaguccuugccuccaccuugggcacugaauccagugggcuggguucuuccuaugucuuuucccugacucucagugcccugggauugcaccucagagugaagcguuugcacuuaagucuugcuucaggcucaguauucuagaaaaccugggcuaugacaugggcccauuuugaggguuaaauaagaccauuccauaucaggugcuuaguccuaugcauauuauacaugcaccaaggguucaauaaauguuagcuccucuucugggaggcaucauaaucuuaugauuuguauuaugggcucuaaagucaaaauuacuuuugugugacuuaaagcaaguugcuaauccucugugucucgaugcccccuuucaauaaauggaaagagucauaauauguaacuaauaagguagccaaaaagaucagauuauaugagauacauaaauaaauguacugagaagugugggcgcacuguggauacucaauaaaucuuaacuauuauuguguuuuauauaauuauuuguguacauuucuuauguaccucccuccccaccccacacacacacacuacaagacaguaaacuucuugagucuuggucauuuccuaggcauguuuguuaauuuuuuuuuuuuuuuugaggcagaguuucgcucuuguugccuguccaggcuggagugcaauggcaugauaucggcucacugcaaucuccgccuccuggguucaagcgauucuccugccucagccuccucaguagcuggaacuacaggcaugcgccaccaagccuggcuaauuuuguguuuuuaguagagaggggguuucuccauguuagucaggcuggucucgaacucccaaacucaggugauccaccgccuaggccucccaaagugcugggguuacaggcgggagccacuguaccuggccaacauguuuguucguuuuaaaggaguugggcuuucacaugguagcuaaaccuuucuuaaaugaacuaacaaggaaaacccaguucacucagguuuaacuuuguaaauacauugguuucucucaugcuaauccauuuaagaaggucgcugaggcaauguguuugaaaaaagccucucauuucugcaugagaauucgaaaauggauggcuuaugggcuuuuuacuucuguugaugaaacagguucagaaaaaaaggaaacagauccuuuuaagaccugugguugggcagaugaugaggaagaagcccuacaucuuccucauucuccauuuuaaaaucucuaucuccaugaauuuagaagcaauauauuugcugcuuuggcugaaaaauucuguuuugaauuuauaggcguugucuuugcaguuuuccccugugggcuuaacaagggaaaggucagggcagugcuaagcuggcagcuaaugguuucugcguuagucaguggacauguaaacaguaucaggaggauugcuucaggcugagaauucugagcacugugucuaugagguugcugaucacuuuguguuuuauuucaaaagccugagaaagaaaacaacaacaacaaaaaacuugacccaguugacagauguguaggagcaaccccugaagccaugugugcuacagcuaugucccuugagcucuuggagaugaguuagaguggccacuguccaugcauuaaaguccuaggugcucugguagcuucgccggcaaagaaaccgaguuugagaugaggccugcagaugagcuggcuccuagggguacucagauuuggggagacugcagcucuggcagcuggcuagguaccucccuuuuccucuuucccuuugucugcaguguuaaguugcuucuuucccuggccuuugucucuucaaaguugauggcaggugugaauucagagaggaugucaucauccuuacuauaacuucuggaagaaggugaugagcauaugauuggcauauguguuccuaaauucacuuuugagguccuuuccauucagauacagcccgguggccaaggugcucuauagagucacaccaucugggggaaaauccuggguccguuuugggcaagauacuuaaccuguguaucucaguuucccucccuguaaaaugggguuguuauaaagaugaaacacgaugauauauaugaaggacuugcaacauauccuggcacacaguaaauguucaaaaaauguuauucuuauggugucagcauucuuaugguuaguuccucuaugguacauucaacacaaagguuuaaguugugacuaucacaggguaaccucuccacccucaauuuuuccagcugaugccauaaucuccaaagcccccaccacacacacacacacacacacacacacaccacugugugugcacacguaguccaccuuuccuuauuccagaacugcccaaacuuuaugcauacaccaccuucacaauuuuucuaaauccauggaucauaugugcuauuauuuaauauuuuuucuucuucuucuccuucuccuucuccuucuccuucuucuccuccuccuccuucuccuccuucuccuccuucuucuuucuucuucuucuucuucucuuuuuuuguuuuugagacagagucucacucugucacccaggcuggagugcuguggcaccaucucagcucacuguaaccucugccucccggguucaagugauucuccugccucagccucccaaguagcuaggaccacaggcaugcaccaccacaccuggcuaauuuuuguauuuuuaguagagucaggguuucaccauguuggucaggcuggucuugaacuccuggccucaagugauccacccaccucagccucccaaaaugcugggauuacagucaugagccaccacgccuggccuaauauauuucuuuaaaucaguauacuucucauuuuaaugaaguuauuuguaacuuuaauauuaccuuugauugcuguagcugcuaauauauguguauauauuuuuucuaaucugugcuaauacauauuuuaauuuguaaauguuuguaauuuguaaaagcagcacuuucuacagugaucugcucuccccgugguuuguguccacacuuggaaucacuucuccauccauucacucuuucgguugggaagagugggugucaggaugcagguucucugcucagugccucugcaucugccaagucuugucuuuaauacuucauuacuaucuauaccuggugaauucuuucugcccaucaggguccugcuuaaaugucacuucuaugaggccuucaccugcucuuccagacagcuaguugcuccauccuguggucuccuggcauuuuuuguaucaagcaaagacuggucaucugcuucuuggucuccucuacagaccaugaacucuucaaagacagggaacaugucugauuuaucuuuguacccucuuugacaagcaagaugucugcuacacaguaggugcccaauaauuguugaacaaauacaucugcauugaugggaaaugagauuccuucgguguugaggggugacaugauaguagcgcauucuuuaugcaggugaggaugggagaauuguccugaaaacaagacucugaaguuaccucuuucccucauucccuccccacugccuacuucuacuuccucccagguuaugagcagccguuuucugcccuacgacaacaucaucacagacgccgugcucagccuugacgaggacacggugcuuucaacaacagagguaagaacccaugccugaggagcagcaggugggcuguucaggcagucaccucauguugcacgaugcuaaugcuucuuuuagccgugccuuggcagaaguugaaaacauuuuucaaaacuuccuacagcgcugguuuuaaucagcccgauuccuguuagcaccuugcugccaccuggcacucugaggcgggcaucuccccuuuguugucucugcuaauuggcuccucauuugcauaacugggccucaccccuccucccaggccugcccuccuuuuuuguuuuuaaacagcacaguugugagcaguugcgcagaacugaggggaagggggagggugcguguucugcauuagguugaaaccaugcuuuccggaggagauaaucccauuccucuccacguauccuauugccucaguuaggagacucuauguggagcucuaaaggcagcuuuucugucuugguuuaaagagcucauuuucuuucaccuauacaagagcaaacgguuucacuucaagguugugauggagauuccuauuucagauguucagguaguugugccaaaaauaagauugccuaaagaaugcgcguggaggagagagagaggaggaaagauagauaugguagaaaaccaauuuuuacaacucgaaugaguauugaucucugaaaccuuccuuuaaaccaugcagaggaccaaagacagcuauauaaaaauggaguauaugagaaauacauuauuaauggcaacuacuaaaaagcauggagacguaacuacuuacaccuuuccccucccucucccugucuuuuuuccuuuuuguucacaaucauuuuccuuuuaauguaaacaucaguguaaccugcauuuuccuggacaccaaucuaguucuaauggccugcugcccacagagccaagacucaauguuggccuaggugaacucagugucuccuugaaauuccacagauguggccugacgcgguggcucacgccuguaaucccagcacuuugggaggcugaggcgggcagaccacaaggucaggaguucgagaccagccuggccaauauggugaaaccuuaucucuacuaaaaauacaaaaauuagccaggcgugguccaggugccuguauucucagcuacucgggaagcugaggcaggagaaucgcuugaaccuaagaggcagagguuacagugagcggacaucguaccauugcacuccagccugggugacagagcgagacuccaucucaaaaaaaaaaaaaaaauuccauagaugcuuucaaggugccaucagauagaguugcauagauguuaugucaaagggcaaccuaaauaaucccaggacaaaauguccuggaccucaccuuguuaaaaugcuuucuaugcagccgaagcucuauaaauacuuguugaaugagugguugggccaggguggggggaugcaugcuuuggggauuaaagguggacacaccgccaauugugucauguguagguuggcaggaggaagggauguugauaagcuuaacauucauagggaaagacagcuauggaauacaggguacaggucacucuggcuugcauuuuucugccacuuucugcaagggaagcuggaacacauucauucaacaaguauuuauugagagauuucuuuguccuggucuccaugccagguacuucaguuacacaguuccaggcuauauccaucugaguccuggcaacaaacugaauucaaaucagaugauucaaaugaaggaacuuuggauuccuuagggagguguagaugggguuaaaagaccccauaagagagaaugaggcaccuggugaguaaugacagcaggaagcagcuccucccuuuggccugaaggaguuagagaaggaacuccuucuuucaaaggcccugagagauggcacuaggauggagaggcugcucuacaagugcuaugaucauggaaggacguggcuacugccagaacucuaauggcaaaggagagagggagcagagaagagauacacugaccucucucucuauccugccucgauuuuccugccggugacucccauugaccuaacccaaccaggugaugcaguccauagggguccauuaucugagggcacagggcaggacaagaagaguggauaguggauuuuggagggcaaacacaggcaaagcagcacaccgccauggugcaacaaauggucaagacaacuacagcauguaccuuaaucaucauccuaugaccugaaguauugauucauccucuaucuuucccugggcacaaggcaauuagucucacucuaggauuguuuuucccuauccuauggugaaauaacuuucaacugcugugaugcauccucaugcuggugaauuucuuuucaaagaauagcaauuccaaccacucaaugcaugcugggaggaacauguguuguaugugaaguaauuagaagucaacguggguugaaaaugauauguaaaucuaagaggcuggcagucugguuugcuuuugccugcugaucaguggagugguuguguugccuaaaaugguccugggcaaggauuucucuuuucucuuuuuuuaggugaauagauguugguucacuuuucuuuuccucucuaaggaucucagauuguuuaaaugucucucugcagcauuaaggauggauuuuuaaacagcauccuauaaagggcauuauaguugguuuauaguuauuuacauuuaucuggauugcugcagacgcugcucaaaagaaaacagauguugguuuuugagagaaagggccuuaaacugaccuuugccuucuuugauguguuaauaaucugcaugaaauuagagcuaucacaagaaucauaguuuuaucugaauuuacuuuugaguuccuuugaaaugacuugaaacagccuuaagauaguaagaaauucaugcgaugagaacaccccauuggguucuguaguaguugcuagugcauguguuuccuuuucaaagaaugauagaaaaccccaaagagugcugacggccaggcugauccuuugacaacaggcugcauaauauacugucccaucaguugucuccauuaguauugaccacuagugaaaagguguagguaaucacaaccuaauuucaauuuucuagcagaugcucaccauccccugcuaccuuuuaacuuugagauaacgugcucccuaccaagcuuucuuaaugucgguuccaccacccggguuuuuuccccgcucuggauuuuuuuuuuuuuuuugacggagucucacucugccgcccacgauagggggcaguggcaccaucucggcucaccgcaaccuccgccuccuggguucaagcaauucucgugccucagccuccccaguagcuggaauuacaggcgugcaacaccacgcccagccaauuucuauauuuuuaguagagacaggguuucaccguguuggccaagcuggucucaaacuccugaccucaagugauccgcccaccucagccucccaaagugcugggauuauaggcgugagacacugugccuggccccguguggauguuauaguuuuggggaacaagccauauuuuuaagucuuccuuaucuuaagauagggcaguguauuaggauuuuucaggcaaacagaaucaauagaacauaauauauauauauauauauauauauauuuauacacacacacacauauauauaccuacacacaugcacauacauacauacauacauacauacacugagagagagauuuauuaugaguaauuggcucacauaauccugggggcugagaaaucccaugaucugccgucugcaggcuacagacccaggaaggcuacugguguaauucuagacagaguccuacagccugagaaccagggagccaaugauguaaaucccaguccaagggcaauagaaguucgaugucccagcucagccggcaggcaaaaagaaaaaggggaggaauuccuccuuccuucaccuuuguuuuguauucaggcccugaacugacuggauauugcccaucugcacuggcgagggcagucugcuuuacugaacccguggauuccaauguuagucucauccagaaacacccucacagacacacccagaaaucaucuuuaaucugggcacuucaugguauacucacauugacacauacaauuaaccaucacagguccugcuuuggaaccucugagagggcaggaccuggaccuagcagcaucccuccgucccccagcuaccaucacagugccaggacucaaaauauuugcgaaacagaugaaauuuccauuuguauugcuuauccagaagagauacggcaaagauaacgaggugaaucauagcguguauaagagacaaauugcuuuuaacacuggaguaacagagccaaaagagaaguuuugauaaaguacguagcacauuugaaaccagacugccugaguuugaaucuuggcucugccacuuauuagcucagcaaauuacuugaacuuauaucuuaguuucccuuucuguaaacugaagaauguaaaagccccugccuuacagggguauugugaggauggaaugaguuaaaauggauaagcaccuauagcugcaccuguuguauuauaacauuucacaauuaugagcauuauaugauuguuugcugucacuauuuuuguuauuuuuauuuucuguuuauuauuuugauuuaccauucaucaaaugaucauagaaaucagaagugaguuuaugcauuugaaaacagaucacuugcuaacuauaagugcugguuuauagcagguucagaagcaccugcuuugggcuacuauaagcaccggagagacauuuagcugcauuuccuuuaaaauaauucuguggcuucaguuguucuuguccccacuuauucuuagugauuuucacuguugaugcuuucuucuagugucucuuaaacugugcaucuucaaaccuaagaagccugaauuauguuuucuuuaugauaccugcucuguauuccuguuagaacuugugguguuuuuuuuuuaaaguuauuucucuuacucuuaagagggugcuuuuauuuuaggcacuuuggcuuugauauaugcuggguaugauauauguuguauauucauucuuuggauauacaugggaaauuucucauuuauaaaacagauguguuugugucucacgugaaucaaggcacgugcaccuuugaggaagggggaaaagaagcuuuuucaacuuauguuuuagcuugaacagacuggauuuuuaaagggcauaucagcaaauuuuuuucuuccuuucauuuccauacuacucugaaguuucuuuaacagaaaacauuaaaaugugcauaauuauggggcaaaaugucaagcagucaguuuaauuugcugaugaauacauagaauuaauguuucgccacaguccccggauuuugcauuaugaauuaguggggagaagguaauguuuuguugacauuuguuaacacuguugauugcuuguuuggcuuguguucugccugcagguggauuucgccuucacaguguggcagagcuucccugagaggauugugggguaccccgcgcgcagccacuucugggauaacucuaaggagcgguggggauacacaucaaaguggacgaacgacuacuccaugguguugacaggagcugcuauuuaccacaagugaggaaucuggacaugucucuuacagacuuuacauagcuuuuuauauuggcugcugcauaaauaggaacuaaggccaaaucuuguuaacagcauugaggaaaauuagucuguauccccgcuuaaguuuugcugaugugucaaauguguguuuuugaaaccagugaaaccucuuggcauguuucauuuccagaaauuaugguagaguaacauuuucaguuggucugaagugugaaaauacucucagggcauauuagguaacugaauauuuagaauaacaacaacaaaaguaaauaccuaagucagcacccaagggcacuguucuaggugcuugggauucaucacugaguaaagcagaaaaaauuccuugccaaugcaggucuuauauucuaacaaagaaagacugucuacauaauaauuccauaguuuauuaaggagauaagugauauaacagacaaaguguagaaaaggaucaagggugcugaagguggagauggggcagauuggggguguccagggugauucugauugcacaggugagauuugagcagagacuugaaggacaggaagucaagaggacaugugcaccaagaguguuguggcaggagaacagcgagaauaaaugcccugaggcagaauacuggagaaccaucgaggagaccacugugacuggguggaaugggugacaggaagucagaaaagucagggggcauggaugcacgaccuugauguccaucaugaggacuugacuuuuucucuaagugauaugggaggagggcaggguuugaacagggugugacauguacagcaugucacuguaccgaauacuguaggcaguuuuaacacagugauaaauccugcaggaccuugauguccaucaugaagacuugacuuuuucucuaagugacaggggaggaggacaggguuugaacagggaggagaaauccggcuuuucuuuuaugcauccacuguggauucuauguugagaagaggcuauaacagacccagaguugaagcagaagcccuauuaggaagugauugacauuaucuaggcaagagauggugggauccugggaccaggaagugaaugguggccaugguaaguagugaucagauuauuuugaagaugcuuuagcaugaugccuagagagucuggauguagaguuugaugacuccaagucuuuugaccugaaacacuggaagauuagagggcugaucaacagagaugaggaaaacuacagauggaacaaguaugagggaaaauauauagguucagucuuggacauguuaagacauccaaaaggauauauggaaaaagcucagggguggagauacaaauuuggcaguuguuugcauauauuuggucuuuaaagccaggggacuggaguaagauugccaaacuagugaggguagauagcuaacauuccccacucaaccaguaacaaaauaccugcucuucuaucauuagugaacacaccaaucuugccuuagucuuuuuaguaaagaauagggaauuuugcuaucucagggauagcuuggaaaugcucaaggcauaaacauuuaggcugacugauucuuggucucaagauuucacuucuugaaaguucauuguuccuauugcuucugccaccaccacucuaagaauuugauucacucaaaugauuuuuccuauaaauauaugcuauauguauauaaauacauuuuaaaaacaguaggaugagaaauaauucaaauuaauuauggguuuucuguuacgauugaccaccccauuaauucagauuuugcucuaacaggauugaaauauauaugguuuauagggcacaaauauagaacagucuauuguuggacucagagucaagggauaauauuaaauacaguucugauuaagccaaugauuaaaauuguuaagcagcuuuauaauauauagaucauguguaaauaacuuaucuugccaucuaauuauuuaguucuucuuucuaacucaccugucugauguuagaguuagacuggacaagcaaugucuguaugucuguaucucugugccuuguuuccucaucuguaaaaugggaguaauaauagaaccugccuuguaggcuccuuaugaagacuaaaugaagcauuucuuguaaaacacuuuagaacaauaucugguauauaacaaguaccauagaagugauaguuaucgucaucaucaucaucauuaucauuaccauucaugacauguuuagggauucaaagaauggguauguguuuucugucucagaaguccacuugucaucaugugauaauggcccccugugaaacccaucuuugauuuuuacagauauuaucacuaccuauacucccauuaccugccagccagccugaagaacaugguggaccaauuggccaauugugaggacauucucaugaacuuccuggugucugcugugacaaaauugccuccaaucaaagugacccagaagaagcaguauaaggagacaaugaugggacagguaaguauagaagagcccucuucccuugcuucacucacuggugguucagccccagguaaugaggacucacguuccucuagcuguuccacccaggagcauauaaugaggagaaaccaggaaugaacuacaucugaaagcuagaaaagaguguaugauuggugcagggauaauuaggaagacacaaguuaagaguaucuuuaugccaaggauguaaagcucuccuauaaucuuuaaggugacaugagaaagauaugucuuuagaguuugucuuaguccauuugggcugcuaugacaaaaauaccauugacugggugacuuaaauaacagacauuuauuuuucauaguucuagaggcuggagagucccagaucaaggcaccagcagauuuggugccugacaagagacuguuuccugauucauagauagcccucugcucauugugucuucacauggcagaaagaagggcaagagaguucucuaggguccuuuuuauaagagcacugcucccauuugugaggacuccacccucaugaccuaaucaucccacagagaccucaccugcaaauaucaucacauuaagaauuaagcuucaacauauaaauauuagggggcacaaacauucagcccucagcagaauuaaagcccuacaaauaacuuaugaaaguugauuguagguaccuuauuuaaugucuagcaaaccauacucucuuuaacacaguuuucuggugcuugcaguugaguugaauugugucuuggugacauaacaggaaucacaauauuuaauuuucaguucuagaaucaggauuuaaaauacaggcaagucaguaaccuucugaaacucaguuggcucaucuuuaacauggaaauggugaaaucuaccuuacaggguugaaauaauauguuugaaagcuuuuauaaaagugaaguaaaauauuguguugaguuauacaauuuuaguauuaaagguauuuucaaggaaauagaauccaacauuuucuuuuuauaaguaagaaaacuaggaccuagugaauuuaagcauauugccacaaguugcccaguaaguuagagacagaauugggaauugaaucccagggucuguggacuucacugcuuguccuuguacaccccaccaucuugguaucagguccaccuggauaugccgaauuucaucuaucuuuauucaucuugagcagagccccuacuauauguaagaaaucaaaaaucuuagccaggcacaguggcucauacugauaaucccagcauuuugggaggccgaggcaggcagaucacuugaggccaggaguuugagaccagccuugccaacaugucgaaaccccaucucuacuaaaaauacaaaaaauuagcuggucauaguggugcacgcuuguaaucccagcuuacucggguggcugaggcacgagaauugcuugaaacuggaaggcagagguugcaguggguugagaucaugccacugcacuucaggcugggugacagaacaaggcucugucucaaaaaaaaagaaaaagaaaaaagaaacaaaaaaccuuaagaaagagcauuaagauucacucacguuaaaucauggagcauccaacaggauugagguuaaucugaaugaacauacuuuaacaugguuauauuaguucaauuuugaggggcuuugcaugugccuuguucucacaggcauuggaaaacauauacaaaucuagcuuuugcaaaggaaaucuuagcuaggccucauguuaagcugauaguuuuucauucacuaaauuuaguaagcaaaaauuuaaaguuuauaaagaauuuaaaguuuauaaaaaguuauuuaguacuuagugagcauguuaccaggcacuguucuagguauugguuaugaugaaagagcuguccuuagcaaagagucuggcagaaaauucuguuuccuucuaauuacagaaagaacagauaagaggauuuguaaaaauuuuuaaggcugagagaauauucgaauucaagcaagauguauugucuauuaugugcccaaacauuuuuauuuauauuuuuuauuuaucucuuaagaaugaggauacauucugagaaaugcaucauuuggugaucuugucauuauccaaacauuaucaaguguacuuacacagcccuauaugguacagccuacuauagccuauugcuccuaggcuauaacauauauagcaugucacuguacugaauacuguaggcaguuguaacacagugauaaauauuuguguaucuaaacauuucuaaauacagaaaagguacaauaaaaauaugguauuacaguauaugggacaauagucaucuaugugauccaacauugauugaaaugucauuauguggugcaugacuguauauuaucucauuuaaggacaugacauuuuaaaaauauuuuuuuacucagaguucuucagaacacucacuaaguggggaauucuagucauacaaggccucuuaggggguggauuugugcuauuuucauagauuagccuaauucuaccaaacaguauuucuaguaauucauacaucuuuaacaaaaaaaucuaaauuuaaccuuaggucuaacuagguguauucagguacuauauuugcccccuucuuuccaucauacacauuaauuuauugaauguuuguaugaccgguaaaguaaauagauaucauccucuaggauuaggcuuuuauuacauaagaaaggcaucuuuucuaauagauguugguugacucagaauaaauguuaacaucuagaagcaaaacgauaccugaaugauucaacugaacuuuaaaaaaaauuuuuugaauaggaaugaguguaaacucuagacaguauuucuaguugcauauaugaguauuuugccuggguacagcacccuuugggaaugagugggccaaucaaaaauggcccacaggccgggcacaguggcucaugccuauaaucccagcauuuugggaggccagagcagguggauugcuugagcucaggaguucaggaccagccugggcaaaauggcaaaaccccaucucuacuaaaaauacaaaaauuagccaugcaugguggugugcaccuguaaucccagauacuugggaggcugagacacaagaaucacuugaacccaugugguggagguugcagugagccaagaucaugccaccgcacuccagccugcgugacagagugagacucugccuuuaaaaaaaagaaaaaaaaauggcccacaaacucauauccauuuagggucaaaacaaguuacauuugggauugucuacucugauaugaacucaaccagucagcuccauuugauaucuuucucugauuuaucaaguagaguuccccucauauaaaggcugaagaaugaagcuugaguucugccccucucuagccuugaacaaauaacucuaacuuucuuaaacuugcuuccucagcuauaaaauggggauguuauuaccuggguagauacuucaccagauuguggugagauucaaaugaacuccaugaaaacacuuuacaaauaguguuuuguuuguuauucugcuguucagagguaacuugacauuuguguuuaucuucaauguuauuuucgagcauguugacacuaugauucugaagugacucuuacugcuucucacacuaaaauguaucuucccaugaaaguauuuuucuaaaacugugaguacaacaaauacacagaacacacgugcauacauauacaucauuaaagacuugccuauugacauaaaugggcuuguggggguucccccauaauugggcagcccaucuuuuccauguuucauaaaaacagggauugaaagacaaugugcuuagucauucuauuuaaauuucagcacuccagucauuaaggcauucuuuuuaaaucaaugccaaucauuugcaugaucuaaaaauauuuaaccaacuuuaggggcaacacagagagcuaaaaacaugguagccaucuuuucuauuugucgagaguuaaucuuuauucugggugagcagugauucuuuggagggcugauugcccuuuaaaaaguaaccuuuggggguuuuagucaagcaggaaagccaacaauucuuggguuaagagaagaacagaauuuugagauuuuaguauaaaguuagucauacagcaacaugcucuauauaccacugaaucucaccuucucauccucauggagucacgucaauggggaggcuacagaagagaaaacggaguuuuagaugcugcguaacacuagccuugagugacauguaaaaggcacuauuuuguucuucuucaacuauauaugugaauuuuuaacaaaggauuuaguaggacccuuauaaagguaaagagauaguagaaggaaggaagugauggauagagagaaagauagacuucuaaaaguugguggguauuucuaaaucaacuacauaaacaggaaggauuuagaaaacucuuugaaagcagaaacacaucuuuaaucuuaguacuuggucccaagugcaaagagagguuuuagauugagucacuguaguagucgaguuucaguugcuaagucguggacugaccagagaauuagucaauaaauuuuagagaauuaaagucaacaugaaucuuuguuuuuguguuuuuaacacugaggaacguagcauaccuugggaaaaaccaauaucagcgauugcauuuucagcaggugcauagauggugagacuugguggccgggccagaccccaagcuuugcugcuugcucauuugccugacuccauuuucugcaauguuuccaucucaccuugcacuucucucaucauuauccuuguuucucuccuucucccuagacuucucgggcuucccguugggcugacccugaccacuuugcccagcgacagagcugcaugaauacguuugccagcugguuuggcuacaugccgcugauccacucucagaugaggcucgaccccguccucuuuaaagaccaggucucuauuuugaggaagaaauaccgagacauugagcgacuuugaggaauccggcugagugggggaggggaagcaagaagggaugggggucaagcugcucucucuucccagugcagauccacucaucagcagagccagauugugccaacuauccaaaaacuuagaugagcagaaugacaaaaaaaaaaaggccaaugagaacucaacuccuggcuccugggacugcaccagacugcuccaaacucaccucacuggcuucugugucccaagacuagguuguguacaguuuaauuauggaacauuaaauaauuauuuuugaaaugauugcuaugcagguuuaaacuuuuuuaaugaucaaaacuauuaaaaaccagaguucuuuguuuaaucaaaauuguguugguugugaauauuucaaagcugcuauuccuuuucccacagacaucauugucauggccauguagggugcccugcaguuucaaaagcucaaacuucguggaaaacacaauaagucacucuacccauuaucaagaaauaacugagcauaaguuguaacuucauuauucaacuuugccagugcaaauuguuuuccacuucgaaucuucaaauccacuugaacuuuuaucucuaaaaugucgcugcaugaaagaaaguauuacgacuuccagguaggcaguucuaacugaaaucucuauguuugagauagauauauaugauaaucguuuuucauuggggggguggggggaauuaguaccaagaaaacacuaguauaauuaagaaauguucaguuugcacaaagaacuauccagauaacccaccagcauguuagugagauggaaauacagacccacaacaguaacccaauacuugcagggguugggggcacgguuauagauucaaccauugaccuaagucugcguagcacugggaagaggcuuugguuuagaagccaaggaauaaugaguauauuggggagaacagauuauuuacaagaugaacucuuuaauguuugugagaaucucaaguuucagaguuucucuuuugagaaagaaaaagggguaauaagguagaaauucacaccaaugaacaagaggauugcugcaaaguaacugaggagaugucucgccauugggacccuaaugccauuuuuggucaaacauuguuuugagcaagaaucuggcaaacaaaauaaucaacaacaaaugugaauauaguuucauuuacuuuuaauuuuuaaaucuguggaaaaguuuaguugugcuucuuguuaaaaagaacauuucuaucccugaaaaugcuaucuugggcuuaugauuauuguuaaacuccaaguauaaacugaaaaaaaaaacauaucccuaacucuguuaugaaaaauggagacuucugauauuaaaugcuuucuucuacuuggaagaggccagagaaaacagggaagagaaagacauuauugaguuugaccauguauuaugcugaauaaacaauaagcacuuuagagucccucccucaaacucucauacauuucauauuucuuuuccauuuauuuucaguuuuguuuuagaagaaaaguucaucagagaauuuuguucugauaauuucaaguggccaucuuaggucaguggaaaccguaaguccauuggacuuuaccucauccuuucuuuguagacaucugggagaggaagaggagcuuguaaugauagcacgg

SEQ ID NO: 17773 - RNA, 1758 nt, Homo sapiens
auauuuaggggcagagagaggguuuucuuacaucagacuguuuaguucuuuuuuaauaggcugguuaauuacccagauaaaagccaauauuugaacucuuaauuucugauuccagaguuuguacuucuguccacccauuuuauuaauuuucagauauguuucaaugucuauguacauuuuauuguguugucucuaagaaaguuagcaguugaaauguagauuaggcauucucauuucugaagaugauuccuuuaaucagggauucccuucuauaauuguaguuuuuuuaaaauuguguuucagcaccuagaagaaugucuggugcacaguaggcacucagaaaauaacuguuaaaugaauucagaucuugcacacagcauugggcuuucugaaucauauaugauaggaaguagaagaaagcccaaguguccuaagucccauucuagugcuguagugcacguguacacacucagauuugacaaaggcaguugugcaaaccgaaauaccuucagcccugaaagagagguuuccuguguauggaacuucuuggggcaagcauauuuuuuuuuccuauuuggcaguuaggagguauuauugaagugguaacaaccauaagugggccugauaggagcaaguggaaaaagacuuugugggguacagaacuauucugcuuaagaagucuggggguacuugugcaugaagacugcagccuucuggaucuugauuuaagcauacagucugcugacugcuucccagagaccuucccaucuguuccuuucugcugaauaggucuuuuuaaacuuagaauggagagacgucccuaagggccucuccagagccaucucuuuccuucccuauuagcuuucuuuccucuguuucucucugcuucuacccaucaguucuucaucuuuggaguagggauggggguaagagauuguugauguugaccugguuuuuagaggagccaacugccaaacuaaacaggcucagcuauuggcauggccauuugcucugugauguugcuuuugacaucuggguccccauucuuagggagggaucaguggaguagggcuuccccaaaagaagcaggaagagggcaagaccacaguauuucuacgauuucucuucugaugauaaugaguaacgauguuugaacuuaugauacucagucugccagccacguuaaguuuuugucagugagugggauaaaagggaguuguacuagaaaauagaauaauaaugaggaggguauggugucuggaaauauuuaaacaaagaagagucacugucuaggcauggagagaaaaauaauuuauuguuuuaagcuacaucauauauuuagaccuaaaagcauaguuuguuuguaaaccuaaaguaauuuuaaccuaauuuaauauauucugguaauauccuagaguaagauacaauuagaaauuuaagaauuuuuuuaaaaaaugcaauauaguaacauuucccuacauuuuaaauuaaucuuuuaagauaauuauaauuacaugcuuauuauauauacccauuggaaaauaaaaaaaaaucuucaugaauucaccuucaaaaggcagccacuguuaguauuuggcauauuuucuucuagccuuuuucuuuuuguaugguuuuugguuuugcauagcagucaaggcauuuugcuugccuuuuagugggauuuuuuuggucuucaguuggaguugacugugguuauguucugauaaugcaugucugugauuuauucuuuucuuguca

SEQ ID NO: 17774 - RNA, 9739 nt, Homo sapiens
aagaaacagaaguucaaaauuuuuaacauauuuaugcauccauccauuuauucauucauuccuuugaucaacagauaucuguugaauauuuagacaaagagauuacaaaagaaacaugguacagacccacucucaaaggaagacagauaaauaggcaauuaaaagacuauaaaggcugggcgcgguggcucacaccugcaaucccagcacugugggaugucaaggcggguggaucaugaggucaggagauggagaccauccuggccaacauggugaaacccugucucuauuaaaaauacaaaaauuagcugggcguggcggugcgggccuauaaucccagcuacucgggaggcugaggcagauugcuuggacccaggaggcagagguugcagugaguuggacccaggaggcagagguugcagugaguugagaucaugccacugcacuccagccuggugacagagagcuaaacucugucucaaaaaaaaaaaaaaaaaaaaaaaggacuauagcaugaucucucuguaugaaaaacaaaaacacuuggugcuuugggaacauguauuugaggcaccuaaccuauuccaagaggaugugggaagaugauauuuaaguggagagcaggaagaagaaugugacuuacccaggugaagagagaaagaaaaagaaguuaaagcagaggagaacauggguaaagcaucagaaagaagauagagagaaauuuugagaugcuaauaugguggauuauagugcugagguuaggauggaagcaagcauagggacgacuagaucugaguuaacaacaguacguaauaaacccucuggggaaccucuaguucucacuagaucuuaggcaaaaguaggccauugcccggguucauggcuuagcauguggauuccagccccacucaaauucuuagccaggugccugugucuguaggcagcaaucuuggccagaugacugcuaaccuauauuaaggaguugaugcuuucucuucaggacagugggaaacccugcagggcaugacucagaggaacuagguggucagauuagaauuuuaggaugaucucuccggcuacagcauggaaaguuucuuagaagauuucaaacuggagucaaggagaaugguuaggagaccuacucggugguccaaaugagagauaauuguggccugaccuaaaguuguggcauucauuggcguuggugccaucaugacuaauuaagagaaguguaucagcagccuucaagaggcaaaagucuugcucuuucucaccaaagccugucuuggugagagacacaaaauaauggauuugcugaaccauuauuuagacucagugagaaaauagauucuucuauuuuuuaaaaacaacuuuauugagguauaaauaauauauaaaaacuacacuuauuuaauguauacaauuugauguguuuggacauaugcaaauauccauaaaaccauuacuacaaccaaaguaaugaauguauccaucaccucuauccaaagggaaauagguucuacuuuuuuuuugagacagagccuggcucugucacccaggcuggagugcacuggcgccaucacagcucacugcagccuugaccuccugggcucaagggauccucccaccucagccuccugaguagaugggacuacggguaugugccaccacaccuggcuaauuuuuaauuuuuuuuuuuuuuuauagaaacagucugacuuuguugcccagccuggucuggaacuccugggcucaagugaucuucccaaagugcugggauuacagacaugaggcacugugcccagccuggaaaucgguucuuaacaauagaaauuacaaagagcaguaggaagagaaacagaaagagauuucaucugucuccuaagcuggcccaaaggagcauccccuuuccuuccuucauuuguguaauaaccucgcuugagccugacaaaaacauuuauguuugugacaacuuauuccauucuuucucuccaagggcauauugaagacuuucauucauugccucaaaaagcaauucaugcuuucaagauugugcaauugcaccgaguuaaguuuuuacaggcccuggcgugggugagacaugagccugcaggaugaaggugugaaaagugcagagagucaggcaacagugcgauuagccacagggagaauuuggguugcuauguguaaauauccauagccaccagcccaggggugcuugcagggcuaguccuugagcuggaaaaaccacuaaugaacacaaucacucagguuuuucucuaguuuucuuuuuuuuugagacagagucuugcucuguugcccaggcugaauugcaguggugcaaucucagcucacugcaaccuccgccuccuggguucaagagauucuccugccucagccucccuaguagcggggauuacaggcacgcaccaccacaccuggccaauuuuucuauuuugguagagaugggguuuugccauguuggccaggcuggucucgaauuccugaccucaagugauccacccaccucagccucccaaagugcugggauuacaggugucagccagugcauccggccuuuagauguuucucuaauuuucuaaccaaguuauuaaaauucuguuauuuuagccaaaggaaaaaucccugccauaaaagagcaagguguauuccuagaguuuuccccaccuaggcauugggacgcucaauaagaccuacuuucucuggggccuccuuuggucucucgaaauuccuuucagaguuaaaauuccaugcuuucaugaaauguuugcauuuugaaguuucagcccacaauaggaucucaaugcauaucugucaaagggaggaaugagcauuuuuugugcuagacccaaggcuagacugggagacacaaagauaaaggaaaaagguccuuacuaaugcucacagugcagcagcagaguuggucuuauacacaggugacaaccgggcacuguccuaggagcuguccuagcuggggaaucauagagaagggaacgucaugagggaugguggagcggaaucugagcaaagguuugccagaugugcaggcaagcccauucaaagcaguggaagugagacaaagguccacuaauuaugcuacacaacuugaaauagacaugugaggcuuacaugcaagaacagcuccccgggagcuugcaggauaauugucugaccagcugacagcaaaaucaagauacccuguggcuccuugcugcacugucugaugcagacagaugguuguaucugaccaguagauugccuacggagggucagcaccccaagggccgauuucagguguauuuuggagacaccuccugagggcuuguauucagaucuauuuaggagacagcacauacaggucuggcacauaaaaauaguacaaagaaaauaaagaaauugugggagaggggugcaggugaauagaugaucugcccuuggugaacugaaccaaguuccauaaagccaacagacucugccuacuagugguacuggugaauauaugguaggaagaauuagaugcuuuccaucaacuuuaaaaaaaaauuuauuuagacggagucucacucugucacccaagcuggagugcacuggcacaaucuuggcucacuauaacuuccaccuccuggguucaagcaauucuugugccucagccucccaaguagcugggacuacaggugcucaccaccaugccuggcuuuuuuuuuuuuuuuuaauuuuguauuuuuaauagagaugggguuucuucaaguuggccaggcuggucucuaacuccuggccucaggcaagccacccaccuaggccucccaaaauguugggauuacaggcgugagccacccuacccagccuucaucaacuuuuugugcuaggaaugaacguaaccuaucucucccuucacuuucugugaauuacucuucaacuucaucuaaaucuuuccacuguccuagcucauagcaagcagaacacagaugaucaucuggcagaagaauccugcaugguaugugaaguuuuccuagaauaaugguuugcaguacuuuuuaaagcaucagaacccccuuucgauauuaaauauugcuuagaagaacaauauacaaacagcugugaucaagcaacaaguguaaacaugcauugguauuuacaaugucccaggugcugugcuaugcacuuguauguguguuuuuucauuaaaucuucacaauucuaugaugugguaucuauaaaauaggaauuacuucuauccuuuuuuaagagaugaggaagcaggacaucaaaaguuacagguaauguguggcaaaucuagauuuugacucuggaaguuugcccucaauguggggguccugauggugcaggagguccuguucauauggcccagcugggacaggcuggggcgguaggaggcacagcugagcccuguugaaauccaucucucuuuccugcucuucugggguaacagguguagcuaagugucuccauucuccuuccuccuuauacucucucaccuuggggcucaagaauuuggaugauuuaccaggcugcugugaaauuuggucuaagaaacauugccuugguucauccuucaagaucucuaccagaguccauauuccaucguauacacucaauaggagagugaugcuuauagacaaauaggucuucaaaaguggaaguuaauaccaaucacaacagacaagguguuguaugauucuauuuauaugaaaugaccagaauaggcaaaccuauagaaacagaauucugucucuaugaaugguuacugaggccugggagaaugagggguacaaggggaaugacuguuaauaaguacgggguuccuuuuggauuuggagugaugaaauauucuaaaauugauuguggugaugguuauauacuuuugugacuauccuaaaaaccauggaaugguaccauuuaaauuggugaauuguacauuaugugacuaggucucaauaaugcuguuaaaaacaacaacaacaacaaaaaucacccagaaaugaaagcagagcaucucguuuaaaguucauuaaguguguuacuucauuuccuucuacaacgucuguggaaugccauugcugacuaggcagccugccacacauggggcacaggagaaaagagcucuuggucaagaauaaucaugacacagcagcaggaagcagccuugacugcacuaauagcaugucaugagcaagcagagaagaggcccagagccuggcagaggagcuuguguugaacccaaacccagauuuuaccaguagggaaacuccuuagggagccaggcuggggcauggauguuuuaguagagcuagcaccacuugaaagguuggaaaaaugagagggcagggcuuguuuggggcuuugcaugccuagauaacagauuauguggggagagaccaaggagaagaggacuaaagauaagcagaagcugaaugaccccauucccugaacauucauucaucucuucacuccuuuauugagccucacuugugucaugcagaggcuaggucaguuguucucaagcuuggcuuuuggaauuaccuaaaucucaccucagugauagcuggucugagugugcuuugggcaugaagauuguuaagagccugggagauucuaauuuuaguugauguugaaauucaguaggcuguaugauagagauaaagaaaaaauuaaaaaaaagauuaaggcagauauggugcuggcaccugguguguacaaucaacaaugcuuucugaguugccuacuagguacgagauacugugcugaguaaaacauaagagucucaguucucaugaagguucagacuaguggaaacaacagaaaauaagcaagugggcagacugagaagcuuuucaucacaacaucagauaacugauaugaaggaaacaggaaagguuaaaagauagccaauaacgaagaaaaagauggcucauuagauuggcuggucaaggaagaacucuuucuuuuuuuaacauuuacuuacauauguacauauaaaugcauacauauauauguacaaucaucaacacaaauuaccaucuccaaaaauuccucaugccccacuguaauuuuuuuuuuaauuuuacuucacguucugggauaccugugcugaaugugcagauuuguuacauugguauacaugugccauggugguuugcggcaccuaucaaccugucauuuaguuuuuaagccccgcaugcaucagguauuuguccuacugcucucccuccccuugucccccaacccccaacaggccucggugagugauguuccccucccuguguccguguguucucauuguucaccugucacuuaugagugagaacaugcaguguuugguuuucuguuccuguguuaguuugcugagaaugaugguuuccagcuucauccaugucccugcaaaggacaugaacuuauuauuuuuaugacugcauaguauuccaugguauauaugugcuauauuuucuuuauccaguuuaucauugauggacauuuggauugguuccaagucuuugcuauugugaauagugcugcaauaaacaugcgugugcaugugucuuuauaguagaaugauuuauaauccuuuggguauauacccaguaaugggauggcugggucaaaugguauuucuagcucuggauccuugaggaaucaccacacugucuuccacaguaguugaacuaauuuacacucccaccaacaguguaaaagcguucuuauuucuccacauccucgccagcaucuguuguuuccugacuuuuuaaugaucaccauucuaacuggcaugagaugguaucucacugugguuuugauuuuuguuucucuaauaaccagugaugaugaguuuuuuucauauguuugcuggcugcauaaaugucuuuuuuuugagaagugucuguucauauccuaggaagaacucuuugagcaggugacauuaagccagcaccuaaaguaugaguagaaacuggccuuggaagaucuauggaagaauguuccuggcagugggcacaugcugggugcacgugcuguuguuguuguuacuguugcaaggaacuggcacauauucagacuccaugaggaaacauggugugugggagggacuuuaauguguuuauaggcuguaauguuuuauuuauccguguaugugaagaaucaaagacgcuugauuauaguugcuuuauaaaugccuauggaauaaaugaacugauguuaucaguagagaagaaguugaaaggaaaggcgaugguugaugaguuuuccauaggaagugggaagagagggaaucuacagugcacagaaaaagagguaccucugagguaggaagggagaaguggagaauagauauauuuuucuggugcagggacaggaaauagaauuuccuucugauagcuacuguguucuuuauugggggaaaagaguuuguuugcugaaagcaagccaggugggagugggaucaggguucuaaagaggugggaaguguuacuuugcauaauuagagaagugagcuggcuggggacauuuguaagaacugagguggugcugagugcccagccagggguaggccagacaucaaugguggugccaauggccaugauuuuggaaugauguuuaccucuagcagauagcuacaucuucgguggagaauuugcagauggguauggcaaugguaggacaaagaaaugaacaaauugaaguggaaggagagacagaucuaaauugauauuaaagacuagucggagacauagaggaaguauugucaagaaggagcugaggucagacgcaguggcucacaccuguaaucccagcucuuugggaggccagggcagguggaucacuucaggucaggaguucgagaccagccuggcaaauauagugaaacuccaccucuacuaaaaauagaaaaauuacccaguuguaguagugggcuccuguaaacucagcuacaugggaggcugagacaggagaaucgcuugaauucaggagauggagguugcagugagcagagauugugccacugcacuucagccugggcgguagagcaagacuccgucugaaaacaaacaaacaaaagaaaacccugaauauaagaagaggaaggaacaagggauaaacuucuaaugaguccaaagccagauguaugaugagaaugagggagugagaggacugggagaaagagagugccuuguuauuccaugguaagcacugcacauauuaaaguacuuuaaaauauaauagcuaucuuuuacugaguauaacuccaugccugcagaaaggcuaaggguuuuaucuacagaauuucauuuaauccucauaguauauauuacaacuccaguuuuacugaugagaaaacugaggcuuggugagguuaaauguauugcucacauuuucgcagcuaggaagaagaaauugccucugucugaugaagcaaaugccccuaacuaccgagcuaggugauguugaucuauaucuuuuuguuguuguuggagaacaaugcaugacuccuguauccuccucuugugaguugaugccccagagccaguuauauuaacacauucagcgcugcaagaugaaguccacauccccuagagugacacaggaggcuggucagaguccaucccgcacccccuucucuagauucacccucccacaccgucugcuccugcuugccccgacuauuuucaaguucacugaacacaccacagcaguuuguaccuggugcugucugggucggugauguccuucccccucuucuucuccuggcuggcuccuccaaguccuucaaaauugagagugagugucacccccuuuccacuuuucugagcugaaaacagugaaaguacuauugcuuuucacacugggcaggucuaggucuagggcuucucugcagaccuccaccauaacucucugccaucccucaacuccgccuccgucacauuaaaauucugugaugcugacugcuuguccauuguucauuucacaagcucacagccccuucccuuuuguuuaguauuucacugucuggaaggacccagaaauaagauagaaagaggugcugauaguaguuagugauagacuuugcuagcagcccggggaacaccuggcuuguaccucuaaguggcuagucugguuaccacagcauccuuuuagcaguagacuauuuuuuuuuuaauguagccaguaaauucaagauaucugugaauaucaaggaacaaaacaucuauuaucuaauaaaacaauuucugacacucacuuuuguaauucaaaaauuaaaauaacuguagcuacuauugcuuuauauuaauuguguucucguuaguagugugggucacucagcaggguggugggugguuucguggauguggacuggaugccaauuaagaagaccuggauuucacuuucugguugggugauggggcaaauauuuuucugagcuucuaauucuuuauguguaaaauggcaguaguaggagagccuccucggcauuguuugggaggccaaaugacagcaugaucgugaaaagcccuuuguaaacuguagcguguuuuagaaaaaaaaaugguggugauauuuuccagagcgucagaggaacuuaaacagcauaggccugccccuguuugaccuggaaaugcuaguucagggaaugcauuaacaacacagcaggaaacuugugcugcgaacuccuuuuggaaacagacugaauccuacagaaugaaagaga

SEQ ID NO: 17775 - RNA, 49764 nt, Homo sapiens
cccagcgcuuacccggcugauucucaguacccucacccgacgacaccucuggcccauguucugccucccuacuggccgccgacgggaauuuuccuuccccccagaucaccagcagcagguaccgauccaucuccucagagaucaccccccaacuuuaggucucggcuuccacauccaaacagacgcgcgcuaugacgcauuuccgguucccuucguuuaggucggcuggaaauuauguccuccgucgguuuuccgcaguuuuuccaccaagcgagauauuuuugggaguuauucccuaaauaacugcauuauaugcuccuuucaugacgaaauugcugccguggagaagacuggaggaaacucgaggaagagggagaagccgacaagugcucgacgggcuaggaacuguccugcuuggguguuagcguuucccgccgggccaguaaggcugagugacccggcguggcuacuaggagaaggacguacgguccugcuaguagaggaauaugucgaguuucucuagggcgccccaggugagcucggacucuuauggcuugaugggguucauuauacuggcagaaggagagcguugguuccggcagauuaaguagugaagcuggggcggcagggaagccgagacccucggccaagaggugacuugggaaagcacaagagggucgucagucuggcaagcacuuaaugucguucgucuguuacucguccccucuucuuuucaaucugcccuuuucaugucuuucuugggggggcggggggaagaggauuagagcagaucggagagguaauaagguggaucacauagggcauuguaggcccuugcaauaauuuguuuuuugacugaguaaaauggggaccuuuuggaggguuuugauccacggaguaacaggaucugaccuggugucaaaaggagcacucuggcugcugggucgagaauagacuguucagaaauagggguuaguagaggacagaagcaaagaauauguuuggaggguguuacaguaauccaggcgagacgugauggugcagaggccacgcuagaaauacuauggaguguguugaaaguggucagguuuuguuugaagguggagccaguaggacuuccugaauauugaguauaggccaacagcaaaagaagaaacaaggauuaccccaagguuuuuugguuuguccaacuggagggugugucaucaacugagauagggaaggcugagauugaaccagguuucagguggaagaauaggaguuaguuuggguuauaucggucuaagaugacucucaacucagugccgcuccaaguaugguuccuuccuugggcuguuuguugccugucugugaugagauaaauacaggaaguaaaauaaaaauuuuaaaaccuuuuucagcaaucugacaucgcccagcauuuguauuuuuuucauuaaaaauuuuuuuuuucuaaguaucaaacuauuagucuacaauggauggggacaaaaacuggccuuuuucuuauauguagacuaguuugagguugugauaaguaaauuuaaaauaagaccagcuagccucguucuauuuuuccagcauuguuuagccucuuguguauaugcauagagaaagcaucugguggagaucuuucuggccuagaauuuucuaagaauuugaauacauugaugacgacuguaaaaacaaugcucuauuccugaggcaaccuaaagauaccuauuucaggcaacuuuuuaaaguugaaauuuauuccacaucacccaucuguacuuucccaacuacauuguucuauuuaacucuccccaggaauugaacuccugaaucgucuucaguuuccaguuggccacucagcuuucaauauaauguaccuaauaaucucuaaauguuuuugaagaccuucauaaacagcuucuacuuucuuacaagcuucucauugccccuccagauucuauuauguguuauacaaaaaaaaaaaaaaaagucauaccguaaagggaaauauaucuuugggauauuuauaacaaaacguaagucauauugcuaacaggaaaccaggaaggaauaauuacuguguuugucuuugcagaaugauuagaaaaaacaacccuuuuccagaaauagaaaugaaaacaaaaauucuuuagcaauagaguuauuuuucaaagaaauuguugacauuaauuguagaaacgugaugauauaugauaauaaauuuaauuacuguauuuccauuuuaaugauaauuaucuuuauuuuuuccucuucuuuuuuuuuuuuuucccccccaagcaaugggccacuuuugcuagaauaugguaucucuuagaugggaaaaugcagccaccuggcaaacuugcugcuauggcaucuauaagacuucagggauuacauaaaccuguguaccaugcacugaguaaguauuauuuuagaccugucauuaaccacuguaguuuucaugccagaauagaaucuugaugaaguuuaacagggcugaguuuaagggcccuuuuuauuuuuccugaggauccuguauuccauucuugcugaaaccauacuagcgcccaaaacugaauuuggcuuauucacuggaaaaccguauggaucaguuuacccggaacaagccuauuuuaugccacugcccagcgaaauuauuaguagcccuucuuuucacacucagaaauaaccugauuugccccaugacuuaaacuuucacuuuuauauaugucuuuucacgugaugacauccauauaaagaguuuuuaagggaaauaauuuugcccucucuucuaaaaaaucuuuuccccuagaaaaauauauggugcuagcuagguaugggaagcuuauuuucacuaauaagacuaauagacuugcuuuucuguauccuuuuuccaaaauaaaauuaaaaaguuguuuucguucuagaagauuucugcuuacagauaguuuuugauagacuucauuuaccccagcacuucauggccagauccagaugucaguuuuuaguccucauacugguugacuugucaacagcauuugcugcaauugaucacauuuuuauuuagcuuuuauugugcaauauauuaaacauacaaauauguauauauaaaaauaugugauauuuuaaagaaaauuaaccauaacaauuauaauggugaaaugaauauacucagcauugguuuguuuccaauuuuuuuggcauuauguuauauuacauuaauguugcuaucaauauucuugugccauuuucuuagcacacauggaagaauuuuuccaagguaugcccaaaagacaggaauuacuggguuuuaaggugcauagcaacuauugagucuuuaucaugccaguagcaugcaagaguuuccauuacuccucaucuucaauaacacuugauauguucguucuuuuuaguuuugacuauucugguagaaauaaaaugcuugcuuugugauuucaauuugcauuuucucgaugacaaauauggcuggcugaguaucuuaccacuuauuggccuuuacagcuuccuguccugugaaaugucugugcaugucuuuugucaauucuucacugaguuguuuguccuuugcuuuuuucuuacuuuuauuacaaaagguuucaaacuaucagaaaaggucaaagaauaguacaaugaauuucuuuauacucuccaccuaaauacaguuaacauuuuaucauauauuuuuuauucaaccauuugaaaauaagcugcagaugccauuauaauucccccaaaguacuucagcaugcaucuccuaaaaauaaagauacucucuauguaaccagaaugccauugacacacguaagaaaagaaacaguacuuuauuuagauggucucauguucagugcauuuuuaaauuucuuugguuuucccaaguauguuucuuacagcuauuauuuuuuugaaccaggaugcaaccuagguuuauguauugucuuuaguuguuauguuccuuuaaucucuuaaucuagaauaauccuucuuuuauuuucuucucauuaaccuuuugaggaguccaggcuaauuuucaucuggagaacuuucuucuugaaacacauucuucacuuguuucccuggauucacuuguuucccuguuucuucucccuuucuuaguacccuuggcuauccucagccuucuaaacucucaaaugcucuucucaccaaaaauuggaagugcgucagggcccaguccuugaaccucuucucaugccuuagaugauugcauuuugucucauguaucuaaaaaucaucuauaugcuaaugccucccaaauuuaaaucuccaguuuugacugcuucccuguauucuagacucacauauacacauuucuauuaagcaaauucaucuguugucuaguagacaucuccaaugaauaaguccauuuggagaugucuugcuucuuaucuacuucacccaaaccaaccuguuccuucccaguuuucccugucucaauuaauagcaucacuguucuuuuuguugcucugguuugaaggcuuugccuuaucugugacuccucuuuguucaaccaaaaaaauaaaaaaaguacauauauauauacacucacacacacacacacacauauuuaaaaauauauuagaaaaaaguauaucugaacucuggcacgucucaucaucucucccucuacucugauuuuaagcugcuguacuccauccuguuuuauuccaaaaacugccucacugugaucuguuuucuucugccauugccuccacguaauucuuucuccguagaucaacuacaguuaucuuuuccaaaugaaauuucuguguguccuacaagaaccuaaauaauauggucccuguuaccuuucugacuuucuuuccuuuauuuauuuauuuauuauuauuuuauuuauuuuuuuacuauuaauuguuucugucaauccacucagaccuauacuguuccauuaacuugccugccgagcacauuuuugccuuaugccuuuuuuuuuuuuuugagagagagagagucucacuuuguugcccaggcuagagugcaguggcccaaucuuggcucacugcaaccuccgccuccuggguucaagcauuucuccugcuuuagccucccgagaagccgggauuacaggcauaugccaccacaccugacuaaguuuguauuuuuaguagagacaggguuucaccauguugccaggcuggucuggaacuccugaccgcaggugauccacccaccuuggccucccaaagugcuuacaggcgugagccaccaugcccagcccuuaggcccuuuucacacacuguucccucugccuagauauucuuuaccagauaucugcauagcuuauuucuucaugucuuucagauuucugcucaggcauuuauauucugagagaggccucgccugauuccucugcucacccuuucacucuauauaccuuuaccuugcuuuaaaaaaaauaguguucauguaucaccugaaauguuauguaaguaucuguuuauuaucuaccuucuuucacuagacuaaguuccaagagcacauaaaauuuugccgguuuuguacacagcuguauccccaguaccuguaguagugcuucacacauaguuggaauguaagaaauguuuguuaagugaauacuggcauuuaugaauuccaguugugaaaaugaagaaaauacuuuuagucagggcucuggcauugaagcuaagucagauuuuuggaucuauggagcuaagaggaagaguauuccaaaugauuugauuugagcaagagcaaggauuuucuguaauuucuuauacuugcugcucuaaccuuuuuucucuaccuaaugaaaauuucaauaagauaucaaaauaaacccauacucugaaaucugugaguauagaauaugaaucugagguuuugucuuuuuaaucuuuguuuuucaagcacccaguacaaugucuggcccauaauagaugcuugccagaaaucauuuguagaaugacacuuucaaacagauguuuugugaguagccuguucuuguucccuguaguuauccugugaacacuggauuagugaauaccgaaccauugcuucuggggggaaauacggaguuagguuccucugaaccucuggucacagcauuuucaucaaccaaucaauacauaaccuuguuuuauguguguuucuguuuaaagauaucuuaacacugaacuugugaccaacagcaguauaauaacaagcuuaucuaacacacauauuaucucuauaaggcaacaacacagccuucuuguauuuaggaacacuaaauagcacucaguauaccaagcuugggggauauuuuaaacagugaagucacuaagaaaaaguccacagaugccagaaacauagcacuacauagaaaaugaaaaggaugcuuguuuguuguaugaaaggugaaagaaggcagagcaucaccuuguucagccucagcugggaacaugugcgucaaguaacacaaauuuauuuccacucugagcauguccaugaaugacugcaaaagcacuaugaguauugauuuugggguaacaaauaaauuuuaacaaguaggcaaauuuguaaauauggaaucuaugaauaaagagaucaacuguauuuugaaaguaaauagugaucaggagacuuacacuuucacuuauaaaccuguuuacuuuaaaaauauuuuuuggcagaccagaaaaauagucauagaauuaccgauuuauagaguuguuuaauuccuuaggacuuuagauauuuuguuuaaccaccucaucucuucauugacagucgaguaaacuaaaaucaggauuucauugcuauucagcuauauuauaguagaacugggacuagaacuuaggcaccuguuucuuauguaggaaauuccccauuccacuucagucuggugauucuuaaccacuuguacugaguuuuccugcugcuuuuuuccuuagcaaugguaucagcagauaauaaaugagaucucuuagguugucuuugcagaaaugcaaauaauacaaaauuugaggaaaagugcaauuaguagcagucaccuaauuuccaucuccaaauauagcacuaacuguccacucaaaguucugcuuccuuauaaccaggucaucauugcaaaagcauaccuuagauauggaugaauaggcauucggcuaggauaccagaagagcuguuguggcugccuauuagguuucugugaaaguagaaacuuacuuuuuaaagacugaauugcauuuuuguuucacuauguguuuugagacagggucuuacucugccauccaggcugcagugcaauggagccaucacagcucagugcagccuccaccuucugagccucccagguagcugggacuauaggcguguaccaucauacccagcuaaguuucuuguaguuuucguagagacaugguuucacaauguugcacaagccggucuuacuccugagcucaagggauccacucaccucagccucacaaagugcuggaauuacagaugugagccaccuugccugggcauguuucaguguauuuaauauguaacauauuagcaaaacuucucguguccagaagaugucacuaaaaucaaaacuuaaauugcaaacaauuuucaauuuauaaauauguuguguuuuaagaguucauucuaacauuuagugguuuaauaagcauuuauugagcaaauauuaugggcuuauaaucacuauaaacauauuuuuuuugaaaauugaccuacaguuucccagaaaaauaauauuacaaaugaugaucauuguucuacaaaugguuguaaaaauuaacaaauaauguacugaacauaauguauacaauauuugaacuaccuuauuugucaaauggaugucugugaaguguuguggaaaccgacuuuucauuauaagguuauuuuuuauggaaaauguggguuaagguagaaaggauguggaacugguaaaggaaucccuccuucuaauuagagcugcccucuugaauuugggacuugagaacuuuuugaacguguuucugauaaaucaaaaaauagguuauauauggugauuaguggaguaugacuuauucuuuaugaggauucuacuccuuucacugccaacugaauuaaugaauuaauauucauugaggaggacuauaggaguauuuaaaggaagcagaggaaaaccuuucuuuagcuuugcuaaaauuagauuauguuaaaauauuucuguucugcauugaaugaaacaaaaguugcacucaguuuauaaaaauuaaugcuaugaaugcuaacauaccaaacaauucaacagagaucagauuuaugaucucuaguauucugccuuguaaguuuaugaugcuguucuuaaaguugcuuagcuaacauuuuucucuuacuauucaguuaaauguaaaaauguauuucaaauguuaauaucacagcauuuuaauuuugcaaucuaaauuguacauuuauacuucaccucacuccuagaauaucauccuacaaagcacugaaggagauuuuugcuucaggcuauaucuagaauacguaucuccuuuggaagugacuauauugauauugucaauaaauuaaacaauaugccuuggugcauguuacaguaucuauacauucagcagauuuuaugguaaccuaucugaucauucaucaccuuggcugugcacaaguucagggaugccaaaaauaacacugaaguagccauuuggacauuuguccuuccaaacuuagaaacaaacauaaaggccaaagccaaacuuuguuguuuaucacuaauucagaauagcuauuuuucaaacauuucucaaacuaaaucuucaaggaaacccaauaaauaaaagcaguacuguccuaguugaaggaaaaagaaccuggauccuugugccuugagucaccuuuuagaagccuaagacugaaucaccugcacuuuaaaaaccacuaugcuaaaucaaacagcuuauaaggaaggauucaacccuauaaaggggaagaaaacaagcuacagacuggaagaaaauauuugcaaaccacaucaucaacaaaagacauaucuaaacuauaaagaacuuucaaaacucaacaguaaaaaaacaaacaaucuaauuaggcuaugggcagaauacaugaacagauggcagauaaguacaugaaaagauguucaauauaaguagccauuagggaaaugcaaauuaaaaccgcagugagauaauacuacacaacuaucaaaauaacuaaaauaaaaaauagugacaacagaugcugaugaggaugcauagaaacuggauuacucagcauugcugguagaaauguaacaugguacagcaacucuggaaaagaauauggcaguuucuucuaaaacuaaacaugagcuuacuguauagcacagcaguuucauuucucuuggacauuaucccagagaaaugaaaauuaaguucaugaaaaaccuguaccaauuaaucgcuucacccuauuacucuuuaucuucccauguucaucagcuccuggcauauugcauauucauuuauuuguuuguuuauugucuggcuuuucaacuagagcauaagauugauuaacaagaauuucuuuguaaggaacuuaaacaaauuuacaagcaaaaaacaacccuauaaaaaagugggcaaaggacauacauaaagagacacuucaaaagaagacuuacauacagucaacaagcaaaugaaaagaugcccauaucgcuaaugauuagagaaguguaagucaaaaccacaaugagauaccaucucacaccagucagaauggcuaucauuaaaaggucaaaaaauaauagacauuggcaaggcugaggagaaaagggcaugcuuuuacacugcuggugggagugcaaauuaguucagucauucuggaaagcaauuuggugauuucugaaagaacuuaaagcaugcagauauguucauuuuagcacuguucauaauagcaaagauacgucaucaaccuaagugcccaucagugguagacuggauaaagaaaaugugguacauauacaccauagaauacuguagagccauuaaaaaaugagaucauguccuuugcagcaacauggguggagcuggaggccauaauccuaaguaaacuaacacaggaacagaaaaccaaauacugcauguucucacuuauaagugggaguuaaacauuggguacuccugggcaugaagggaacaacagacaacuacuugaggguggagggugggaggagggugaggaucaaaaaacuaccuauuguguacuaugcuuauugccuaggugacaaaauaaucuguauauucaacccccaugacaugcaauuuaccuauauaacacaccuguacauuuaccccugaaccuaaaauaaaaguuuaaaaaaauagagguuuuucaguuacauucauugcuguauucccaacaucaagaaugguacauggcauuaguaaguauguaauacauagcaaguggauuuguucaucaauggaaaaggauuauaaagcaaauuuuaaaagagcuggagacucucagcaagcugaauuggugucucuaucugaaucugcccuugcauggaaucugaguaucucaaacauaguuaaaaaugaacacuagggauuuuuguaaacacuuauugugucugauaacucuaugugagggaucuauaauuaagagucugcagcaaggaucuaggaccaaaaaaauuauacaaaugcuagaacaaaguagaguuugccauuucaguggcaaaaacugcaaauaguuuugcaccaaccuaaauagcauggcuuaccuggcccagacaguaguguuggaaaaacugguaaauaaggcuacaaaaaguuauccuauacucuaggucuccuugaaucccuaaucaaggagcugguacauggggaaguacaaagauggcaaauaacuguaaccugugagcaguuugcugagaaggacuucugagaucuuagaauuuagcagaaaagaauacgugaucaauuagugaaugauaucauugucuccuuauggcauuuuaacuaccacuuuuugccaucugguugugguagaaaugguaagaucugccuuugaaguuuuacuggaguuguauuugaaacuuaacuuuaccacuuauuagccauauaauuuuagcugaguugaaccucugacucuguuuucuccguaaacauuauuaaauaguaaaagugguagcaggcagagggaguacguuagcuuuaccuaauaagauaguugugagacuuuaaguguuaaaagugaguauaaaaugccuagcucagugcuuugcauguagaagauguugaauaauuauuacuuccuuuccucccaggcaauuuugaggaaaaauuaugacuucauucuggcuuaagggagaaggugggccaaaacauugaggcgguguaggacuaagagcugccccugaugguguaaccuaucugagaccuuagguuuccugacaugaagcuguugaguuuucacuuugucugaauuaguuugaauuuauuuggccauuuaauugagcaccuaguauuauacugaggagucagauaaaguuagaaguuuaagguuagaauuuuuguaaauaaacucacaauuccuauuucuaaaaauugcuuacuauuuuucaacuuaauuucucuucagaacaucucuugaucaagcacuagagcuaugauuuauuuacauuugguacauauauauuaaaugugcaguuuuaaauuaaaaauuauaaaaugaaacuauauguauuuaacuuaauagaaauuuagacagaaacaacugugcuauauccaggguuacagucuuacaguaauacugacuuuaguguuaaugaaauacaguuaaaagcauguauuuaauugcugguuaguuuuuguuuagaguuaguagagaaaugcuucuuagaaugaauuuacuagagauuuggcauauauuauugaggaagaacaauuuuucccagauuagaugugauaccuuagaacugaaagaauaugauuuucaguugcuuuguggcaaucugucuaaugccccuuggaagaucuuuuuugcucucuguagauauuuuuugaguggcucgagaugcuuuaccuauauuuaaaacuuaacaauuuaaaaauaaauucaguuuuaauggaaaguuuaaagauuccauuuuuuccuccaaauagauguuauggaaagagccuacaccggguguuagguaacuuagcgugugagccucugcaaaucacuuaaucuucuucugcuguaaaugucugaaugugagcuaaaguaauuucaguguuuuuugagguugucugguuaucuucccaccuucuuuauuugcuguucugcugcauucgcccaacugccucaguagccaacagggugucacuuuuaggaacuucaaccauuuaauuaaacauugucagacuauucuuuuccaucuaauaacagcaagcuucccaggucuuucauucauaccucugaauuuccuuucacucuagugaugaaaacccacuugcauuaucuucuuuucuuuauucuuauccuauauagacuaugaacgucugugaaaauucugccacucaaauuuagggcucugcauagaaucuuauaaucuuuaguuuucauauauauuguacuuguauuucuuauuuuuaguacuuuuuucuugagcuucuagaauaucuugguuuguuuuuucuauuaguaaaauagguauuuuauaaauguuucuaauuacuugauuuuguuauguauagucaguuauuugaaaauguacauguuaacuuuuuaguuuguuuuuagaugaacagccaaacuuagggauagaaaaugaagcagauacacauauuuugauuuucaggucaucuguccugucaaauauauuuacguagucauaguugagaguagcaguuuaaauuuacuauaaacaugguuggaaagaaaccuuuccaugguaguuaauaagaucaaagcagucuguucccuaaauuugcaaaaaauaauaauuguaauguuuuacauauguuuucaauuuaccuguagguaaaacauacuuuuuuauaucuauauacauacuguuuucauuuucuuggcuauuuuucagggaaauuuuguaucagacauuuaaaggcacuuaauacaaacauuuuuacugaaguguaauuauuaaugggaaaagucacaagaauaacaguaauuugccuuuaaaagauguauuguuguuauuggcaaccuuauuaaauuucuuuuacuuugcaguguugagauuuuccaaauggccagccaacucuuucuauacuuagauguuauauuaaaaaguaacagaaaucuauucaaggauuuuugauguugcacuguaacuugcuuuuuauuuuuuaauauguuguuugaacuuugauaagcuuuauaaauaaccaaggccacuuuuucuuaagguuuuuauuuuucuuacaaaaucuuguuucuuuuuaaaauguaggugacuguggggaucauguuguuauaaugaacacaagacacauugcauuuucuggaaacaaaugggaacaaaaaguauacucuucgcauacuggguaagauaaugcuguugucagggaaauuagguaguuaaaauauauuacuuuaagaauacaguuguucuuacuuaaaagaaaaaagauauuuuuaaaaaucagcauuuauuacuaauuuuacucaugccauguauauaauuuacucaauuuuuaaaaaccacacaacuauaccaaauauagcuauuaccugacaguauuuguuuauccuacaaguguuucauauaaccuguggacaagauuauucucauguuuuagucacucuuuuacuuuguauuucugcuuccuguaauucaucuuacugcuguuuucagaaccaucccaaaccaucugaaaguuaacaagauguuuaaggaauggucacucuucucuagauaaaaucuuguuugucaguaucucucuuaaguaaauacacucaccuggguguguucugcugguuuccaaauacaacgugacucuccuccauuuuucaguuaggcaaucuucuguugcaauagaacuuuucuucaaggccauaguauuucuguauuugaguuuacugucagcuaaaacuccuaagucuuuuucagguauauuccuguugaaucaugucuucuccuuccugugugcuuuaguuguaauuuaauucaauugcaagaccuuaaguuuacuccauguuaaauuuuaucuccagccuuuuaagauccugauuuuaucaucucauguauuaguuaacccauagcuucaggucaugugcacauuuaauuaaguguacuuucuauacuguuacucaaguuaugguuagaaauguuaucuuuuauucuugaucaaaaucacuauuuuauuuccaacugcaucuucgccuuugauguucccauuuguuacuuuucaucucuuuccccaagugcaucuuaaauauuuggaacaacuguuuugcuuccuugagccagccuuugcccauuccuccccuuaaaauacauucaugaaaucuuuauauaauuuaacaaaacugaauuuacauccgucuuuaguaauuucagcuauuggcagaucucuauguauaaaccaaguucuacaaaauugagagguaauugggaaagaaauauuaaaaaucagaauaacauaaugugauaaaagcauaaagggaaguauugacacaaaaugcuaugguaauuacuauagcaauaauauguaguauuacugcaaaugaaagaaaaugacagcacagccaguagugaacagcuaccauaauguguacgucagcugguagugucccugucaguagugcuuucucacugauaggugaaaauucaaacuccuuuacaagucauuggaaaccaguucccacugcugcuucauaguucuucuuagacaacauauugcuauuucauuccuuucugccuuugcauguguuguuccccugacagugaggaauucuccuauuuauccauuaaaaauugacucagaugucacaguuucugggauaccuuugcuauuuccucaucgcucaaagaguugauugcuuuuuguuucuguugacucuucacuuacacuuuggacauacuacuuuauuaugcucauaacacuguauuacaauuacauauucaaaauuuagcuugcuaguuguaaaauuuuuaggacauacuaauuuuagaaaauauagagaaguuuaaagagggaauuaaaauucacuccugaucccaugacuuaccauuuuaauauacagucagcccuccauaucuauggauuccacauuguggaaauguaaaauuuucauuuuguuuuguuuuuugagaugaagucuugcucugucauccuggcuggagugcagugguacgaucuuggcucacugcaaccuccgccucccagguucaagcaauucuccugccucagccuccugaguagcugggacuacaggugugcaccaccaugcccagcuaauuuuuguauuuuuaguagggacaggguuucuccauguuggccagacuggucucgaacuccugacaucaggugaucugccugccuuggccucccaaagugcugugauuacaggcgugagccacugcacccggcguguaauuuuuuucuauuuaauugugucaauacugaacauguacagacguuuuucuugucauuauucccuaaacaauauaguauaacaacuauuuacauagcauuuacauuauauuggguauuauaaguaaucuagagaugauuugaaguauacaagaggauguguguagguuauaugcaauuacuaugccauuuuauaucagggauaugaacaucccuggaauuugguaugcucaggagguccuggaacuaguccuccacagauggagagggauaacuguauauacaaguuuauauccuuuuucacuuaauagaaaauucucagagaaccuuuuuguaaguauuauuuuugguuacuaaguaguagugcacaaaaugauuuacgauacuugaucauuguucuguuuuuugaaaugaaaauuuuggcuuuuauaaggggcugauaaacaucuuuuuuuucaauucuuguuuuuuguuuuuuuuuuuuaacuuuuaaguucaguuacaugugcagguuuguuacauaaguaaacuuguaucauggggguuuguuguacagguuauuucaucacccagguauuaagcccaguacccauuaguuauuuuccucucucuacucccacccuccacccuccaauaggccucaguguguguuguuccccucuauguguacuuguguuuucaucauugagcuuccacuuauaagugagaauaugcaguauuugguuuucuguucuuguguuaguuugcuuagaauaauagccuccagcugcauccauguugcugcaaaggacaugaucuuguucuuuuuuuuauggcuauguaguauuucaugguauauauguacuacauuuucuuuauccaaucuaccuuugaugggcauguagguuaauuccaugucuuuacuauaaugaauagugcugcagugaacacacauguggaugugucuucauaauagaacaauuuauauuucuuaggguauguaccuaggaaugggauugcugggucaaaugguauuucugucuguaggacuuugaggaaucgccacacugucuuccacagugguugaacacucccaccaacaguguaaaauucccaccaacaguguaaaagcauuccuuuuucucuacagccuugccagcaucuguuauuuuuugacuuuuuaauaguagccauucucacuggugugagauggcaucucauugugguuuugauuugcauuucucuaaugaucagugauuuugagcuuuuuuucaugauuguuggccauauguacgucuucuuuuggaaaggguauguuccuguccuuugcccacuuuuuaaugggguuuguuuuuucuucuuguaaauuuaaguuccuuaugaugcuggauauuagaccuuugucagaugcauaguuugcaaaaauuuucucccauucuguaggugucuguuuauucuguuaguuucuuuuguugugcagaagcucuuuaguuuaauuacaucccaucugucaauuuaugcuuuuguugcaauugcaguuugcaucuuugucaugaaaucuuugcccaugccuguguucuuaaugauauugccuagguugucuuccaggguuuuuauaguuuuggguuuuacaguuaagucuggaauccauccugaguuaauuuuuguaugugguauaaggaagggguccaguuucaaucuucugcauauggcuagccaguucucccagcaccauuuauugaacagggaauccuuucuccauugcuuuuuuggccagguuugucaaagaucaaauaguuguagguguguggucuuauuucuggguuuuuuuccacugguguaugugucugguuuuuuuuuuuuuuuuuuuuuaucaguaccaugcuguuuugguuacuguagcccuguaguauaguuugaagcuggguagcgugaugccuccagcuuuguucuuuuuguuuaggaucgccuuggcuauucaggcucuuuuuugguuucauaugaauuuugaaauauuuuuuucuaguucugugaagagucucagugguaguuuaauaggaauagcauugaaucuauaaauugcuuugggcaguauggccauuuuaacaauacugauucuuccuauccaugagcauggaguguuuuuccguuugucugugucaucucugauugcuuuuuauuauuaaaguuuuuuuucuuuugagaugggggcucacuguguugcccaggcuggucuugaacuugugggcucaagaaguccucacaccucagccuuccacaguacugggauuacaggcaugagccaucauacccagccuucaucucugguuucuuugggcaguaguuuguaguucucauuauagagaucuuucaccucccuaauuagcuguauuccuaaguauuuuauucuuuuuguggcaguugugaaugggaguacauuccugauuugacucuccgcuugacuguugcuggugucuaggaauguuagugacuuuuugcuagugauuuuugcacauugauuuuguauccugugaugucuuuguccauugauuuuuuucauauauguaggauuauuuaaaauaaaucccuggaaguguaauguguuuugauaucaaaggaaugaucauuuauaggucuuuugauagguauuuucaaucaugaguuuucuaauccauagaagagcauacaaauguuuguuaucccaaaucugugcaggcacaguauuaucuuuaaaaauaaggcuguugucuuuugauaugcagcugaauauuuacauuuacuuaauaaugaaguuucaguguuacuuuaucacuuucuauggacguuuuaucuauuaagauuauuaauccacuuuuguuuuuuacuuuuaacaaaauuuuuaugucauuuacuguaguuauuuaauuuuauauuauuacaugccuuuuccuuuguaauuucuucuguuuuccagucucagaaauucuuucuuguucagauuuucauaaacauuuacuucuaauuuuuuagggguugguugaauugggugugugugcaccuugaacuuucacaucuaagucuuuagucaucuaaaauacauuggcaugaguuagagauacaacuuaacaacuaguuguaucaacagaauuguuuaauuuuaaauaggacaggauuuugucauauuuaucuguguguccccaguuccagcaugauacacauuuaaguguuuauugaauuaauuucaaugaaaaacccuuggcuagcauuuaaaacaaauguucucuuacuccaucccauauuggaggaaagaaugaguuauuuucuuacuaguaaaaaucaauugaguguugcauuacucaagucauccuccacucaaaauuuuacauuagcuuuccaaauacgucagaauaaaguccagacuucugaaauauauuguaaaugguauguuuuagaauuugccaucucaauuuucaaacuagaaagaucaucuuucagcauagaaauuguaaaauauuuuuuuccauggagagaaagaaugcaggaauagaagucuagacaggcauuucuuuuucuaaaacugaaauuccaugaaaaaagagaauaucaauuuuaaaacuacccaucuuucucagcaaacuucuaacuuugacaaguuuuauuccuaaaauguguuuucuuaaaucaucuuuaaaauauuuucaaauuuuauugaagggaacauauggaaaaaaucaccuuuagguaaucuuaagguuuuuugcagauuccacacugacuuuccaauuucuucccccuuucuugaaaaucguuuggacuucaucuguuuaggaaaauagaaccuuacaucuauauauguauuauuuuuguuuuaaauuucccaaucccuuucacaaauauuuuuucauuugacccagaaaucuuuugagguagauagcauuauuuauucauaugaguaaaauuauaugcagagagguaaaaugaguugccugauauuacacugggagucacugacaaaaccuagauuccauaccugcaucuaggguaucuggaagcuaagcugccuccaguacuauucaauguauauuuuguaauugccacuuuuuuucauuuuauaaagaauaaucgaucugaacacaaugaaauauuauauuacuuagagccaauauguagcacuuagagaccuuuacaaacugcuaagaagaaacaugauuacuggcugucuagaguaugaacuuaauucagaaccaaguggacuaccaacauuuuccccagaccuaacccguaguuuauacgguuuaucuaauuugguaaggaacaugaaauagucuggcuuguuucuauuucuuuguuaaaucaaguaguaauaaauaccccauaaugagugagugaauuaauaacuuacaauucagauagaaauauacuuaugccaauaaauuuuuccaagaaguagaacuuuuuaugauauaaugguaguugaccauuuaagagaauagcauuucaaaaagcguagauuacuacuuaauuuugaaaacacuaaugaaaagcaguuucgagaaacaauuuauuaaaauaguuuucuuauaaaagaaugaucaguuuaagaauacaguaucagccuaugcccaguuuuaaugucuuuucuccuuuuaacagcuacccagguggauuuagacaaguaacagcugcucagcuucaccugagggauccaguggcaguaaguuucuuguauuuuuuauuaaucaucuuuggaaagaccaauucagauacuguuuugucagucucccuucucauuauuuuaauauaguuagcauucaaggauauaaauucuucacuuuagcuguaucacacacguuuugauaaguauuauuuuuaauauucaacucuauguauuuucuaauugcuauguauuauguuuugcauuuagucgaagaauucugauguuuuucuuuuuaauuuuugauaccugcauaaucaccuaguauaugaugaguuugcugaaaugucuuggaaaggagagagauauauguauguauguguguacauauauuuucaaacaugcuaaguguguucuucuuauauucuaacuuuuuuguuaacucgaguauuaucugaguuuauuuuuguuuauuaacaucucaauuguagauuaauuucuucuuacaggucuguccauuuuauucuggaaaaaauaguaaaguucuuaaaaacaaaacuacuuucauuuuauuuuauuauuuauuuauuuauuuuucuggagacaaggucucacucugucacccaggcuagagcacaguggcacaaugauagcucacugcagccucaaacuccugggcucaagggaucuucccaccucagccucucaagcagcugggacuacagguacacaccaccacacccugcuaaaacuuuuuauuuuuuguggagaccagguuuuccuauguugcccaagcuugucucaaacucaugggcucaagccauccucccaccucggccucccaagugcugggauuacaggcgagagccaccacacucagacuuuacucuguuuuuaauuuauguuuuuaaagacaggaucuugcuauguugcccaggcuggacucaaauuccugggcucaagcaaucuuccuauuuuggccucccaaacaccugggacuauaggcacccugcuuguuuauguuuuauuuauuuuuuauuuuuuuuccugucaauuuuugccuuauauauuuugaagguuuaguguuagaugaauuuaagauuggaauuggaaucuuucuaaacaauugaucagggucaauauguacugauccucuuaaucuccaauaaugcuuuuuaccuugaggucuauuuguucugacauuaauauagcuacauuagcugacuuuugauuaguguuugccucauauauuucauuuuuuacacuuuacuaaguuauucuguuauagauguuuuuauuguaaacaucauguaacuagauuuuuuuuucucuccuuucuugcugccuuuuggauugguugaauugauuuauuauagcucuaagguucaucaguauuuuuaccuuacuuccaaaucaaugaaagcccuuagaagauuuuuaacuaccacccucccucccaaucuacaagcuuucuuuguucagguuuuuaaaaaaacucuuccaauugaacauucuuguuauuguuuuauucuguuacugauuuuuuuaaauuuucuuuucuuacaaucccuucuugugacucagccugccuucugguaucaauuuccuuuuccuugaaguacuucuugcuggcauucuucaagccacauucucuuaauacugaacucaccuuuuuugucuacaacuguuuucuuuauuuugugcuuucauucuugaaagauaguuuugcuauauguggaauucuaagauaacaauuauuccauuauuuuucccucagcuuuuugaagcuauuauucaauuggaauuuagcuuguauuauugcuuuuaugaaucagaugucgauuuaauuguuucuuuauguguacucuugucuuuuuuuucuggauaccuuuaagaccuuuucauugucuuugguuuucauaucuuccuacuacagucuuauuuauuugguuugaguacuggugucuucaguucuggaaauguguuagcucuuaaaucuucuaauauugggucucuuuauucucuguuucuucccuuuggaaaucugguuauaauaagaguagacaguugcauuugauuguacaugauucaguaccucucuuucauacuucaugucucacugucucuguggggcauucucaguaauuucuucagaucuguguuccaguucuguaucuuuucaccugugucuaaucugauugaccuuuuucugaggugcuaauuucaauuaucauuuuucccuuucuuaaaguuuuauuauuugguucuuuuacaaauuuguugaucaguuucaauagucuucuguuuaucauguuuugguucacucuuauauuucuuuaugcauacuaaacauaauucuuagaguuuagaucugauucuaauauuuguggccuuuguagguccgcaauuuauaauaucugcucaguguacuuacuugguaggcucauguaccuugaaacuucaucuccaggaauucuuuaagaccuguguuaaaaaugacuuuccucaaaaaagauucacuuagcuuauggcuaagugaauugggcuauaacaaccuaaguuuuuugagcugaacuuuagacuuacaggauuuugauccccacaagaaggaugaauuuggggccucaaagccuugugaggucagcuuuguuucauacuuuaaaaaauauuuuuauaaacaauauuaauuaacuucacgaauuaacuaaauuuuuaauuacuuuuaauuuuaacuacauaaauauauaaguuuauauauauuuauauguuuauauauguuuauauauauguuuauauauauauuuccauauauuaaaugaccucucagaaacauaaagucuuaacacuaauagaaaacagauggaaaauuuauaugguucauuaauguuuauuucuuuguguauuauacugggagaaguucuaauucauacauuagucaccaauauugcuaaaggcaaagucuccuguuguuuuuucuuuuagcuauugauagaccuaaacuuucaacuuuacucauagguuagauagcauguuuuuccuauuagagacuauuuuaucuuuuugcugcaauacauuaauaaauuagcaaagugcuagaccuaaaaauaucauuuuuuguuucccuaaaauaauaaaaauaaauaucuauugucaggauacaaccauuuguuugguauaauacugccuaaaauuuucuugguaagguuggggggaaggauauuuuauuauaauaagaccugacauaccauuuaaaaguuucaugauuuacuauuuauuuuguauuguuuauaucuguuuuauaaaacugugcucagaauuugcuucuuaggaaauauuuaauuuuuuuuucauaacuaguguguuuuuaagccuuacaggucaaaauauuauauuuugaauauuaauaugcuuuguauauaauagcauuaaaaguuauaaggcuccugauaauauauaucacagcuguuaacaauaaauuauacuuuuaauacuucauaaauauuuuaaauguuaaaaugaaaguuucuauuuuauguuaacuguacacuaggaggcaguauaguauaacuuucauguuaaaaauuuggucuuagguaacuuuuguagaaauuguuucaaauuauuguuuaugagcaauaauugaaauggauuguaaaauguuugaggaaggcuuaggaaauauuucagaguuaaauccauuuggauuauuaccucauuaaaggauuuuaauuuuuuaagucuuaauuuuuacuauguuuugaaaaagaauggcucgucaaggaagagauuuauuauuuacuuuuaauucaaauccuaaguuuuugucuggaauaguaggccucugccaguagacauaauuugcuuaucaguucuuacuguguguggccuaucggagaauuuguuucacaaugcagcuuucugauuauuaguacaguauuggaauacuauuugugaaauaucuuaauuaauauuuaauaguuaaauagguaauaguuuguuaaauauuuaaaauuuuucauaaugauguagauuauucuaauuucaaauaaauauaucgauuuagcccuuuccuuauguucuuuuucucucuguuguauguuuuagcuucuuuaagagguucuauguccuuauauuuucuucuaacaugguuccucuauuugauuuuuccccuuccuauaaauaauaaguuacuucuauggcacaaauggcacguacccugggauauagauuauaugaggaaggucuuugauauuuacuaacuuuaucuuauucuauuuuuuuuacuuucugaauuucuuaaaacuuauacuuaaugucuguacagcuagaauuacuuuuuugcauguacauguuguuucaccuuuguuuacguacauuuguaugucugucuuuuuucuucccuguuagcuuauaaucuuuucacauuuucuagccuuuuuaaauuugaguguggaguuugcauuuucuaauagggcagauuuuuaaaauaccaacuuaguaauucaaauaaauacaacuaaauuuuuuagaaacaugaaaaucaaaugccguguaacacuauuaauacaauaaaaugccuuuaugauaauauucagaggauauaauuacuugcuuauccagaaaagauagucuuaacauugucaguuucaauuuacaacuuuuaaaacauugaacaauuucagugcuaauaacuaaaucagugcugucuaguagaaauuuuugccgugauggaaauguucugugucugcacugucaaacaugguagccacuagcuacaugucaaccgaccacuugaaauguggcuuucaugacuaaggaacuaaauuuuuaauugcuuuuaauuuuaacaacauaaauauauauauauuuauauauauuuuauauauauuuauauauguuuauauauauguuuauauauauuuacauacauuaaaugaccucaaaaacauaaagucuuaacacuaauagaaaauagauggaaaauguauaugguaacccauuagcuuuugcauguaaugaggcuuuguggucugauuugaugagagaauaaaagaggaaggccucuuaacaaaguaacccuauucuaacauguauuguuuuaguggguuuagcuuuaacacacaucaaauuauauugaaauaugagugcaaaugauaauuauucuaucuaaaauuggcacauauacggguuacuuuuaaucuuuuuucuuuuucuaaauaaacaauaaauggagccaaaagaaaauaguaauguacaaaguaauaaaaguuucuuuucuguugcuuccacauauccacuuaggucuauuucuuuccuauauucguguugaaucuaaaccccucauuuucaucaucaucucuaauuauguuugcuuucuuacuaucgcaagucacaauuuucuuauuguguccuauguauaucuuucagauuguaaaacuagcuauuuauggcaugcugccaaaaaaccuucacagaagaacaaugauggaaagguugcaucuuuuuccagaugagguaagucaguggucauugguaacaaugcuuuuccaaaauuuucaauuaaauguuucauuuucuuuuuaaauaaaugccacagacuuauuuucaaaaauuuuaugucaacuucugaaauauuuuuguauuuuuaaaugaauauguauguauaaaaaaugauaauucuauuaauauuuuaaaauguaaaaugaaccaucauuggacuaaaaauuaaaaguaaguuuuuaaaaaaaauuuuaaucacugcuugcuuuugaacaaggagcuaugaucagaaacccuguuaaauugagguacuuguugauaauuucauucacuaugaaaaaguguuaauuuaguucacuuuuuaugugaccaguagcaaaacuucugugaaucauggauaaauagcuuaacuuugguugcuauuguuucccaugauuuaacuuuagaauacuuguucauacucauaguugauucagcuaaaaauuacuuggaaaagaguguaaacauuuuuauuuauuaguauuauauuguuuuaaguacuuaacuuuucuccuuaauaugauguaaugaaauauuaaagcuucuauaauaaaauaauauuuuaucaagucagacugccuggcuuugaaucugugccccauuauuuacugacugcauggacuugggcucguuacuuaucucuguuuucuaaucugugaaguugacauaauaauaguaucuauuuuacaagauuguuguaaggauuaaauaaaauacacuuguagauugcuuagaacagaaacuggcacaauaagugcuagaugcuaucauuaccaugguuauaauuguccuucuuguuccuucugaaggaauacuguagaaauuuauuccaaaauaucaaguuauaacgauuuuucaagcuauuuaugugcucuuacuguuuaagcuuuaaacaauacaugaauaguuauuaauaaugaguaaguuauucaugcuuuaucaaaaugauugauuuauugucuucgcuauaagugaauaaguagaauaauuucccacuauucacuuuaccucuaagguagcauguaugggagcaguaucaucauccaaggaucacuucaugaugaaauugcaagaauuuaagaacuccuauuucugauuguauugucacuuucuuuagaaaccauaauuucuaaaagacacaaaaauaauauuuauuucauuuacaagauacguuugaguguagauauuuuaaguauucacgauaguuccguuaaauaggaaauuauuucauuucagacuauaaaauaaaugagccuaguucccaaaagugaauugguaaguauucagaagcuugacaguacauuuuaucaagccgaugggggaaacaggcacacuuauacauuguuggugguagcacaacauggugcaucucaucuggaauccugggaauuaauuagguaacauauaaugaaaauacauacaucaggagauugauccuugauccagcaaucucauuuauaaaaauacaccuucaagauacacaugcacaugauuauuuucacuguauucaauaaugguacaauaagaaaaacaaauaaugcuuauucauaggaaauaaauuaucgaguauugugcaauuuuuuaaaaaaagaaugacagauauuuuugugacuugguaaguuguacuuuccaggauauauuguuaagugaaaacaaacaagguaaaaaagaauguagauggcauacuacauuuguaugcauauauaccuauguauguuuacauacacacaagcauauauuuaugugcgcuacuuuuugcguaaagcacgggaagagaaaguugcaacuacuagacuauggguacaaaggaauagggaaagaaugagauuuuuuucagagacuaucuuuaaauuuauuuuuuauguuaaucaugcuaaaauuuuauauauuagaaaaauaaaaugacagcaacaguagaagugagcacaacuaguucccaaaucuuguuuuccacaugcuauucccuaccaaaaggaacuuaguucuuggagaacugauugauucacgaucuggagcagagagagaacuaaauuauuauaggguauacacaugcaaaagacuauuauuucugcaugauuuauaauagugaaauaauagaaaguaacagaaaauaaggcaauacucaaaaacuaauggagcaauaucaagggaacauggagccagcuuuagguggugcccacugaccaaauacaggacugugugagccucaaaacacaugguaauaauaagggauuacacugaauaagaaaacaaaaaucuauacggcuacagugaccauccaaaaauuauuuuuaauuuauuaugaugucccuucuuucugaggauagaaaagcccucuauagaagaauaucauauaaaaaauauggaaggaauacugaacuagaaaagccaucauuaccagcguauucuguggccacuggguaaaagguuauuguggagcaggauauuuauaguuuccaaauaccacaauacagaguauuuauuauuuguaaagggcaucuuuucaauuauuugugaugggaaucuucccauugcuuuuacauuaauaaaaucugguggacaccaccguaaccaugagaucaaaucuuuggucacugugggaaaaacugacaucaggugccuccugcuaugaagcacugaacacucaacauaaacuauauggccucuugucaguaaugcuuaaccugaauguaaucauggaacaacaauaguauaaauccaaauaaaaggaaauucugcaacauaacuggccuggacucuugaaauauuaaagaaaaggcaaggaaacuuacgauaaaaggagacuagacuacagaguaaacaacauaauauaguaacuaaaugcaugugauucuugaccugauccugaauugggaaaaguuacauaugacaauauuagaccuauuugggaaauuugaauauguacuguauauuagauaaaaaguauuucaucaauguuaauuuuccugaacauaaaauuuaauguucuauagggagacuaggagauacaugcugaaauauuuaguuugaaguuuuugcaaauuacucuaaaaugguucauccaaaaaguguuuguauauagacagaccaaaagagaaagcaaacaugucaugcuaacaguuggggaacuuagguaaagauuagauuaauguucauuauauugucacaacuuuuguguaaauuuaaauuuuucuaaaguaaaaaguugcaaaaaaagugaucacuugaccccuguuucuguuuguugcucugguucuuucccucauuuccccuuagguuaaccaccucugugugaagggaacucuuuauuuuuauuuauuuauuuauuuauuuugagacggagucucgcucugucacccaggcuggagugcaguggcacaaucugggcucacugcaagcuccgccuccuagguucacgccauucuccugccucagccucccaaguagcugggacuacaggcacccgccaccacgcccggcuaauuuuuuguauuuuuaguagagacgggguuucaccguguuagccaggauggucucgaucuccugaccucgugauccacccgccucugccucccaaagugcugggauuacagacgugagccaccgugcccggccaaagagaacucuuaaaucuccauaaacacauuuaguuagcauucauggguuaccuucucuguaugcacauuaaaggagguacuucucccucuuccugguuucauguguaauaccuaaucaaaaacuuugauuccucauuuugcauugauuuuaaccauucagcaaaauccucuaauaguaaagaaauuuggcucauuguauucaaaauucuauuccauucagcaaacauuagcuaggaagccacuguguuccacaugcucuacgcugaaugagcacuuagcagcuuuuugaaauugucuuuacaacugaucuagggaauuuuauacuggcuuuccaaagaaguaugaaauauuuauacaucuuuggaaauaucugacagguaggcgccuucaauaaguaaaaaauaaguaucaccaacaaucuuuuauauguccaggcauccucugcuugcccugacucuguaauuauugugcagauuugaauauacugagaaagugauaacaauaggagaaaggauguuaaauauuguuaaaugcuuuucagugaagaagcacauuaucaagaguaucuauuguguuuucuguauguugauagugacccagccuauccaaaccacaauuuuuaaaauucauuuaaauugccuaaaauauuauaaauauuuugcuauauuggguuuuagaacaagcuuacaggacaguagagcucugugauccuaaaguuauaaaauuuuauccugauucuuaagacaacaugucuuaagacaacaugucuuaagaauugaucaaagugcugccuuauuugaugccauguccuuggccagauauuggauucccacuuguaauagugcgcucugcagagagcuguaauuuacugugugauaauccuuuuaucgaaaauuccuguacacauacuauaaugagaagagggaauuauaucuacucuccuuauaagaaugccuauaagacacuuccauacugauaucuuaccguuauuuaaaaagaguucccaaaaucaauuuaucauccagucucaauacaguucauucucccagcugccuuauuucugcaucaugaguacaauauaaauguucauucuuuugguuacccacacucuucauuuuaucauuccuccuuagucugucuaauuccaaugcuuucuucuuuuaaaaugucuuagauaugugcuuuacucuuuagugugccuuucaguaucuaaacucaaacuuuaaaaaaucuuaccuugauuacugaaacagccacuuaacucuucuugucuccagcuuuucuccacugcaguucauugugucuacuguuggcaggucaaucuuccaacucuucauuuuucugaauauuggauacauaguaggggggaaagugguccuggucaggggaauacaauuaauaaagauaucaugauuugagucuagagcaacacaugaaagguugaggagguugauuagacagaaaccaugguugugucuguggagagugacauuggagagguggacuagugguaacgacacugucuagcuaagcaaauuuagcaaaggaguuagagcuuuauccugaaaaauuuuaagcugagaggugacuuuuuaaaaauuauaagccuuuagaaggcuugaucuuuuuauuuuccuuuauauggccagcaccuggcacaauuuuugguucuuagaaguucaauaaauguuucuuagauaaauaaaugacucaaagauuuucauuuucaaauuuuuuucuggccacaguuggagcacugauugaaagguaguggcacuaaacccgguagacccaguacauauacuugucagaugagaaagcaugagaaugagccauagcagugucuuuuugcaauugaaaagagggaaauaaacagcacauuuuaaaaaauagguaucuuauuauaaugggauuacuuguauuauuaaccuaauguacuuuuggggaauuuuuauaagguuuuuauuuuaaagauuuuauguuuuccuuauucuacgagcauucuuuugcuuauuuuuuuaacacuuaugaaguauuaguaauuuauugcuaagaaagauauuuuaagaaaauuaagucuaaauuuuuuuuuaauguaguauauuccagaagauauucuuaagaauuuaguagaggagcuuccucaaccacgaaaaauaccuaaacgucuagaugaguacacacaagaagaaauagacgccuucccaagauuguggacuccguaaguguuucccuucuucuuguuuuuuuuucuuuugauauccucuguuuccucaaccauaugauuaaauaagauccuugagggcgggaagagugaacucauuuuuuugcuccccugggaacucagcagcuacuaccuacaaauaaacucuagauguagguauuagaaccaaaaauuuuuaagcauuaagaccuugcuagauaagugcgaggauguucauagguuccuauaauuaucaaguauuuuguuugggcugaugguagucuuuaggaaugauauaugaauuguuauuaaucuaaaacguaaugauucucaguuuuccacauuguuucauaaguuaaaaauauuaucuaaugaaaagucauuaauuuuggauacuuguugucuugguccaaaaagaaaaacaaaauaaaaaaauacuuuuugcucuccucuguacaguuuccucuaccuaaggccguaaagcugcuaagauguaacauucuuucucccaucuaguuguuucuaggcuuuuuugccagggcuauccagaugaugaagcauuuaaguguaacuuccucaggcaguccuuccuguaaucuuugaaccggguuaggcucucauuauggguucucaucguacacuuccauuuacugauuuacucuaauuauauauuugugugauuaucuguuuacuaucugucuuucuugcuagacuucaugagggagcuacauguuugucuuauuuagcacugagcauggugcuggacaaauuaaauagacacucagccaguauuuauugaauaaauuaauuaagacuuuuaucagcuuuuauaagugacuuuaggaaagaaucucuagaaaauaugaagcaaagaccacuuuucauuuuuuucacagcauuuaucacuaucuacuguacucucauuuauaugugugucuguuauuugucucucuacacucauggcaauaauaaaaauagcaagcacuaauaaagcauuuauugugugcuuuacauguauuaaucuacuaauccucagagcaaucuagugagucaguacaauuuuuauuuuuauuuuuauuuuuuaaaugagaaaauaugggcacagagagauaaagcaacuugacuaauaucacauaguuauaaaugguauauuaaggauucaagccugagugacuagcugcugggucaugcuccuaacucugcuggaaugccccuucuugcauuggcaugucagcuucaagggggcagggacauugucugguucaacauuuacaucuuagaaauacuuagaaacccuuagaaauaguacuuggugcauaaugggcacucaguaaguguuuuggaaagaaugaagacaugagcucuuucccuaaaaauuaauugugaaauuuucaugaauagcuuaaguuuuagaaaaauccaaaccaagguucaaaucuugccucuauaguagcugacucuauaaccuuaaguaagucaucuuucauuuugagccuuaguuucuucaucucaacucaguuucuucaguuguaaauuagagccacuccauacuucugagaauugcuggaaggaguaagugagcaacuuagcacacuugaaguguugacuaaguuuuuaauaggagaauuuuuuugcuauugcaaauucuauaccauuuuaacaugcuugcuaguguagaguuuuauuguaaauguacuuaaguugauguaguuugaaaauauucagcuuugauaaguuauauacuaaaaacauuuuaaguuguccuugaaguuuugacagguuaccuuccuauaacaguucuguaaauauguaucugauuuucuuacagaaacaccaucauaaaugaauuuauauuccugaccaagaggggugugguacucuuuuuuuuaaaauuagaaauaauaaaguugcuguuaaaucauguaugugcaaauacauauuauacacuugaagucauauuucaugaauauucuaaaguguauucuaaaucaguuaaacuggcaccacacuaauauaauaauucacaaauuauauuuaguguuauuauagucagaguacugaccaaaauuuucauucugcugaaugauuucugcuuucuuuugaaacaaauuagaaagugccugagugccuucauuuuauuaauagaauuagaaagggcuuuucuauagcuauuuuuaaggagauuuuuagagaaacuuagagccacuagaugcauuuuuuaguuacuacucugggaauagauuuuccugcccucucucuucauuccagauuucccugaggcaggaauaugcauuagacacuagguuuuccuuuaugcuuuauuaagguugugauuuuuuccucauaaauagucacacgcauauguuaacuuguauuuucaaaauaguaaaauagguauacguuuacugaaacguauggauaguauagguguacuagucauuuaauauaaaucauucuguauuucuuucucccugcacauuugagcugacaucaaguccaguuagucuuuauuacgugaaaagugugugaccaggaaaaauauagucauuuuuggauuaaccaaaagcuuaucuaagaaauagaugaucauuuacuucaaggcucuugaguagaacuuucuacaaugaugaaaacaacucucagccaggcaugguggcucaugccuauaauccuagcacuuugggaggccaaggcaggaguaccucuugaguucaggaguucaagaccggccugggcaagauggcaagacccugucucuacaaaaacaaaaaacaaaaaaauuagccagguguguuagcacacaccuguagucccagcuacuugguagucugaggcaggaggaucucuugagcccaggaguuugcagcugcagugagccaugaucaugccacugcacuccagccugaacaacagagcaagacuugucgagagaaggggagggagagggagugggagagggaggagagggagagggaagccuggcgcgguggaucaccuaagguugguaguucaagaccagccuggccaacauggugaaaccccaucucuaauaaaaauacaaaaaaaacuagccggauaugguggugggcaccuguaaucccagcuacucuggaggcugaggcaggagaauugcuugaacccgggaggcggagguugccgagaucgcaccauugcacuccagccugcgugacaagagcaaaacuccaucucaaaaaaaaaagagagagaaaggaaggaaggagggagggauggagggagggagguaacucucuauucgagcuucaaauacauuagcuacuguugacguguggcucuugagcccuugcacuguggcuaaugugacuaaggaacugaauuuuuuauuugauguaauuuuaguaaauaaaauuacguguuagugaauaaaauuacgcuaccuucauauggcuagugucuacauuauuggacuaugcuauuuuaguuauuggacuaugccauuuuauaaaguucuauuaaauauuauauacuuuagaauuagaauuaaaauauuugauaugccaugcaguucaauucauggaacaugagguuuuuauuauuaaaggauugccuuuauuagaaaaaaauuuuuuucuccuuuuggagaggaccuugcuuaagauaugcuuuuguucuacccaacauagcuaagccaagaauauaauuuuccuuuggaauguaguaacuggaauuuguuuaagauaaaucugauggugaaucugcagagacuugacugaaacaaauguaccugcauugcgccacaaguauauagccacaaaaauagcuugcucugguguuugcugcccuaguaauaaaacuuaaaauauguucauaauauuagaauguacaucuuauaauuugaacuauuauuaauauuugguuaaauauaaguuuauuaacuuuucuauuagagacuaaaagcuucugagcagcagaaacaauuaucaaagagcuuugaacccaguagaugauuaacaaaauugcuuuaaucuuaauuaaaagcuagcauuguugggauuuuauuuaaauuauuuuaaaucaucuucaaagauuauauucuuucaggccuaguuucagcauacauuagguuuucuuuugcuaguuguuguucagucauuaguuauugucauuuuuaagcuaugguaggagauaaggaaugaaauugauauuuaugacaaaacuauacuuuuuuaaaacuaaaagccauuuuauauauacuauggguacuauugcccauucaucucacuucuuaaguuaguggauauucuugguguauuaguauauuuuacauaaaucauggauacauaaauuuugugaaaauauguuaggaaguuuauuuuauauuucuugacuguacaaagcagauauguauuugcaaugugcaaauggugacugugggguuuauacuuagauuuuuuuucuuuuuucuuuaaaggaaaaaaauagcacuaucuuuucuucacaauucuguugcuuaagauuguagcuuuaaaauggucaauuuauuuuaauacuaucaauuguuacaugauuauugcaguuuugccaacacauuucacaaccccaauaaucauggaaauuaaucaugcucauuguaagggaaauguuucaaaauguagucuacaaauaaaacuuggaucauuuuaaacuuuauuuucaaguuuugcaaaaugaugcaggagagcuuuuccuaaggaaaacuacguaugugaaaaaauucaacuugaauugcuuugcauuauuuuuccuuacauguuaauucaguaagaaaugcuuguuuuaagcaaaacucucaccuuuguagagaagcuaaccauggaaagcuucagcaucaauacaugcuugaacacagguuuuuauaacagaaaccuguguuccugguguuucaguacucuagagugugcuauuagaaaugugccugcaaaggagagauggaugguaaggaugaagacaaggaaguaugaggacaaccauuacugaugcagaacugucucuucgaaaguaggaugaggauuagggaguucaauaugugauccauucagcucuguaaaagaaaagcuggauuccagaugcugggaacauuagcacugcauuggugagcauccucuucagucuauagcucuagaagagagcacggauuuaagcuuagugcauauucucugauaugaaagcuguuaauccuaaaaacuacccauuuucagauuuacuuaauacucagaaaaagauuauuuuuaccuaugccuuuauaaaacaugcuucagaucagagacuuaaagacaauguagaaggauuuuuaccuuuucuaauccauaaguugcugggaucuggacagcuuuaagauuuuccauaauuuucuucuagucuagucauguggcauuuucuccacacaauuuaacuuaauuugcugcucuucacagucagcaguuacuagcuggacuuguggacuaagguuacuuuccaacuuuccuaccuauuucaaccaguucagcauugacuucaaugauagacuucagucuuuccaguccuggguuuugcucaaauuaggcauucuaagcuguacuguucuuuuggaugugaauagaucaggacuggcuaguaaaauaaaaaaguagucucuauuuaaacaacaaaacccaaaucauuuauaaguccuagcugauacagauuuugacuaaaaaagugcaguugaauguaauggcaauuucuguucauuuuaauugaaaaaaucauuuggcaaaaauuuucaacaaucuuacagguuuaguuuauuuaaaaguauguugaucuguaggucuggaucugaaagggaagaaacaaaaaagaauaaucaagaaaggauuuaaaaaaacauuuuauuuaaauguauguugagcuuuuucggaucaggauggugcuacagugccuaggaaaauuaguauuaaggcaccauuacuuuaccucucaguauagcuagcaucuuuaaagaauaugugaugucaccagauuuccugaaaugguuuauucuaaauaauuucauucauucaauggaagugacuuaaaacucaaacugaccuuuuaucgcuuuuaagauuaguucaccauccaaauauuauuuuagucuuuuaaauguuucauagaauaagcauuauacuaagaaauauuauguaagagugaaaagacauaaaaccuauugaagaaaaaaauuuuuuugagauuuauuacacuuaagcuacacucaauuuccuggacuuacagcugaaauagggaauuuuuuuacuugaaaaauaaauuauucuuaguaggaccaauaauguauuuuuuguuuuguuuuguuuuguuuuguuuuguuuuguuuuguuuuguuuuagauggaguuuugcucuuuuugcccaggcugggguggugaaauggcgcgaucucggcucacugcaaccucugccucccggguucaagcaauucuccugccucauccucccaaguagcugggauuacaggagcccgccaccacgcccagcuaauuuuuuguauuuuuuguagagacuggguuucaccauguuggccaggauggucucgaucucuugaccucaugaucugcccaccucggccucccaaagugcugggaaguaggaccaauaauguuaagugucacuuaucuuaauguagcauaaaccaugugcuucauaacuugauguuuuguuucauucacaaccaaguaaauuuuuccuaccauuuuauaauacaaacuaaaaucuccgaaaaguuuuuuccuaauguuaagaggugagaaauuacuccauuuucaagauaauauaaauguuuugacuucugucauuucugaauucugaauuugaaucugcuuuuuugauaugugcuuauuucauccuaaugaguagcaguauuuugcuuguuucaucuaaugaguagcaggcaguguuuugcauagggaugcguaugguaaagaauuugcuauaggaaacagaaugauguggcauguggugugauuuuaacuguuuuugagcagucacaagcaccagagaauauuuucuacaacucagaugaggcuuuuuaaaguucuguuuucucacucaaaauguaauacuauuuucgaaaguuacuuuguauaaaggcaguuuuugcuagugacaaguaucugcaaaauagauaguuguuacagaacauuugauagcuauggaaaguuuagcacaauuuagagaaugaauuaaggaaaguuuuauguuagcuauuucuuagaugauucauuaaucucccaaguauauuuuaagcacauaaaugaaaauuuaaaacuuucgucuuucacuucaaagaucaaagcuuguguguguuucauauauuuuuauauauaaguauacuauauauaaauuguauauaaaauauauaucauagcuguauuagauaacaauuacacacacacacacacacacacacacacacacacacaugcacacauauauaauccacuguuagaaacugcuuuauaaagaugaggacuggguccugcucacuacuuuauucccggcgcccacagcaggaccugaccagucaauuuguugaauaaaugaaugcaugaauggaaucauauccucccugaaagggaaauugauguucaguucaugaagugugauaaauucauguuuuggguuuugcuccuuacuuaaaucuugucuaacuauaacuaaaauagacauuuuucuuaacaggccuuacuuuaaugcaacucuaauauauacaauuuuggauacuuuguauuacaugucuaaagaacaaucaugguaauuucauuaaaauacaacuuauauuucugucaaggaguaaauuuguauaauuuauaugaaaaaaauugacagguguuagcuuucagaaauggcauuugaaauaucccucuaaagauuuccugugauuauuuuagaauacuguuauuauuuacaaauauauuaaccuuauauaacauuaacgcacauuuuaaaacuacauaauuuguuauuuccaaugaaacagugacaaagaaguagggcuaauguacaauauacauucaccuaucaucccucuuuuaaaagauuaagccguuucauuuaaguuucaaauauuuaagcauucauaguaugaaaaguaaugugcuagaugccacccuucuuguuuuuaaaaacuauuuaaucuagugaagagauuaggucaccucagcacaaaauaggguauguaagcaacauaaucugagaauucaauucuaguuugcauguuaccauauauggguuaccaacuuuuaaagaaccuaaauacauuugcugaguacuaaagcugcuugaacuacaguuugggagaaaagaaccaggaaagauacuguguaucaaauggagucaucucuaguuuaggaagaaguauguguguuaccuucuguuagauaguauuaguaauuucuuacugaaggugcuccucugucuuauaaauagcucugucuuuggucuaaggggaacccaugcuaauuagaaugugguccauaaaccagcaaugcaucaagugggaacuuguuaggauugccaaaucgugagccccuccacagaauaagugaaaucaggaccugcauucucauaagaauccaagcaauuuguaugccugcugaaguuugagaaacacagacauaaauagcccucuccuccccuuucuuauauuaccuugaauuucguuguuuuaguggaaaggaauaagcaauacagaaaaguuguguguaugcuuguuuucauuucuguuugagacagagagaaguaaaaccauauuuaguguaaaaaccucucuuuuccccacaggggaaccuccugaaaaauguguaucauuaauugccuccaguaugaguugauguuuccagcugugccacuaucuuaacuaucuagucuuuggccaugauacugcuuuucccccuuuggaagcaaauuaaccaucuggaaaauaucccgauuauuuaaagaugaauuugcacaugaaguggcauuuucaagggggucacuguacucuguacugugcucagauauacuaggcauccacuguguaucaggcauuaccguggcugcugggaguauaagauaaucauaucagggcccugccuucaaaggacuggcagccuaagaggcaucauauagaauaaaauggugcuugcaagcaccggagucaaauuguuuacacucagaucccugccaucuaccuccuagcuguguauccuuagccaaguuacugagcuacucugagccuaaguuuugucacuguagaaugaaacuaauaacagugucuuucuuacaaaguaguugugaggauaaaauaauucaugugaagucuuuauuauacuuuguggcaucuaaugagcacucagcauguguuauuuacaaggaagagccaguaugauuagagaaacauuguaguagaagcaugcauuaagcuuucuggcaauccuagagaaaggagcccagucuguguuagaaaggaauuguugugaagagcuugacagaaaauguaacguuugagguggauuuugaaagauuagucaugguugccaggcagagaaaagacaaagaggaaauuugcuuugaggucaauguccacauuccuuuaugugguggauuauaccauucaauuuuacuucuaaauuccacugaaaggugguauugucauuucauuucaauuaaauaaauuaaccuuuuguguggaaacaacuggugacugugacuaaacacauuuaauucuauugaguggaguugcagacuucuuguggggcauuaacuuagauuucuuuccaauugcauuaccaccaccucuuuuguaauuauaugaaccagcuggauaggauaauaaauuguuucuuaaaauguacuggugucucuuuacuaagaacugcuuugcguauauugagucacauaccaaaggagaaaaggguauauucuggagccgcguguagcugucaucagauuguuauuucccagacuuuggaugcaguuuuuauguuuggauagagauuucacaaacaaagugacaaaacucugcaguuuaucuucuuauuguuauagauggcugauauggcaaagcauaccuggcuaguuucccagaucagugccuuuguugcucagaguuuaauaauaaacaauuuaaaauucuaguagaguuauuuuacucagcugguagacugucagucuucuuagguaggcuaugggguauccugugaguauucaguuucagaaaacauuuauaaauuuauaaauauagaaaaggacuaguagauuaaguuguuuuugggcaaacaaagucaucuacuuuuuaaaggaacucaaacuauuacauauuuuuacagguguuuucaaaauauuuauuuucuugaacauuuauuuuaaguuccaggguacacgugcagguuguacagguuuguuacacagguaaacaugugccaugguaguuugcugcacagaucaacccaucuccagcauccauucgcuauucuuccugacggucucccucccccaaccccuccuaacaggcugcauugugcguuguuccccccaaccccauguguccauguauucucaucuuucagcucccauacgugagaacaugugguguuuggguuuccguuccuacauuaguuugcugaggauaauggcuuccagcuccauccauguuccugcaaaggacgugaucucauuucuuuuuauggcugcauaguauuccaugguguauauauaccacauuuucuuuauccagucugggaauuuggguugauuccaugucuuugcuauugugaauagugcugcaaugaacauacacaugcguuugucuuuauaauagaaugauuuauauuccuuuggguauauacccagaaauggaauugcugggucaaaugguauuucuaccucuagaucuuugaggaauugccacacugucuuucacaaugguugaacuaauuuacccucccaccaacaguguaaaaguguucuuuuucuccacaacuuugccagcaucuguuguuucuggacuuuuuaauaauuuccauucugacuggcaugagaugguaucucaguugugguuuugauuugcauuucucuaaugaucagugauguugagcuuuuuuucauauguuuguuggccucaugaaugucuucuuuuaagaagugucuguucauguccuuugccugccugcuuuuuaaugggguuauuuuuucuucuaaauuugccuaaguucauuguagaugcuggauauuagaccuuugucagauggauagauuacaaacauuuucucccauucugugaguugccuguugacucugaugcuaguuuauuuugcuguacagacgcucuuuaguuuaauuagaucccauuugucaauuuaugcuuuuguuguaauugcuuuugaaauuuuugucaugaaaucugcccaugccuauguccugaaugguauugcccagauuuucuucuaggguuuuauaguuugggguuuuacauuuaagucuuuaauucaccuugaguuaaauuuuguauuagguguaaggaagggguccaguuucaguuuuccacauauggcuagccaguuuucccagcaccauuuauugaguagaaaauccuuuccccauugcuuguuuuugugaggucugucgaagaucagauaguuguaggcauguggucuuauuucugaguucucaauucuguuccauuggucuaugugucuguucuuguaccaguaccacacgauuuugguuacuguagcuuuguaguauaguuugaaguuggguagcgaagugccuucagcuuuguucuuuuugcuuaggauugucuuggcuauuugggcucuuuauugguuccauaugaauuuuaaaauaguuuauucuaauucugugaagaaugucaaugguagcuuaaugggaauagcauugaaucuguaaauuacuuugggcaguauggacauuuucacaauacugauucuuccuauccaugagcauggaauguuuuucccauuuguuuguguccucucugauuuccuugagcagugguuugcaguucuccuugaagagguccuuaauuucccuuguuagcuguauuccuagguauuuuauucuuuuguagcaauugugaaugggaguugauuuaugauuuggcucucugcuugcauguuguugguguauaggaaugcuagcaauuuuugcacauugauuuuguauccugagacuuugcugaaguugcuuaucagcuuaagaagcuuuugggaugaaacgaugggauuuucuagauauagggucaugucaucugcaaacagagguaauuugacuucucucccuauuugaauaccuuuuauuuauuucucuugccugauugcccuggccagagcuuccaguacuguguugaacagggguggugaaaaagggcauccuugucauuugcugguuuucaaggguaaugcuuccagcuuuucgccauucaguaugauauuggcuguagguuugucacauauggcccuuacuauuuugaggcauguuccuucaauaccuaguuuauugagaguuuuuaacaugaaaggauguugaauuuuaucaaaggcuuuuucugugucuguugagcugaucauaugguuaugucuuucguucuuuuuauguugaugaauuacauuuauugaucugcauauguugaaccaaccuugcauccuggggaugaaccugacuugauugugguggauaagcuuuuugaugugcugcuggauucaguuugccaguguuuuauugaggauuuuugcaucgauguucaucaggcauauuggccugaaguuuucuuuauguuguuguaccucugcuagauuuugguauuaggauuaugcuggccucauaaaauaaguuagggaggagucccuucuuuugaauuuuuuagaauaguuucaguagccaugguaccagcucuucuuuauaccucugguaaaauucagcucuaaaucugucugguuguggguuuguuuuuugguuggugagcuauuuauuacugauucgauuucagaauuaugggucuauucagggauuuaauuucuucuugggucagucuuuggaggguuuuuguaucuaggaauuuauccauuucuuccagauuuucuacuuuauguguauagagcuguuuauaguauccuugcauggugguuuguauuugugugggaucaguagugauacccccuuaucauuucugauugugucugauucuccucucucuucuccuuuauuagucuaacuagcagucuauuuuuuuuauuuauuuauuuauuuauuuauuuauuuauuuauuuauuuauuuuccaaaaaaccagcuccuggauucauugauuuuuuuuugaaggauuuuucuugucucugucuccuucaguucuacucugaucuugguuauuucuugucuucugcuagcuguguuugcucuugguacucuaguucuuuuuguugcaauaucagguuguuaauuugagaucuaaguagcuuuuugucgugggcauuuagugcuacaaauuucccucuuaacacugcuuuagcugcgucucagagauucugauauguugucucuucauucucauuaguuucaaagaacuccuugauuucugccuuaauuucauuauugacccaggagucauucaggagcagauuguucgguuuccauauaguugugugguuuugagugaauuucuuagccuugaguucuaauuugauugcacugugaucugagagacuguuaugauuucaguucuuugcauuugcugagaaguguuuuaccuuacugugaucaguuuuagaguaaaugccauguggcaaugagaagaauguauguucuguuguuuuggggugcagaguucuguagauaucuaucaguucuguuugauccagagcugaguucagguccugaauaucuuuguuaauuuucugucccaaugaucugucaaauauugucaguggggcauuaaagucucccacaauuaucaugugggagucuaagucucuuuauaggucucuaagaacuugcuuuaugaaucugcguacuccugaauuaggugcauauauauuuaggauaguuaacucuugaauugaacccuuuaccauuaugcaaugcccuucugucuuuuuuaauuuugguugguuuaaagucuguuuuguaagaaauuaggauuguagccccugcuuuuuucuguuuuccauuugcuugguaaauuuuccuccaucccuuuauuucgagccuaugugugucuuuguucaugagaugggucccuugaagacagcauacugaugggucucaacucuuuauccgguuugccauucugugucuuuuaauugggucauuuagccuauuuacauuuaagguuaauauuguuauguaugaauuugauccugucaugaugcuagcugguuauuuugcagacuuguuuaugugguugcuucauagcaucacuggucuguguacuuuaguguguuuuuguaguggcugguaaugguuguuccuuuccauauuuaaugcuuucuucaggagcucuugcaaggcaggccugguggugacgaauucccucaguauuuguuugucugaaaaagaucuuauuucuucuucacuuaugaagcuugguuuggccagacaugaaauucuggguuggaauuucuuuucuuuaagaauguugaaaauuggcccccaaucucuucuggcugguaggguuucuacugagagguccacuguuagucugacugguuucucuucguaggugaccuggccuuucucucuggcuguccuuaacauuuuuucuuuuauuuugaccuuggagaaucugaagauuaugugucuugaaguugcuuuucucauggaguaccuuacugggguucuccggauuuccugaauuugaguuuuggccugucuugcuagguuggggaaguucuccuggaugauaaucuugaaguauguuuuccaacuugguucuguuuuccuugucuuuuucagguaccccaauuagucauagguuuuuacauagucccauauuucuuggagguuuuguucauuccuuuucauucuguguguguguguguguguuuguguguguguguguauuauugucugccugucuuauuugagaaagauacuuggucuauucugcuauuaauacuugugauugcauuauguauuucucauguuguauuuuucagcuccaucaggucaguaaugcuccucucuaaacuggcuauucuggcuguuggcuccuguauuguuuuaucaugauucuuaacuuauuugcauuggguuacagcaugcuccuuuagcucagugaaguucauuauuacucaccuucugaagccuacuucugucaguucagccaucucaacuucagcccaguucugugcccuugcuggagagguguugcugucauuuggaggagaagcagcacucuggcuuuuagaguuuuccagguuuuugcauugauucuuucucaucuuugugggcuuaucugucuuagauuuuugagguggcuuaccuuucagugggguuuuguggggucuuuuuuguugauguuguuguuguuacuuuguuuguuuguuguuuuucuuuuaacagucagaccacuuuuccguaggacuguugcaguuugcugggggauugcuccagacccuaguuguuucaguuuuuaccuuaccuggagguaucaccaguuaaggcugcaaaacagcaaugaugguagccuguuccuuccuuugggagcucuguccuagagggguacugaccuguugccagcccagacacuccuguaggaguugucuagagaccccuguugggaggucucacccagucaggagagacaggaucagggaccugcuuaaagcagucuggcugcuuuuugguagaguaggugugcugcacuguggggaucccauccccauccggacugcuucaacuguccagagccaacagucuggaaaggcugugucgacugaacugcuuagauguuggccaccccucccgccaggggcuccaucccugggagggaucagagaucugucuguauaacccuggcuggaguuccugaaauuccuggaguugcuggugcucacuggcaccaacuggugaggagggauggaucggggucccacuuaaagaaaaagucuggccacaaucuggcacagcagcuaugcugcauuaugguagacuccuccuugucuagacugccuggacucccuggagcuggcaggcuggaauggcugugucaaaugaacugcagaaacaggggccgucucuccccagggcucuaucccagggagagaucagaguccuguucauauaacccuggcuagaguuguugaaauuccugcagggaggcaccacccagugaggagggauggauuagggucccacuuaaagaagcaguguggcugugaucuggcacagcagcuguguugcauugugggcgacuccuccuuguccaguggacuccuuggagcuggcagacuagaauggcugagucgaccuaaccacagaaauggcagcugccccuccccccaggaacuuguccaucucaggcagucuccagccuguugcacugguuggcuggauuuccaauccagugaggcuuaacuugugagaugccauggaaguggggcccgcagaacaacaccgcuuggcucccuggauucagcucccuuccuuggagaauuuauggauggaucuccugccuuaccgggauuccuggggcuagagucuauuaaacuccugggucucugugugagccugagcaacugcucugccaagacucugcacagcucuguguauuggacccaaggcccugguggugugggcucacgaggguaucuccugauccacaggcugcaaagauccgugagagaaacgugguuucccaggugggggucacacaaucacucacugcuucccguggcugggaguggggguuucuuuggcuccaugccacucccaggugggcagucacuccauccugauuuccuuaguucuuucuccaugggucgaguuguccgccuagucagucccaaugugaaaaccuggauauuucaguugaaggugcugaauucacuugccauuuucauuccucugggagaacugcagaccacagcugcuucuaaucagucaucuuugccaaaauaucuguuuaguuuguuaccaacuuccuucagaaaauuccauauggaaacccaacaccuacaaauacacuuuugaaaagauaacaggacaaauuguuugcauuuuauaauuuccuauguuuaauuuugucuauuguuauaauuuaauacuucugaaaaauuuuuuuaauugacuaaugaaagcagcucucaggugugguuaaucuuauaauugcauaaauaaggaaaaccaguuauguuuguaaauaaauauuaaaggacugauguuuauacacuuauuuuguauauggaucauaaugaaaauuaaauuuagcauaugauaauauaaauaggaaaaaucacuuacucaaaauuugcauuuguacuauaaauccaugucuucguaugauuuuuaaacucuuaaagauuauaguaaucuuuucaauaaggacuuuauaaaaguuuaaaaauggaacagagaaauugaauucaaauuauuaaguuacuaaauacauucuuauauaggcacaagguggcuuauauuuauacuuucaaaaagacuuuggaguugucacuuaacuguucuacuuuauaaagauuugauguuaauguuuuuuuuucaccaaaaauuuagauauaguguuuguagcuauuucuuggugaacaguuauuuuuauuuuaaauuggaaaaauaauccucaucagucaggagaaaacaaaauaaugauucaugaagaaauauguugauuuuuucuuucagaccugaagauuaucggcuauaagagaauaagaauugcagaaaauaacagugaagugauugaaacuuucuucugaugaguuucucuaaccuacaggauggaguaaaacaacugcuacaguucagcaccuguuuuaugugccgaaucacuguggggaaaggucaggaagguauaguccuucaauaggaaauuguaauuaaaauauaauuuuauagaaccauuuuuauguaaucugauuugaauguuauaguugauaauaauaaaaucacuuacuugguugacuauuuagu

SEQ ID NO: 17776 - RNA, 78427 nt, Homo sapiens
cggcuucucccucuuccucgaguuuccuccagucuucuccacggcagcaauuucgucaugaaaggagcauauaaugcaguuauuuagggaauaacucccaaaaauaucucgcuugguggaaaaacugcggaaaaccgacggaggacauaauuuccagccgaccuaaacgaagggaaccggaaaugcgucauagcgcgcgucuguuuggauguggaagccgagaccuaaaguuggggggugaucucugaggagauggaucgguaccugcugcuggugaucuggggggaaggaaaauucccgucggcggccaguagggaggcagaacaugggccagaggugucgucgggugaggguacugagaaucagccggguaagcgcugggaugagaaagagcgggaacggcuuguggagaggggaagaaguuugaguuuugugaucaaguucugcugaagagggaucaauauguaguugucccacgaagcugggacucuaucugggauagaguuaaugagggcugcaaaaauagcaucuucauggaaaaacagggacaaauuuguggaugcaagauuccagcccuuagaaguucuuggcauaguaaauguuuaacuuaauaaauuuucuaugccuuaguaauggaauuuccugcuuuuuggaaauauaugcauuuauuauuucugcuccuguguuucacaugcaaauaauacggaaaggagcaagauggacaaagaucuugcuguccuacaauuuacaucuaaugggaggagacaucccacauauaaccuaaguuuuaaaaacaaaugaugaauuuuaaaugauuuuaauuguuugcgauugcacugcuuuuuggugcacccgucuagauucaauauugcauuuuauguguucauuuguuucgaucaaacaggcauuuugaggaguaaauguaugugguuguguauaagguauugucacagaauuucccuucucuuuaaaauuauucuuuugaggggaauuuugcauucgugcuaacugacuggcauguacagaucgggagccuuuucuauuuucucugauugcuuuagauuuucuguaucaaaacuugaacagaucuugagcagcguuuaguacuuuuauguacaaccuacuggucuugagagucucugauggugaaauuggacuaaguuagauuauguaaaucuagagcccuuugaguuagucuaucuuuucuuuuucagacuucacagcagcaaauguuuaucaccucuugaaaagaagcauuagugcuucaauuaauccagaagauaguacuuucccugguaaguauaauaaacuccucuuuucucuggcacagcauuuguacuggaaauuaacuuaauuaauuuggacccuaaggaguacaaggaaauacuucuugacuguguacaaggcacugaguuacagagauaacuaagggaguacaaaacugaaaaauaaauuaccccuuucuucuagaugcuugaauauaguaaaguuaugaaaauuauucuagguucucagcuugaauuuugcuccuuuuaugaaauuuucuugccuaucuuaguucuguauaacuaaggggaguguggcuuuaugaggaugauuuuaucaugaguaaaaauauguaaagcucccacacggauuuccuuaccauuuauuuauuuauuuauuucuguucuuaauuaccuauuucuguucugauucucuuaaaaguacuuaauaauuacuaaacacgaugagcuuuucucaguucuuaucugcuuugacuuuuugaaguauuucgcuuuuuugaccaaccguacuuuguaaaaaucuuuccuccuuuagcuucuacuggcauuauacaaaugcauuuacugacuuugauaguuaucuuuucuuuuauuccugcuucuuguccuuuacuggagaauguccuuuaaacguucugaaaauggagaugccaaaacagaccaauaccuaaaaacugaaggaaguuucuuuccaugcaaggaagggucugcuccuuuugauaauuuuguaguucccgugacuguacaaucugcaccuuucucuucuuucauuagagaaccucuugucucucggugucaaauaacaccauuggggaaugauuucuaauauguguaugcuacucuagcuuguuuuccaaggccuaguaauacucauuaauuuucaaguugguauaauuuuagucaauaccacuauuauugcaggaaagauuuucuuugauuuguaccucaaauguauauguaaaagagcucuugggaguauuccagggguucucaugauaaauuuuacuucccccuugcguguuuaggguuucuuauacacacgguccuuguuuuguaugauaguguuguucuuuauaauugauugugcaaagcaauccuaauauaaucaaugagaaaaauuagaauugucccaugaccuuuaauaucuuuugucaaaacauuaaaaauucucuuacuguuauaaaauuuuauggaaauaaaaaaauaguaaaaauaaaauuuauuuuguacccuguaauuuuaaaaccuuagguacauugagaauuaaaguguuuuauuucuuuguaaaaaccuuaccaagaguaguuugagcagugcuugccaccuucacaucaucacguaacuuaugauacagaaugaacaucuuuuauuggcgaauuaucauauuccaguuguaucaacuuccaauguuuuauucuucgauuuuuuuuuucuuuuuuugagacagggucccacuuuguugcucaggcuggaguccaguggcucaaucaugcuucacugcagccucaaccuccccggcucaagugucacuauccuccuaccuuagccuccugaguagcagggacuauaggcaugagccaccacaccuggcuaauuuuuuaacuuuuuguagagacaggguuucauuauguugcccaggcuggucuugaacaccugggcucaaguaauccaccuguuuuggccucccaaagugccgggauuacagaugugagccacugugcccgaccuggacuuucaauguugugaaauaucucugaguuccuuuaauauuaagguuuuugcuagccucauuuucucugggacaucuucaccuuuuugaucaaaagguguuugucacagcagcuauuuuuagaacucuauuuacauuagcuuugaagauugcuuucaguguuagcacuuuuuguuucuuugguguuucuuuaucucucucuuuuuaaaaaauucccucauccauuuauccauuuuuauaaaauaucacauggguuuacacugggaaaccagaaggcaacacaauuacauccuuugcuaccugugugugaacugaauggcacuugcacagugaccaaucaaugacguacuuuaaaaguaguaacaugauugguuacugaucaugacacacaucuuuuauguauacagugguuuuguagacugagaagcuugcaaugaagucuuaaacuaugcaguuauaguuagugaauauaccaugguaacugaaauuugaaccagguuguuggggaacugguguuguuuaagcuacaguaacuggaauuugugcauaucagaaccaugcaaauggaaacugccugcgcugaauuuccugccauacuaggauuauugauuucaguaauauggcaaguuugagggacggaaaguacaauaugauuauaauugggauaaggguggagagguaggcauggcuauuuagaggauuuuguaaauagugucaggguguuuggauuuuuuccuaaugguaaucagcagccauuaaaagcuuuaauuaaggaggagacaugaucagaucugugcuuuugagguauucucccugcaguauaguagauggauuagagaaaaguauagcuauuucuguacugggggauucuguagaagaccaaaugaggaaugggagaggcagccaggguggaggaaaguggauagaucugaaggaaauuauggggguagaauucaccuaccuuagcguugaauugguaugauguagaagaaggaaaggaugagaaaagaaucaaggaugacauuagguuucugguguggguaauggcaugaugguggcauuuagugagaaagaaccagauuuggagggaauaugacguguucaguuuggaaccuguuaauaguugccuguaagaugcaaaguaagaaguaaaaauguaaaaauguuuuacauguuuacuaaaauaaaauguaaaaauaaaguaaaaauguuuuauaaaaguuggauauuugugucgggaacucaagauguaggagagggcuggagauauuagguuggugcaaaaauaauggcaaaaaaacccaauuauuuuugcaccaauuaauacaaauuauagaaccaauguacagaugucaggugaaggcaugagaaaggaugggauugcuuacggauaguagggagaacagaaagccucaaacugaaucccaguauuuagaagaacugaacaccaguuuuuaaaaagaauaaggagcagccagaaggaugggugccacagaagccaaguguuuuaaagagaaaguaguaaaaugugucaucuuugauucuucucuuaugcugagaggucaaauaacaacagaacuaaaaaccgcuagauuuaguaacaagucaguuauuggugacuuuggugaguguucuuucaguggcauauuggagacaaaaaacagauugaaaugcauuuggaaggaaguggaaaaguugaugaggaaauggagacagucagguguggacaguaccuucagaaguuuaucuuugaggaagagcuaagaaagugaagugaagaugaauuuaaagggaccccuuuuuuuaaaaaagaaauacuuugagaaacacuuguguguauuuaaauggcaaugacaaagaacagacagaagggagcagacugaaaugcaggaaagaugaucaguggacuagauaauagaaucaguggucucagaggaggugugggggauaacauugaauuagaaggacagugcuucuuacacguuaaaggggaggaaagaggaaagauuaauggcaauacaaguugaguuguaucuuuccugagaggauguuacagggauuauuaccuaauagcuucuauuuuguuaaggcagaaggagucuucugcugagauuguuggaagaaagugguaauaagaauuuagcaucuuaccuagcuuccuuccauuaguuaagccucaguuaccuuucuucuuccuguuuugagucuaauuucuauacauagcucuaaauucuuuaugacuccuugacacauacccuggggugacccuuaauuuuauauccucauauaauacuccauucuccaagaagagcaucuuccuuaucuuuagacuggguuugcucuuuaacgccucugucucuagucaggcugaaccaaccugcauagucuuuggagagggaauugcuuucacuaaaaugacuuacaugguuuugcuuuacucaguaguaauugaguagcuguauuuucaacaucuuuaugguugauuguaaucugugugaaaugaugauuaaaauaauaaaaaauaauaauacgaaauucugaauugugacaaaugaaaggcaaguauuuauugugaguaaagaauuuugcucuuuagguagauuguuguauuugaauuuuuaguagggauuuuuaaaagauccacauauguauguuggauaauuauguaauauguuucaaaaguuauggucuguaaguacgguauauaugcugugucaucugcuuauuuaugguaugccuuuuuaauaauaaugugguuuuauuuucaagccuguucagugggagguauaccugguuccaagaagugguucuuugcagugcaggcaauauauggauuuuaucagguaauauaaauuuaaagauagcuacuaaugaaugucuuuacuaauauaaauaauuucaugauccauuauuuaauacaaucuuuugauuuguuaguuuuguaguucugauuggcaagagauacauuuugauacagaaaaagauaaaauugaagauguucuucaaacgaauaucgaagaauguuugggugcuguugaguguuuugaagaagaagacaguaauagcagggaaucauuauccuuggcugaguaugcuuauaugguuuuuguauuaucauuaaaauacuuaauauuagacaguuauuuuaauccaugagaaugaagauuauauauuuuagcaucuuuacugaagaaacucuaguuaauugaaauuuuugacucucaauuugggccuuuuauuugaauaaaauucuuuaaaaugcauguuucuuaagcuuacauaaugucaagaaucauaaaaagugauauuuuaauaaacauguuccuuucuugaagauaaauucugccuaauauuuuauuuuauuuuugaaacagggucuugcugugucacccaggcugcagugcaguggugcagucacggcuugcuacagccuagaccugggcucaagcgauccuccgaccucagcuuccagaguagcuggaacuacaggugugcaccaccacacccagcuaauuuuuguauuuuuuuuuguagaaauaucauuucgccauguuguucaggcugaccucgaauuccugagcucaagcaaucugccugccuuggccucccaaacugcugggaguacagcugugagccaccgugccuggccaauaauguauuuuaaaagcuugaauagaaauguuauuuaauguuaauagcuagcauucauaccaaaguaucauuuucauuuugcuauuugaggcugaaauaugugacuucuuuaauuuauguguauuugcagcauuucagguaccuuuuaaaauccauagaguuugugaggauuauauguacaugauugaguucacuuuuagguuuuuuucaauugugguacaauauguaaguugauccaggugacauaaguugugauaauaauuuuucucuugaugaaauaucccaccucuuauaguuaauaccuuuuauuuuagucuuucauaacauuucaugacaaaacugcucuuauuuuaguauucacauauuauaucuguaaguagcuguagacuuaaaaauuuucauuuuccuuuuuccagaucauauuuguuuguacugauuaauaaaaggagaccuuuccaaaccagagaaauaucauugaaccagggauuaguagagguagacuuuauuuacacaaucuuaggccagucacguaacuucucuggucguuuguuuucucauccauaaaguauugaaguacuuuuagauaauuucuuaggugcuuucauuuacccuuaaaaacucuuaucaucccauauguuuuccuaccacuguuaaagacaaguauagccaggcacaguggcucacgccuguaaucccagcacuuugggaggccgaggcgggugggucacaaggucaggaguucaagaccagccuggcuaacauggugaaaccccuuuucuacugaaaauagaaaaaauuagccgggcgugguggcaggugucuguaaucucagcuacucgggagccugaggcuggagaauugcuugaacccgggaggcggagguugcagugagcugagauucugccacuguacuccagccugagcgacagagcaacacuccgucucaaaaaaaaaaaaaaaaaaagaaaaggcaaguauaaaaguuucugauaagugaccuaauaauuauuuccacaagggggagccugaaaacuagaguuuacauaagaugccuuaaguuucuaagacgguggguuuauaguaaaggauuuaaguaccuuuaugcuauauaauaaacuuuuuugagaaaaaaauugcaucauauagauaaaacuaauaaguuuugaagaaucugaagagggcgucauauucuuuagucaagacuguuaaauaccauucagagaaaaaucauguccuuuuuuauuaaacacuuagcauuuucuuacuuuuaagauucagaaaaauggcugggugcaguggcucaugccuguaaugccagcacuuugggaggcugaggcagacggauaaccugagcccaggaguuugagaccagcuugggcaacauggcagaaccccgucucuacauuagccaggcaugguggugugugcuuguagucccagcuaucccagcuaugcaggaggcugaggugggaggaccuccugaaccugggggauugaggcugcagugagcugugaucaugccacugcacuccagccugcgugacagagucagacccugucucaaaagaaacccaaaaaccaaaaauaaauaaauaaauaaaagguuccaaaaaaaguuuggucuguuaguuaugauuuauauuuaauaugcuaguuauaauuuagggaguuuuauuuccuuuuuuuugauuguuuuugggguguggguaagaacuuguacucaggguuugaauccuagcuuccauacauacuaauuauguaacuuuagggaaguuauuuacaguugagauaauaguauuauaguaguaccuccuggaauugucauaaagaucaaaugagauuauacaucuaacauguuuaacagugucuguacaacaaucuuuuuaguuaauauuaccuauuaugauuauauauaaauauauuuaugggguuuucuuucccuaacuuacccuuuuauuuuagucucuaugaagaagcugcagaaaauuugcaucagcugucagacaagcuuccugcuccugguaauauuuuaugacugcuuucaauaauuuguaucuuaucuuauuacacuuuaugaauaaaugauaaauuuguucuuuauguuaguguucucacucuaaucuuuaaauuaaaaaaugcaaaacaauuuuuaauugaaguugauacagaauguauccaugggaguacauuaccgagauguagcaguucuuuucauuguuuucauuuaguuaggcaaaaauuagaacuuuggacauuaaauaacuaucucuguuucuuuaguuauugcugaagaagaaucuuccugcuacagacuguugcuuuucagaguauguucuauagaagacuaauccuauaaacagcucuuuaaaaaggagauuauuuagccuugaugauuuggauaacauucuuuuauggugaaguuacuauaugcauugucaaauggaaugucauaccauaaaagaaaguguuuccucagcauuuuuuuauagaaccuauuuuuuuccccauaguggaaagaauaccugugacauacuguaucauaauauuccuaaaacugguuuuuuucuuuuuuccuuuguguuaaucaaguagcugucaucuaauauuugguacaguugguauccgcaaauacuuugaagaguauucuuuucugaaugcuuuauugaaggucauuaguaaguaaauauuuguacuaggagccaaguguaccaugaugaauaaagcaucugugauuaacauaaaggagcuuuuagcuuauagucagccagaucucuauauucaaggagaucauauauuaguacaaaaagccccacauagaaaaauaacugaaugaguugacaaacguaucaacuuuuaaaaugaaauguguugaggucaaaguaugcacugaaauauuacauaguuguuuuggcaaauuagaauacuuucauuaucaaauuuaucuccaguuuguuucauuuugauuuuuguaguccuucaggaaauguauaauuuuauaaaauuuaaaguuuugugaaguuauuuuuucucaggauccaaugaugaugucaguauaauugguuuucagaguguuuuauuguccuuuauaaaagagacaucauuuauuugaacauuacaguuuugcacuuauucauucucuuuuggauaacaaaauuauguuuagaaaaauauaaugaaauugcacagguuuuuuuuuucucuguugaguacaauagcauugaugaucaugagagugauguguguaauuaaccacugcugcagaauuggcaaguaauuaugauauaguuuauuguuuucuaguauaugcuagcuauuucaagauaacauggcuuucaauaaaugaugaacauuuaaaaaguuugaauuccuaagggcguauauuguuuuggagaauuucagaaauuaaaacuaaaagcuuccuuugucuucuaaauaaauauaaaacuaauuuuucuaaauaaacauaaaauucaguucuucaggguacuauuuugagacauuucagaucuaacuuuuuaaaaauuacaaaaaugccuuuuucucuuucuagguagagcaaugguagauauaauacuguugcuuucugacaaagauccuccuaaauugaaagacuauuuaccuacuguaggagcauuaaaacauuugagagaaugguauucagcaaagaucacuauagcaggaaaucauugugaaauguaagcuucuuuguucauauuugauuauugucugccuugucuguuuucacaauuaacauacuauucucuuuucagacucagcguuugaaaauuauuuuaauaugacaacauaaaauucuauguuauaccaugauugcaaauuuguguauugagaagaaucuagauguuucauauuuuauauuuauguuucugagauauuuaaguuuuuaguaaauauuauugaugcuguuuuacaaccauuauugaggauuaauucuauaagcacacugugugcuuuugaacauagauacacuggauuugucauguuguauuugguuuucuguuaugugccaauguaggaauaaauauacacuguuguguuuuaugauauucuagcaaggauuaauuguauauuacaauuuugauccuuaaacauucaguuggauuuaauaacuucaugauuuguuuucauucaacgaauguuuauugagcaauaccuuuauggcaagcauagcaauagaugcuuguaaguuaagaaagugagaagacaugaucuuuuucauugaagugcagggagaaacaggaaugcuaacagucaagaaagucugugguaagugcguuacagaauuccaugcaaagauguaugggaacaauauaggagagcaguucucuuuuugaagauaaggaagugacauugugccuguguguguguuuauguacaucugacaccuuuaagccaauaguaagaggaaagucuauuucuucauccuuaguacuaaagauaauuacucuaaauuugugaggauguugggacuaaaugaacaugugucagcaaugcacuuagagacugacuuaauggguguuucauauuaauaggaaaaauacagcaauauaaauuuugcaauuuugccucuuaggcuuguaguuaacuauaaugauuaaaucagugaaauauaaaacccuguguuuaauuguuguaaucuuuuuuuuauagaaacugucagaaaauugcagaauaccuuucugcuaauguuguaucuuuagaagaucucagaaauguuauugacucaaaggaauuauggagggggaaaauacagauaugggaaagaaagguaaauggauuauucacaguuugccaaguaggccuuucaauuuuauuuacaacacagauauuuaaauaaaucuuaaugaaaauguaccuuauaaagauauucuagaauagcacuaaguagaacuuucugcaauaauuaaauguucuauaucugugcuaauacacuagccuacaaaccacuuauugcuacugagcacuuuauaugugaguaguuccaccaaugaacugaauuuuuauuugauuuuaauuaacuuuaauuuaaucacauaauaaugugauuauauucaagugcuguuuccagaauguaauguucuuuuaaaauauagaauuuuuaaucgaguucauguuguuuauccaaacugcuuuauuuuauugcauguguaaacuacuagaaaaaacuacuuagagcauauugucuucccauaauacuaccuuaggugaucuuugcuguuuauuaaccagcccucagauuuugaacaaauuuuuuuaaccuuacuggaccccagauuucucaauuauaagaugagaauguuguauuagguggacucuucuaauccugaauuucuaugaaauuucuauuucauuuugacgucucuuacuaugaaagaauguuuguggguuuuguaaguuauguccauuuugaaauaaguguucauaguaauuuauguauuuuuguagauaggcaaaacuaaacuaagaaaguuucuuaauguuuauuuaggguagcaugggagcaugaguagacuuuugaguuccucuaaaguuuuguuacacuaguuacuagaaauuuuucuuccuuuuuaauucacccuuaauaaugguuuaauaaaaucucugauuagacaacaggaaucaauguggcuggauuugucuuguugauuugcauguuugcucauccuaaucucagacagguuaaaucugcaggugaacuuucucugcaaauguuuuaguauaaagaaaucccacauaggcugggcgcaguggguggcucacgccuauaaucucagcacuuugggaggccaaggcgggcagaucacgaggucaggagaucgagaccauccuggcuaacacgguaaaaccucgucucuacuaaaaauguaaaaaauuagccgggcgugguggcaggugccuguagucccagcuacucaagaggcugggacucuugaggcaggagaaugaggcaggagaauggugugaacccgggaggcggagguuucagugagcugagaucgcgccacugcacuccagccugcgugacagagugagacuccgucucaagaaaaaaaaaaaaaacccaaaaaaaccccacauagccaaguggaagaguggaagauacaguuugcuagaauugcuuuuguauguuuucugaaacugcaugcuuacauacagagagauaauggcagaguucuuuucaugugauucuuuuauucucuugaauaggaaauuaaauguucguaucuccacuggaugcauuuaaaacuugaaaucacuuuuuuugguagagaacagcuuuuuagucaagaggcaucauggugauuaaggacauagauucuagaguuauauugccuacaaucaaaucccaacucuuuuuucuuucuaguuuaacguagcauguugugcaacacuuagccucuuggugcugcaguugucuucaucuguaagaugaugauaauaguuccuaucgcauagauuuuugugagaauuaaauuauuuaaagcacagaguaaccacucaguaagcauuagcuaucacuguuguugugccuaccauuacuauuauuagcauccuuacuauuacuacuucugcagcaauugaucuuaucagcaacauuuaucaaagacaaacuaugugagacacugugcuaaggaucuaguaaagaauaagauagagccaggugcgguggcucacaccuguaaucccagcacuuugggaggcugaggcagguggaucacccgaggucaggaguucaagaccagccuggccaacaugguaaaaccccaucucuacuaaaaauacaaaaaauuagcugggcaugguggcaggucccuguaaucccaacuacucaggaggcugaggcaggagaaucacuugaacccaggagguggagauugcaguuaggcaagauugcgccacugcacuccagccugggccacaagagugaaacuccaucucaaagccaaaaaaaaaaaaaaaaaggaacaagacagacagcuucugucuuugcauaacuuacagacugguaggaagccagauauugaacaaugcaaaagagguuguuugguccuguggcugcauagaaugagcuuaacauacucuugccagcuggugaaggaccaacgagagcuuuucaugaaaaccugaaaaauugaugucuaaguuaaaacaggauguguaccuaaaugugagaagcacacuuuugagcugaggaaucaaaaauaaauuuauacauggauuuccccucaacuuuuacauuguaauaagauguauuaaucuuuauagcauuauucaugauacuuguaacuguguuuucuuggucucuuuucaguuuggauuugaaauuaguuuuccugaauuuuguuuaaagggagucacacuuaagaauuuuaguacuucuaauuuaaauacugacuuccuugccaaaaagaucauaccaucaaaggauaagaauauuuugccaaagguaaucguguuuaauuuuuuugugugaucauucauguguauuuuuguuccuauaaaauauguuugaaucuugacuuaauauuacuaauauaugugcuuaagugugcucacuagcauaauuuuuaauauaauuaaguacuuaaguuauacuaugucaucaacauuaaauuuuggugaaagugucauuguuuuagauguuuaaaaaaauguaaugcuacuaaauguguauaguccugaaaccaccuuugguuuggacuuuacuaugugaccuuucuaagacucaguuuggagagaauaugacauagagaaaagaggauauguuuugauguuagguaaaccuggguuuggaaccuaacugugucaccuauaaguuguuuauaaccuuggguagauugauuaacucauuugugaaguggaggcaauaguaacacacuuaucuuacaaaguuaugaggauuaaaugaggugagaguuuaauaugugacauaguaccugacauaugcuuaacuuauaguguaagaaguaucaguucuugcccuguaucuccuauacauuuauucuuaaaaugcaaguaauuauaaaauauaauaacuaggaaaaggcuuaguuggcuuuuuaacauuggaaaaauaaccuaagaagagauauuuauaugaagguaccuuagaauucacuuuaaaagaacuaauuuaagaacauggaaaacagugggcaugaaguuaaaggaugucaaauugaugguuaauauuuucuaaucaaagggugguacaaaaagaggguaucauuugauuugaacucauuucucaauauuuguuuagaauugcuuacuuuaaguaacuuacuauggccaucuuucacaggaauauuaaauucuuuucuaaaaauuagaaucguaagauucaugaccucaacuuuucuucaaguaugaauaauguguccaaauuuuugcuacuguugaagagaaucuuaggguacaacuucuucaauaauguaaaauucauauucucucucuguauauguauagacacacacacuguauaaacacauauguuuaugauuauagauauauauacacuuaaucauguauggugaaauuacucugcuuuuuacaagucuaaaacuuuguguaaccucuucaagaagugugcucuuuucuuugccuuucaugugaagcaccguggcuccaacuacugaaauagccucccuucaguaacaaacucuaauuugguuuuaggcuuuacccaagaaauacaguaccgaaauuuuauuuuuucugaauggagcuuucuauguuaauuagcacaugcuggcuucacuaucucucucuguaauuuauuuagucuuuucacuagaauuuuuuuuuucuaaaugucaguguaccacucagccuaaguucauccuggagugucuuuucuuucacuuuuuuagucugcagauuccaccugcagagguagguugcuaauuuguuucuucaacacuauagccuauuguaucaccugucugucucguugaagauaaacagcaaaaguugagaacgcuuguccucuguugcuuaccucuucccauacuuauuuucuccugugaaagcucuuccugguuacuaagugaucuccaugucuguuucuguacccugaaagguagaauugaaauugaagaaauucuggucugcuauagaggauuaaaugcuaggcaugcuuaauguguaaaaaguugcuuuuuaagauccauuuuaaaguuuuaaacccuuaaucacuaauuuguuuacuuuuguuuaugguauuuaaauauuacacaauuuuaauuucuuuucuagguuuuccauuauuauggcccugcuuuagaauuugugcagaugauaaaauuaucagaucuacccuccugcuauaugucggauauugaauuugaguuguauccuuucauuuacauguucauuuuagauuacauuuucugugucagguagaauguucugguauugucagguaaauauacauguuagguauaucuuuuucauuauauucacuguuuuaauguugauguucaaguaggcugcuggacuccuuauuuuuggaguugcuggggaaggaaguucuugcuuuucccaccaccuggauccuauaccuauuuuaucagaaaucuuccucccuaugcaagcaucuuuauuuuuguucaguauuguugagacuuuucuauggauagggcuauggaaauaauacagaagugauugagccuugcuucuuuaaugcaauuauaauguucucugcuugagcacaggacugaucuacucucacaccuagccuagcauuaacugcaacuuuguccuucccacccacugcccagacaccaccacguauauauuuuaugugcuuuuguuaacuuuacuauuauuuuuuauaguuuuaaugcuuuuuggaaauaauuucccuuuuccugaaauccaggaauacaucuccaugacuucuguguuuuacucaauauguuucugcugaagaagucuguaacugcaauauaucauagcauagaguaagcacucaauauugucagaugaaugacuuuggauuaugucagccuaaaucaaaauacucauuauuuucuuauugaaaguucuuugcugcagaaaagauaacauauacaaagguguaggagaacguuacccagcugagaacuguuuguagucuagaaucauuaaagaguagugguuuuuuggcuuggggguguugagggcaguugcuaagugaucagauuggagagccuuuucagauuaaucagguccuaaaagaccuuacguaucaugauugggguuaaauucuauccuaaagauaaugaggaaucauacaaggauuauaagccagacauagcuuaaugaaaaguaaauuuuagaucaugcugguaggauuuuggaaaccugagcaaagcucgaacuaaacaaguggcauuuggaauggagagccaggaaaaguacacgauguguuaaagauguaaaaucaacacgguauuaugauuuauuuauuacaugcggagaaagugagaaggccagagaguguaguugauucccuauguugaaacuggugucacuaguugagauaacaugaggugagccauuuucgcagaggaaaaggaauucagguucggguaguuggagugguaauguacauuguaguaaaaagcauaauagguaguuuaaaaaauuuuuuauccauuauacauuacuguugagaaccauuuagccagcaugcuaccuggcaguauaacuagacguuacuuucagauauaaucuauuauuaauacuucuuuucucuguccucaucuguuagcagcuuguaggucagaagcuauuugauguuuuuaucuuauauuagauucuugucuuagaccaaugguuuucaaacuaucuuccaaggaaagucgaggacugaguucuucagauaaugggauugaaagauaaguugagugggcauggcucuuggcccccuccuacugcaaccagagcagcaccuguucuacccuaaauauuggguuuccauauaaaaugucacuugcaaaaaguugcugcauuaaaaagguuugcaaagugcacuguaaacuguuuucaugguaccacccaacacuuagauguuuggccguguuuuuacauaauauucaguauacuuuuugcuaccauuauguuaagaaaaguucuacaacuugaaaaaaaaaaucuucccucaaauacuguauuuaugcuuuuagaauaggcagaggacuuccugguauaugguguagagaggagggagaaauguuaggaaucuguggaaaauaaaacaaguaauuuauaaacuuaaaaaauguuuaaauguuucuccugccaucagcaugaagaaaccuaagaaucagucagcugauguaucauuuuauguauuuaaguaaauauaaaugguaucacauguaucugcaaauauauucaacauauuuuaaacucucuuuuaaaaauauauaagcauguuuagaaauacaccuaagaacagaacauuuuauauaaaaagaaauuguuauuggcuggaaaugaaacacuagcauaguguuuuugaauuuuuauuuaggagcuacaguuuuuauaaauuucuuguucuuauaguuuauaguaaugcucuauauaguagcacuguuucuuagcauauuuucagaaucaaacaaauaauuggaaaaauacuuauccuuagggaaaggcguaauuguuaacugcuacaguuaaauuuuuuaauagaugaauuuaagcaacuguggaagaauugaaauaaugaaacuuauuuuaaggaguacauuguuucauggguaccauuacaucauuucuuuaacuccuuaguacagaggauugacaaacaguaccaaacagaauucuguguugcuguuggagcagauuucuucucuguguagcaagguauugaggguuucuuggggguuuuuuguuuguuuguuuuuauacuugccauuuaaggauguguaagaaaagggaauguaacuuauuaaucuguuugcuugaugacuugguuucuuuaauguaauauaggauaauuuugguccuaacucauauuaagauacuuuggacuuuucauaauaacuguaaaaguacucugcaaacauaagugacauuuuguuuuuaggagauauuuucagaaauaagcuuuaugacugguaauugcuuuaaaguuuuaaaauuuuauaacauguuauuguuaaccuacuucuucaacaugcgauuucaauuuuaugagaagacauucauauacuugcauucuuuuucucauuguagggcaggggaugaaaguggaaaaagcuaaaguucuacuaaauugucauuugggaguuuucaauuuuucuuucuaaauucugaugauguuuaggagauuuauggcuacuuuaacaguuauuuuguauauauaaugauguaaaauugguauauuuuuaacuuuaaaaaaauuacaauauaaagaauuuuaaguggacucaucuauuugaaaucaaauucaguuucuaauaggaaaaagugaaaguuugcuuuuuuucuaguuauuuauucaacuguuauguuucugugaaaacaauuuuuaaugcacaaaaucuuuauuggcaguacuuacauuacauuuucuuauuguuuuaauaacaaguagacuagcaaauaguccugcagggagaaagugauuauuauaauuauaacaguuucccuauggugcuaaaaucaagucuugguuauaauuccuauagaaaaucgauauaguaaaggaaaaaugauuuugaccuuaagauguauauuugacuauauaguaacuuaaaauuuuggcuucuggccucuuuuuccauaaauuuaauaguccuuugaauaggacgacaaaguauuuauuugaugaaguggccuuuaccaauauuaaccuggcuuucauccucuaagaauaacuaauuuacuaaauuuugaaauuuuaaaauuuaucuuuuaucauuuauccaacauauauucuacuguguaugagguacuauacuagauuucgggaacccaguaaugaaguguacagaagaagcuucuguauuuguggaacuuacauuuuaggggaccaacagaaaauaaauaacuacagacauaauaagaauuaugaagaaauaaacagccugagauagggaauaagucaagagacccuaguuuagauagagauuaauaaggccauacauuucuccaaacuauuugcagagacagcuuaugaauuaguauauauuuuuuaagugcacugagaauaaaaaauacccugcuucuauuuuaauccagguagccaaguagcucucuguauaucccuguccagucaccuaauuuuuuggagaugcuuccuuguauggauugagaaaauuguuauuuaucauuaauuaucuauauugccaaauaagggaggaaaggaauauagaugguauaguagaaagucuuaaauagaagagcauguuuuuuagaaaacuugacuuuaagccauagcuaugccacucacuggcuuacagcucuuaauauuguaaacuggaaauaauaaucccucuguuaccuauuucagaguuguaauaaaaaccaaauugaaauguauuuuauaaacuaccaaguaugauauaaaugaugguugcuaacuaauuuuuuauugucuuugaaguuuauguggcccaaaugauggacacacauaugugaagcaguuuccuuaaaaguauaaagcgcuagauauuagauauucucuaaguaauuugaagguaugaugaaauuuauagaaauuuuacagagaaauuuguagaaaucuuauagagacuuuuuuuuuuuuuuuuuuuuuugagacggagucucgcucugucacccaggcuggagagcaguggcgcgaucucagcucaccgcaaccucugccucccggguucaagugauucuccugccucagccucccaaguagcugggauuacaggcaugugccaccaugccuggcuaauuuauagagacuauuucaagucaaaaugagaucuguaccuauaguuuaacacagguguaacauaagcauuaguccaucuaguuauugaagauaggcaacacuaauccuagaagcacccuaaacuauuaauguuuaauaauauauuuucaguuguuuuguuuuaaauuuguuguauuagauuaucauuuuuucuucucaaaccaugauuguaaaauauuacaacauacuuuauuaguaagaaauagagacuuuauaacuauguucccaguucaaugcagcaaaagggauuauuuuugaagccauauauuauguaacuuagaaaacaaaucuaaauaugaaguaauuuauuuuucuuaaacauugaguuaugauuuguuuuuuacucuuuuuuuuuuuuuuuuuuuagacggagucucgcucuauugcccaggcuggagugcaauggugugaucuuggcucacugcaaccuccgucucccggguucaagcaauucucccggcucagccacucaacuaccuagaacuacaagcauacaccaccaugguuggcuaauuuuuuuuuguauauuuaguggagacaggguuucgucauguuggccaggcuggucuugaacuccugaccucaagugacccacccaccucggccucccaaagugcuggcuuuacaggugugagccacugcaccuggucauuuuucacauuuuugaaaaaguguuuaauuacauaccaguucuuugaaaucuagugcuuuauaacuuggguuucagcugggcgcgguggcucacgccuuuaauuccagcacuuugggaggccgaggcagguggaucaccugaggucaagaguuugagaccagccuggccaacauggugaaaccccaucucuacuaaaaauacaaaaaauuagccgggcaaggaggcgcuugccuguagucccagcuaugcgggaggcugaggcaggagaaucacuuguacccaggagguggagguugcaaugagccaagaucacgccacuguacucgagccugggcaacagagcgagacuccgucucaaaaaauaaauaaauaaauaccuuggguuucauuuauuaaacaauuaauuuuuuuaaaaauguuuuuacugcugcuaucugccagaugcuuguuuguaauauuggauagaauaagauggacaggcccuuucucaagaaacuuucauggugcuuaaauucuauugcuuugugugaucuucagucagcaucuuagcuuaaacaaauuauuuaucuauguaacuaugauuagccccagaauauaaguaaaaacuucuuggaguaaagcuuauuuuacuaauaauuaagcuagauuaggaaaagacaagauaggauuguuagggaguuaugauguucacuaaucuucuggcugggaaauauuucuucagagagaggaauuugcaagcuagaaacaugauuuccacaaugacugcuuguuggagaggaccuacugaaaagauuuaaucaagauuuugaaacucaggccaggugcagugacucacgccuguaaucccaccacuuugggaggccaaggcggguggaucacuugaggucaggaguccaagaccagccugagcaacauggugaaaccccgccucuacuaaaacaauagaaaauauuauccaggcgugguggcaugcgccuacuugggaggcugaggcgggagagucacuugaaccagggaggcagagguugcagugagcagagaucacaccacugcacuccagcaugggcaacagggugagauugucucaaaaaaaagauuuugaaacucagauuugaaauguuauuuggcguuuauauucuggagauagaaugauagcuugaacagaucauccucaagucucucagagguuaucuaaugauuaguguaugggugagaacaaguuaucagcaccuaaguguauuaagaaugcauuauaaacaacugacaauuuuauuuuguagggaauuauaguuugugugauuuagaaauacuuauuuucauauuuguagcaaaugucuagucaauuucagucugucucaaaaguguggccauuucagcuaaugggucccaccacauuuauauuagguuauaaguaaugcauugaacugcauuuagcaucccuaaaauguugagaaagcuauaacugggacucagucuggcauacucacauuacagccuuguccaccuuuuuaaccguacagucuggucacauuuuuuggguuaugaagucuuauguaugcaagaaagaacuaggauuuagugucgagaaaauuagauauauuuuuuauauuuaaugauuauuuucuauugcuaaauauuuuuauuuuuaauuucuaauucuuaacuacauaaaauauauuugacuuuaaaaagauuauggcuauaauaauaaagaaaaauaagcauauuucuuuuaaccuuucuuauuuuguuccuaacauauuagguugguguaaaaguaauuaugguuucagaccaugaauuuuaagucauuauaacuaggcucaaacacaucuuuaugaauaaaaauagaaaccauuacaaucaacacauuuuugccaaugauaauuaaguuuuuuuauuccuguaguauaaaaauccaugcuuuggaauucuacgaacucuuggaaagcguuuucugcauccugccuugccuguggaagcauuuucccugcaaaaaguuguugagaugcuugaggaaguggcagucaguuggugagaggucaggugaauaugauggaugaggcaaaacuuuguagcccaguucauucaacuuuugaagcauucauugugugacguguggucaggcguugucauggagaagaauugggcccuuucuguugaccaaugccggcuacagguguugcaguuuuuggugcaucucaucgauuugcugagcauaagucuuagauguaaugguuucaccaggauucaaaaagcugucauggaucagaauggcagcagaccaggaaacagugaccaugaccuuuuuuuuagugcaaguuuggcuuugggaagugcuuuggagcuucuuuucgguccaaccaccaggcuagucaucgcccacuuuucaucacacaaucugaucgagaaauuguucguuguuguguagaauaagggaagaugacacuucaaaacaacaauuuuuuaaauuuuugcucagcuuaugaggcaccuacuuauugagcuuuuggggguuuauuuauuuauuuuuuuguuuuguuuuugagauagagucucacucuguugcccaggcuggagugcaguggcucaaucugggcucauugcaaccucugccucccagguucaagcaauucuccugccucagccucccaaguaucugggacuacaggcguaugccaccaugccuggcuaauuuuuguaucuuuaguagagacaagguuacaccauauuggccaggguggucucgaacuccugaccucaggugauccacuugccucggccucccaaagugcugagauuacagguaugagccaccaugccuggccuuauugagcuuucuaauuugcuucaaaugccaaaugaccauagaauggucgacaaugaguucuucugcaacuucuuguguaguugcaagaggaucagcuucgaucauugcucucaauugguuuuugucagcuuccuauggccggccgcuauaccacucaucuucaaggcucucgucuccuuugcaaaacuuuuugaaccaccauugcacugcauguucguuagcaguuccugggccaaaugcguugauguugcaaguugucuccacugcuuuaugacccauuuugaacucgaauaagaaaauuacucacauuuguuuuuugucuaacaucauuuccauagucuaaaauaaacauaaacagcaaguaauaaguuauuagccagaaaacauaaagcgagaaaugcucauuaaaaugauguauaacauaaccacacuuauuuaagaacauauuccaauaucaaacggcaaauuucaacagugcaaaaaccacaauuacguuugcaccaaccuuaauauuuauuuuuauaucugugaauuaagaaugcauaaguaaaaauaauagcaacaaaacauuaaaauauuagugaucauguauuucauguaacuaguccaucaauauaggacaguuaaaagugguuuugcacuagcuuuaagaucuuuggcaaaugcuuugccuaaauuuucccaaaguuuuaaaaugaaauacuuuuuacugagaugugauugauauagcugcauuucuaaaauaacaggaaaaauauagcuuucagaacugugguuuguuuuauucagcccuuaauaaacugagaauuuaccuaaauagauuauggugauuuuguugaaccaauauuuaauaagcaucuguauccccagcccuggcaauacaaagaugaauaagcagaguuugcucauaaaucagucagaaguugcuguauguuuucuagcauauaauucauugucuucuccucaguuuuuaccuauuagcauuaaaucucugauuuccaggaacaaaguuucugaguugccuucaaauguauuuuaauuuugaaacuagaacaauaauacaucuagucaagaaguuauaagaugaugguugaauauaacaaaauauuuuggugcuagaacucagccuuacacuguuuuguauauauacaaauaaauuauguccacaaccugaacuugaagcaaauauuguguauuuuucagagauguauaccucaguggaaaagggaagccuguagcuuugaaugccuuugcuguuuuuguuugucugcauuuuagcuuuuauuuuguuuuguuuugacagagggugggccauuguucuuacuuuuuaguuuuuauaguggaguuuuugggagagggcauuacuaaaugcauguuacauuggugaaauaugaguggaaaauugucaacuggcacuauucaagaaugaaucucaaugugcaaucaauaaaaauauggucuguuuuauucagguuggugcucuuuuuguauugccauguaccauuaguaacauacugauuccaccucccaaccaacucaguucaagaaaauggaaggaauauauagcuaaaaagccuaaaacaaucagugguaaguauuacauguuucgguuguuuuaaugaugcagcauaguuaauguauguaucaaauuugaagugaagauaacauuucuauaugagaaaacaggauuucauauuauugcuacugauuaccaggaguccacaucauuuuaagauuuuuaauugcaaccuacuguaacauaaaguaucucuaaccauauucauuuaaaaugcuagugaucuaaaggcagaacucuugguucauuagauagcuaauuauacugaacauggguuuuuuagagacauuucaggaaucaaauuugugaaaagagcaguucauuuauuauaugguacauaaaaaaccugugauaauuuuuugaagaaauuaguagaaguuauuuauuuauuuauuuagagauagagucucgcuuugucacccaggcuagagugcgguggcacgaucuugguucacugcaaccuccaccuccuggguucaagugauucuccugcuucagccucccaaguauaugggauuacaggcacccaccaccaugccuggcuaauuuuuauauuuuuagucgagaugcgguuucaccauguuggccaggcuggucucgaacuccugaccucaagugauucaccugccuccgccucccagagugcuaggauuacaggcgugggccaccgcacuugaccuaaaguuuuuuauuuaacaguuuaacuguauguuacacaguauuccaaguauucuauuuuagaaauauugauucauuuaauuuuuguaauaaccccauauacuuauuuuuauccccauuuuacagaugaaggaauuggagcuuagagaagugacagagcuguuaauuggcagaaccuacggcucugucacuucuccaaggguuugaaucugugcucuugugcucuuuaccacuacacuguguuuccacucuguuccucuaguauguucaagaugucuuuauccaaaugaaaauuucuguuauaaaaucagagauuaaguccaaacccuaguauuucaugaggugauucuggcuuagaauguuaaaauugcuuucccaaagucacauuggugaaguguguuccaucauacuuuggccuugauguguguuuuuuaaauugaacaaaaauuguuuacuuuuuuuuuagcuuauaguuuuugugacccauaaugugaugggacuaagaacuguaauugaaacuauuaugaagaaaucuguagaaauacuccacagcgcccuugaauuuugaggaauacaguuuuaaaaucaguagcuuauacaguacagauuuucuauuuuucuguauaagaaacaggagagauacugaauucuauuuuagcagauguugaauuucaaauguagguaagauaucuauguggaaauuuaaauguagaguuugaaauuuagauacagaucucuagguaauagucagggcuggagaucuagauuuugaguuuuccagcaguuuuguuuaucuauugcguaauaagccaccccgaaacuuaguggcuugaaagagcaaacauuuuauuugcuuauaguuugcagucugagcugcccucagcagaguaguucuacugaucucacgagaagucauugauguggguguuuugaacuugcagaugauuuggaggcuggguucaguggagcuggcuggcuuucucucuccguuuagucuuagagccuuuuccuugccacauggucuucucagaugaucucuccugcaaguuagcuggaauuuuuccaugguggcucaggacaaacauauagaacuugaaacuaccaagacuuuuuaaggcuuaaucccaggacuagcccagucuuacuucuguuacauuccguuauuuagagcuaguuacaagaauagucuaaauucaagggggaaguaccuauccaaaggugugaauaauaggaagccaccaauguaaaaagucuaccauaggugccuguaaguuaggaauguagaauguuaguuaggaaugguugaaaacaacaauacauaaagaacauggcuagagaagagagccaaggauagggucuuuagaaauauagucaucccucaguauccacuggggauugguuccaggaccccuguggauaacaaaauuccuagaugcucaaaccccucauauaaaauggaguaggaguuguauauaacuucugcacauccuccuguauauuuuacaucaucucuagauuacuuauaaugccugauacaauguaaaugcuauguaaauacuuguuaugcuauauucuuuuuuuaaauuuguauucuucuugguuauuaauuuguuauuuuuaaauuuuuuuuggaauauuuucaauucgugguugguugaauccacagugugaaacccauggauguagaggcaaauuguaccugcauguaaggugaaaguggagaaaaguuaggaaaugauaugguaaauggucuuuggaagacccuagcaaguuaucguuaacaucagcauuaaaauaccauuuauacagagcguggugcaaagugugggaaauaaaggagcaucaaacuggguuuuuacacuuaaggaaguagauucauugucuuuuucgcugugaaauuuauacucaagugaggaauguaccuaggacaauaauuauaagucuguuuggccaacacugugaaggcaaaauggaagguacuuccagaguguaugaccuaacauagccuuaagagcucaagaaaaguuuccuauaggaggagacauuauuacuguaacuuacugcaccauacuaauacaugaauaagugcagcuuuuaacccuucucaucucacagggaacaaauauauauuugguaauuuuggcacuugcuaaaacaaaaucagaaauagauuuucugaguggcaauauagucaauuucgcuuauucuacauauagucaugggauaauacugauccauuucucagcuuuacauaugucuaaaauugauuagacauauguagacauaugcaaucaguuaaucauaauauuaacaucuccuuaauaaacuugaguguauucuggcaacccauucauuauuuauuuuuccucucauaacuuucuccaacuucaaacuaccauuauguuggaacuucugauuuuaagguaauuuacucuuaacuuaggcguggggguuuuuuuggccugauuuccauuguaauuuuaagaauauaucauguggcuugauuugauuuuuuaaaauuaucuccucuugaaaucugagcauuaauauugguaacuugugaauaauaauaagacacagaucacauaaucuuugaaaccagauuguugauuacugauuaggcuggaucauuaagggcugauuaagcugacacuuaacaguauuuaaaaaaaaaaucuuagaaguagaaauaaaaucaaacuggacaguugauuauucaguucuauucuacccauaauccucucuguaggauaaauucuuacccauugauggaacuuuuuuuuguaaaaauagagaagcugaguuuuaguuaauguaaaagcuucaauaacucacaccuggaaaacuuccuaucccuuccuagcaucacuaacaauacccuuucucacuaucagacucucagaucauucuccuacaccaugacucuguuucuccacaaucuacugaauuaugcccaacuguccucuauuguugccacauauauuccagaaucuucauucuaacuuuguacuguuuccuaaaaguauucccugauuuuauuccuuugugacuuuauuauucauucauucaucuagucaguuauaccuuuuauucauuuauuugaauauacagcagauauuguguaucaagcaugguacuguuaucuugggauuacugauccaugagauagacuugagucuuccucuaauggaauuuacacuguaccacagaaaauagauauucagaaguuauuauaacauuguauuuaguagucacugacuagaaaaaauccccaagacauaaugaaaaaagcaagguaugcaauaguuaugguauuaaugguaaaaacaaguuuguguguauuuagcauuuaaacauauuuguauaugcauuaaguaucugcuuuuucaacagauauuuuuaucgagcacuuacaauauauuaggcacuguuuuacaugcuggacaagcaguaaauagaacaaaauccuuucccuaauggagcuuacuuuaugguagaggucacagguuuaguuuuucccccagauagccauaugacuaguuccuaauuuuuucaggucuuuacuccaaaaucauuuuucucuuuuaggaccuuuuuugccagcccaucuaaaguuacaaacagacucuucuccugaccucuuauucaucuuccuagcuuuaucuuuuuaccuuaguacucaugcugucuauuauacuaaaugugugucuaccugaugcuuaacaguuacucaaaaauauuuguuaaauaaugagugaaguauauauuucuaguuaguaauaacuguucuccagacagauaaagaaagacuuugaauggacuccauccauguagugugaaccaaaauuugugcuccaauuuuuaucaguuuccuagguuucauccuuugaugaaauaaaaaauauguguauuaauuugaaccaucugauguuuuuuuauauaucaaaaauuguuacuuaucagcaauuucacauaguuugaacuuaaauggacaaacaaugcccaauuugaaguaugguuuaauuauaauaguaaaugaaugccuuuuaaaauugguauucaauaaaauacccagaaauuaugaugauacaggaaaaaugcaaaagcacuguacaaaaaaaugaaauuaagucaaccuuauuacauuucaaaagaaaaaugccuauauguaaaacuuuuauugagaagacagaugaauagugaaaaauggcuggcuugccguguuuacagagauauuuuaugaaauugucaaaaaauugaaugaucaucugcaaccuaaacaaaucauagauaaguaauaaaaaauuguaucucccauuauugaaagccuacuaugugccauaugcuguggauucauuaucuuuaauucucgaaacaauacugagaaguagguuuuuaaaaaaaccuuuauauuacaauugagaaaaauaagguaaucaaggaaaccaagaaccuuaucuaaugucacaggguggaauuagaauuucuaccuaauuuugaauguaucuaaaggccaugcaugauuucuuuugucacaucauguauacuuuuguugaaaauaauuuuuagaacuuggucuuuucggccuucgauaaacuuaaacaccccuucaugcuaaaacucucaauaagcuagguauugauggaacauaucucaaaauaauaagagcuauuuaugacaaacccguagccaauaucauacugaaugggcaaaaccuggaaggauucccuuugaaaacuggcacaagacaaagaugccgucucucaccacuccuauucaacauaguauuggaaguucuggccaagguaaucaggcaagagaaagaaauaaaggguauucagauaggaagagaggaagucaaauugucucuguuugcaggcaacaugauuguauauuuagaaaacuccaucgucucagcccaaaaucuccuuaagcugauaaacaacuucagcaaagucucaagauacaaaaucaaugugcaaaaauuacaaacauuccuauacaccaauaauagacaaagagccaaaucaugaaugaacuccaauucacaauugcuacaaagagaauaaaauaccuaggaauacaacuuacaagggcugugaaggaccuuuucaaggagaacuacaaagcacugcucaaggaaauaagagaggacacaaacaaauggaagacuauuucaugcucauagauagguagaaucaauaccgugaaaauggccuuacugcccaaaguaauuuauagauggaaugcuauccccaucaagcuaccacugacuuucuucacagaauuagaaaaacuacuuuaaauuucauauggaaccaaaaaagagcucauauagccaagacaauccuaagcaaaaagaacagagcuggaggcaucacgcuacaugacuucaaacuaugcuacaagacuacaguaaccaaaacagcauggugcugguaccaaaacaguuauauagaccaauggaacagaacagaagccucagaaauaacgccacacaucuacaaccaucugaacuuugacaaaccugacagaaacaaacaauggggaaaggauuccauauuuaauaaaugguguugggaaaacuggcuagccauaugcagaaagcugaaacuggaccccuuccuuacaccuuauacaaaaauuaacucaagauggauuaaagacuuacacauaagaccuaaaaccauaaaaacccuagaagaaaacuuaggcaguaccauucaggacauaggcaugggcaaagacuucaugaguaaaacacuaaaagcaauggcagcaaaagccaaaauugacuaauaggaucuaauuaaacuaaagagcuucuucacagcaaaagaaacuaucaucagagugaacaggcaacuuacagaaugggagaaaauuuuugcaaucuauccaucugacaaagggcuaauauccagaaucuacaaggaacuuaaacaaauuuacaagaaaaaagcaaacaaccccaucaaaaacugggcuaaggauaugaacagacacuucucagaaaaagacauuuaugcagccaauaaacauaugaaaaaaagcuuauccucacuggucauuagagaaaugcaaaucaaaaccacaaugagauaccaucccaugccaguuagaauggcgaucauuaaaaagucaggaaacaacagaugcuggagaggaucuggagaaauaggaacacuuauacacuguuggugggagugucaauuaguucaaccauuguggaagacaguguggcaauucuucaaugaucuagaaccagaaauaccauuugacccagccaucccauuacugggcauauacccaaaggauuauaaaucauucuacuauacagacacaugcacauauaugcuuauugcugcacuauucacaauagcaaagacuuggaaccaacucaaaugcccaucaaugauagacuggauaaagaaaauguggcacauauacaccauggaauacuacgcagccauaaaaaagaaugaguucauguccuuugcacggacauggaugaagcuggaaaccgucauucucaucaaacuaacacaagaacagaaaaucaaacaccacauguucucacucauaagugggaguugaacaaugagaacacauggacacagggaggggaacaucacauacuggggccugucaggguauggggggcuaggggagggauagcauuaggagaaauaccuaauguagaugguuugaugggugcagcaaagcaccauggcacauguaugccuauguaacaaaccugcacauucuguacauguaucccagaacuuaaaguauaauaaagaaaaaaaaaaacuuggucuuuucaauuuuaugucuugauauuuguggaaauaauuuauccucauguagcagaauaauaguaucugacaauuuuauaauucuagauguuugauaauuuuagaacucuaaacuccaauauugccuuauauuuuuaaaauuggaauucuuuugaaaagaaacauguuaaaggcacucuuggagaaaaucauaucugauuguuuuguugacuaacaauucuucuaauaaaaauauuuuuagagggacuagauaaugacugauaaaauguuuugaaaugaugaagcaugugccuuuuccacauucaaaucaccauggugaaaguauuucaaaauagugggcugacaucaacaguggauuggauaaagaaaaugugguacauauauaccaggaauacuaugcagccauagaaaaagaucguacacguaugcuacggaauacuaugcagccauaaaaaaugauccauaaacaccauggacuacuaugcagccauaaaaagaugguacauauacaccaugaaauacugugcagccauaagaaaugugguacauguacaccauggaauacuguggaaccauguccuuugcaacaccguggaugcaacuggaggccauuauccuaaacgaauuaucacagaaacagaaaaucaauaucacauuuucucacaaauggaggcuaaacccuggauauacacaaauauaaagaugggaacaguaggcacuggggacuccaaaggagagaaguuguguacuauguucacugucugggugaugggauuaauagaagcacaaaccucaacaucacacaauauacccucaugagaaaccugcauguguaccuccugaaucuacacucaaaguucaaauaaaaaauagugggcugaaacagauaagguuaaaauagcacaguacaagugaucuauaaauuucaucuugagaaauaaaggacugauaggauuuugaaagaaauuuuacugacagagacaaaguauucuuuuagucaacaaauauuuuucugugccugcugugugcaagguauuacuguggugcuaggaauacagugguaaaccuuucaaguaacuugacuaccaaccuuuauuguacacuuaacuuuauacucauucuuuucaagcacauaugaaacaugcuucaggacagacccguauacaugcuaguccacuaaaugaaucucaguaaauuuaaaaggauagaaauaauacacacgauauccuccaauuucaauggaauuaaguuagaaauugacaacagaaagaauccugagagaucucucaacuauuugggaauuaacacacuuccaaauaaccuauaggucaaagaaaaaaucaaaaaggaaauuacaaaauaguuuuaacugaaugaaaauaaaaacaaaacauaaaaugaauggaacacagcuaaagcaguacuaagaauaucugaaaugcuuaucuuagaauggaaggaagaucaagaaucaauaauuuaaccaucaaccucaguaagcaagaagaccuaaucuaaaugaguagaaggaaagaaauagaccagaaauuaaugaauaaaauauugaagaaugucuaccaaaagaaguaaaagaaguacacugaaaaccccaaaacauuacugagaguaacuaaagaagauauaaguaaauggagagauguaccauauuuagaguuuggaaaacucaguauuauuaagauagaacuccaaauugaacccaaugccuaucaaaauuccagcaggacuuucuauagaaauugacaaacugcaggaguucaagaccagccuggccaacauggcgaaaccccgucucuacaaaaaaaaaaaaacaaaaacaaaaauuagccaggcgugguggcaggcaccuguaaucccagcugcucuggagacugaggcaggagaaucguuugaaccugggaggcagagguugcagugagccgagaucacgccacugcacuccagccugggcgacagagcgagacuccgucucaaaaaaaaaagaaaagaaauugacaaacugauccuaaauuuauauggaguagcaaagcaacuagaauggccagaacaauuuugaaaaggaaaaacaacauuugagaacuuaugcuaccugaucucaugacuuauuauaaagccacaguuaucaagacauugugguauugggcuaagaauacauagauccauggaacagaauagagucagaugccaauggcgaaaggacaguuucaacacacugcuggaagaauuggauaugcauauguaaaaauuauguauauauauuuauauauguauuuagacuuuuacuuuaaaugaaaauuagcucaaaauggaucauauaacuuaauucaagagcuaaaauuauaaagcuuuuguaagauaacauagauaacaaaucuauaaauuagaaaaagaaaacaaauuuauaaaguagaauucaccaagguucaaaaugcuuacuuuuugauaaacacuauuaagaacauuuaaaaacaaucuacuuaaagaaaauaguuccagucguauaucugacaauggacagauaauauuugaaaaauucucccaauuuuauauauaauaaaacaacccaguuaauaagugagugaaaugcuugaauagacauuucaccaaagaagauacacgaauaacuaguaaacuccacgaaaagaugcccaacaucauuagucucuugggagaugcaaauuacaaccaaaaugugauucuacaacacacucacuagaauggcuguaauugaaaacagugacuaucaaauguugaugaggauguggagaaacuucacaucucacacauuguugcuggggauguucaauagcacagcuaguaaggaaaacaguuugacaguuaaacuugcacuuggcuguacaacccagcccuuucauuccuagauauuuacccaggagaaaugagaacguauguuuacacaaaggcuuauaugcagguguuuauaaaagcauuauuuguaauagccaacacuuggaaacuaugcaaauauuuaucaucuggugaagagaucauuuuuuuuugcauauaauggaauacugaggaaugagaaggcaugaaaaguuuggaguguaccugaaaaacauugugcuaaguuuauaaauaaagucagacaagguuagauuauuuauugucagaucauauauaugaaauuucuucaaaaggcagaaggagacagaaagcagaucaaugguugucugaggccauggguagaagggagauugacugcaaaggugugauggaaguuucucaaaacuggaucauagugauggaugcacaguuguuuacauuucccaaaauuuguuaaaguuagacuuuaauauauauguacauacguaaauacauauguaauuuuacaucauuaaagguuuuuguuuuuuauaaggaucacuuuuuguaagaaucauucggguccuucaaccuaaaugcagaguuuuguuuaucucucuaguuuaaugauucuuaacaccagcuacaaauuagaaucauuuugacaguuauuuaaagaaucacuuuuuuucuaagaaucauuuagguccuucaaucuaaaugcagaguuuuguuucucucucuaguucaaugauucuuaacaccagcugcaaauuagaaucaccuugacaguuauuuaaaaaugucaagcugagcuccaccugaaaauaauucaacccaaaucucugggguggacccagggugucagugguuuguuagagcauccuuggugguucaaauguauauccaagauugagaaccucugcccuagguggugcuuuccccaacacgaggugaaaucacugucacugaagaauccuuuagaugcuuugaggcagaaaaaaaauugagaaucacuacuuuaggccuuuaauuccuuaucuagaaaaugagaguacuacuacuuccuuauuguaucucaaacuuguuugaaucaaauugguaaugaagguacacacuuucuaaauucugcaguagcuuuuuguuauucgguccaaucuucuaugcuucugugucuguugaacaauaaagaaaucauugcuguucauaaugaguaagaucuggaaauaucuucugaauggcuucucuauucauuguagcuuucaaauuguguauuuuauuauauaguaauugagaggaaauguauauaguuuaugauccuaauauuacuuaauuguuuaaaauagucaugguggaauuuauaaauccuguguuuuuauaauuuucacaguagugaguuauacaccuauucaacaguacuauucuucuuuuuuuuuuucuuucuuucuuuuuuugagacggagucuugcuuuguugcccaggcuggaaugcaguagcgugaucucggcucacugcaaccuccaccuccuggguucaagcgauucuccugccucagccucccgaguagcuaagauuacaggcacaugccaccacgcccagcuaauuuuuuguauuuuuaguagagaugggguuucacuguguuagccaggauggucuugaucuccugaccucgugauccauccaccucagccucccaaagugcugggauuacaggaaugagccaccgcacccggacaguacuaucuuuuuuuuuuuuuuuaacuauuuuagauucuuuuuaaaauugagccacagucauuuucuugaacaauuucaguggcagccuaguuuuacccuaaauuguucaaagcuuagucugaugaauagggugggguaucaggcuaggaaauacauuuuugaagaugauuuaugaauauaaaguaauuagauuuauuuuuuuuuucuucugccuccccagcuggcacuaagggcuguuucaaaaguugagucuagaauuaaacagugaucucauuguugaaaagaguauagccuccuaagaugccuacauuggaaacuagauuuugcuuuauuauuucauuuuuggaaugauuauuaaaauaauugguuauauuauuuugccauuucuuuaugaacauauauaauaacuaucaguaagucggaauauucacuuacccagaauauccuguuucccccguaguccugggauauauuuuuuccuuccaucauguggaauauuauuuauccuuuagauuauuauaauuuuguuuacauauuagcuguuaaaaaugaguauuauaagguuuuaagaacaacuaagaaacuuauugacaaagaauauaacuugauuuuuguuauauaagaauuuuuuuugcuaauacuaauaaagacauaagacuuuauugugguuuauguguuaucuguaaacuuugaugcaacuaauagacacuugguaguuucugcuucucccauuuuaucuguauaguauauccaaaauauacguaugcuuuugguggagaggggcauacaagccaacaccuuaucaaauaauaauguaaguaaacauaacaguugaaaauagacagacuuuuuuuuaguaaucauuuucccuuauuacuuuaggaagagugaugaggcuggaauaacuacgcuaauuguaaaucuguuacucucuguggcauuuacauaaaaguuauuuaauaagucuucaauuaacaccugccaaaucuggagcaacauuuuuuaaaugacugcagagucauuauggcuaagagaguuguuuacaguaaauauuuuucuuuugaggaaaauaagauuguuguaauuacaagcuucagugauuaaaaugcaaauaaaggugaugagauuuaaaauaaauguggaaagaaugucauagauugaagauauauauauaaguugaaucagcaagcagcuaaaaugguaaaugaauuaaggucacuguaucuuuuggcaaaccuuaauuucuaauaaaacugguaacaacaaguguuuuucuuuucuaauaaccuuuauuuaaauucauguucuaaaacugcaguuuaugagcagaauuaaugucacucuagcuaucuaauuguaaaaauuguuuuuguuacuucaucauuguuuuugggaauagacuauaacccacgguaucuuccuaucuaugaaauaaacuguagcuauuguaauaaaauuacaguacuuucuuaguauuuugggauguauauauauauauguguguauauauuacauucuauauacuacauaaaagaaucuuuuauuugcugugugguugucuauaaagaacugaaguacugucaagaacuuucuuuuugugagcagaacuuuacauuccuaagauaauuuuuaaaaauacaguuuuauugagauauaaugcauaccauacauuuuacccuuuuaaaguuuacaauucaguggcuuuuaaaauauaaucacagaauugugcaacuaucaccacagucaaguuuagggcaucuuaaucuccccggaaagaaaccccauacguguuagcaaucauugcgcauuuccaccacccauuccuccucccuaccccuaagcaaucuauuuuggucuguauagauuugacuguucuggacaugucauggaaguguaaucauauaguaucuaguuuuuagugacuggcuucuuggacuuaguauaauguuuucaaaguucauccaugcuguacaugcuguagcauaugccaggacaucauccucuuuauugcugaauaauauuucaucacuuagauauaccacauuuuauuuauccacacaucaguugauggacauuugggauguugacacuuuuaggcuauuaugaauaaugcugcucugaauauaaagguacaggcuuaaaauuauuuucaguauaaaucuaggaguggaauugcugggcuucgucuuuuuuucagugucuuaagguagaagguuagcuuauugauugagaucuuuaauacuacuucagcuauauuugauaaauuuuauaucuuucauuuaucuuagaguauuuuuaaauuuccauugugauuucauauuugacccauugguuauuuguugguguguuguuuaauuuccacauauuuguuaauuccccaaauuucuuugaauuauuagugucuaaaaggacuaaugauuuuacuccuuuuaaguuuauuguacuuuuccacuccaguguuuccauuggguuuuuauuuuauaucuuuucaucuauguucucuauuugaugagacauugucaucauaccuuucauuucuucuuuaagcaugguuuccuuuaguucuuuaaacguauuuauaauguuugcuuugaagucuuuguuauauuuaacuucugggaccucucacaaguauuuucugucacuugcuuuuccccuucuguagguauuacacauuccuguuucuuuguaugucucauaauuucuugauaaagaugacaauuuagguaauauauuguagcuauugguuaauaauuuaucuccccccuuauuagguuuguuuucuuguuugcguauuuauuuguuguaugaguuggcuaggcaauuuuaaugaagucuguuugacuucggugucacucuucagagggugcggccuucaguguggccacauucacccugggaauccaguggucucaaccugacucacuuugccuuucccugauaccuucuuugucugccucauuugcuaucacauguagcuacuuuauaccucacuaauugccaucuucacuaauugcuuuauuguuuuugacaaugcacuggggcuuaaauuguuccacauccauuuaaauuugauucauuuuuguggccauucuucgauuugaauucugacaccaagaugacacuucuuagcugucucauucccagguucucucuaaugaacuagaucuuuugcuuguuucucuuaauuaagugaacuaccagccuccuuuuauuugcuuauuaccaagucuccauaguuuuugagaccaccuuuaggcuccaacuuacccgcaaucugagucagauaaagucaguuucuuuggguagugcuuagggccuucuguuuuaaggucucuuccccugggcaaaaucucugagccacuacuucgguagcugggccggcauguagcuucuggucuucuuuauauaccucucccaguguagaaacugcccugugaaugcgcugaggugaagacauuugggugccuauuuucucagcuuuccuauccugggguagaaccucugccuuaugaguaggggcuagguggagaaaggaagucccugaauucucaucauaugcgucaggaauuuagucuuuucaacucagaaugaggggaugagaaauugcugacagccugcuccuucccaugagaugcuguaacccuuuauuggaagccgagggaggagggagacccaucuuuuuggccacagccgcuuggauuggaguuucuguccaucuguguugggaauggguggggaaaagcaggcugcggcugaagugcuucggacucuuaaaaacuaagccacaaccugcuucuucccaacccauucucaacucaauggauagaagcuccaaucuguccaacgugcuucuucccaauccuaaucuuaguauauuuuccugaauaaauguuucuuaauuugguauauacccuuaggaucauuucaccgguugugcuuguauugcuggggaguggguccacagacuuucucacccugccauccucauagccccuaaaauaaacuuaagggaaauagagacauagauaacuuuuuaaagugguaagcauucacuuugauucccugauaaucaaucaacccuuaacucugccuuauauaucucaagccaaagacacuuuguuuuacccucuccagagaauaagccucuaaucuucugacagucauuugccugaauagaauaagggaucagaaggccuguuucucaaguugacuuucaaacucuguuccuauuccagcuucauuuugcuuccagugccaucuggggucaccauuccagagccucuugaggacgcguguauaaauuguguugcuuuggggcuuucucugcuguuuuucucagcuccuuagcaguggagagauugaaguuuguuaccaauuguucauaugcuuuucugcuuucaaauuuuaguugucguugucucuuccagauauuaguucuuguagauuuaugcuauuuuuaagauuucuuuauucucauuuaguggaauuucaggagauagugaauauaaauguuuauguccaacucaccaucuucaacaaagaaagauucuacuucuauuuuuaaucucaaaggcuucacaguuuuucuucaaccuucacuauaacccucacuugauuugcuuuuaaaauauacuagacgcugucuuaacugaccuucacauaacuggcaugccagauuaaugaaugcucuccauucccucuguaaaauacauuauggaugcccacugcaagaagcaaaaagggcaagaagcgaaaagcuucccagcucccaaguauagcuguauccuucugcucccaccaauuaaguugguguuuguaggaaucaguuuauuccucuuuaaagaaauggaagcuguaaacauuauugaugugguuauuuaagaaauauacuguagauaugguaagccauaucaaaaguuaaagaaugaguacacauacuuuuaauuuaaaauaaaagauuuaugcuuuguaauuguuaugauuuuuugcuuuaacagcuuucucaauuaaaugaacaacuacuagcccugaauguauuaacagcuuguuuuaaaauaacaaaaaauuuuauuauauccuauggaucaaauguaugguucuguuguguugugugcugaauuuucacauacuuaacaagauaauuguuuuuguuuaguuccagauguugaagugaaaggagaguguucuagcuauuaucucuuguuacaagguaauggcaauagaagauguaaagccacauugauucacucagccaaccagaucaauggcucauuugcacucaauuuaauucauggaaagaugaaaacaaagacagaagaagccaaauugaguaaguguuaacuucagguagaaaaacauguuuacauuguuugugugugugguuagcauauguggcuuuaaguagaagaaauacuaaacauuuaaugaauuuauuuucgccaaacuccauucucuuucauuaauuuaccuuuuauuuaaaacauauuaugacauauuuuuacaauuuaaugugcaaagagcaaauugcuuuuacauuauaccuaguaaaguuuaguagaucagccuucaauucuaaaaaugaaauuuuuaguauuuuccacuuuaaauacauauauuuugcuauauuucccauuuucauuuauaucgucugaagccacauguucuauuuuauugcccaucuuucccucuucuucccaggcuuuauuauuuagguuauugauugcugcaugacaaacuaccccaaauuuggcuuaaaaauaggaguuuauuauuaucucucgugguccuguggguugaaugagcucaguuggauguuucuauuuugagguccuccauaugauuacagucacauacaacuguggcuccagucauuugaagauuccacaggacuugaugucuaagauaguuucuucacacccauguuuggugccugggcuaggaugacuggaacagaugaggucugauuuucucuucacaggcgcuuuccucacagcuagcuugggcuuccuuacaauaucaugguguuagggcagacugacuucuuuuuuuuuuuuugagacagagucuuccucugucaccaggcuagagugcaguggugcaaucuucgcucacugcaaccucugccucccagguucgagcaauucuccugccucagccucccaaguagcugggacuacaggugugcaccaccaugcccagcuaauuuguguauuuuuaguagagacaggguuucaccauguuggacaggauggucucgaucucuugaccucgugaucugccugccucggccucccaaagugcugggauuacaggcgugauccacugcgcccggccuaggcugacuucuuauaugguugcugacuuagagcaauuguucugugaagcuacaaggcuuucuguuuccuagcuagaagucauucagugucacguuuacguuacauuauuuguuacauagugugaagcauguccaauaauuagcagucuuaagggaggacugccacagcguggagaauagggaagaucaucacuaugccagccaccaguaacgggaguccaaauacaucuuuauguugccccaugggcuacuauuuagguccaccauguacugguuaccaauuuguccuaguccggugugacagaacacacucacaugcaaguuauaugaagcagauuuauuacuuacagauaggcagcaaggaacaaaagaagccuaggaucuguugugagccaggcccccaaggcucacgaaagcuucccagggcagauggugucuugacugcauguacgccauuugcaccacagcuaagggaccccaaaaggcagccugaccuggcuucuauauuucaggggccaugugacucauugggcaacgcuuugaaggacauccugcuuuuaggggacagaggaaaaaaacccaagcuauccugggcaguuccucccuauuucaagauaguacauuuccagugcauucugcaguuauucugaguaaaaugggcaugaagaauggggagagagacacggcuaaggcuaucaugggaccauccagcacauuuaucuagguuggauucauuguggaggggacugcacaaaaaggaauaacaggagaugugguucauucaauggcuuuuggggguaucuuuacagacuagcuaccauucccuaucugugauuucugaucagguagaagaaaaugugauucagggaauucuacuuugcuaucuaaauucccucaauuuaaaaaucaggucaauguuuaaaaugcaaaauaauugaguaugcuuauuuucugcugcuuaauuauuauuauuauuuacuuugaaauauguaaggucgagagaggugagugauugacuuuuauuuuuuguuaaauccuugcuauaacacauuucccaggaacugaguacuaauuguuggcaaagggcaucauuaauguugaccuuuuuuuuuucuuauuucucagguuuuccuuuugacuuauuaucacuuccacauuuuucuggggagcagauuguacagagagagaaacaguuagcuaauguucaaguuuuagcuuuggaagaaugccuaaguaaguaacaauuuguguauuuuauccuacccuaaaaauguugacuuguuuggacauaagcuaccuuuauuugcacacuuuuucauauauaguuuaucuuuuaguuaugcuacuuaauuauagaacuauuuuugaaagcaaugauguagaguagaagagauauuuucacuagauucagaauauuucuguuuauuuguacaucacuguuaacauuuguaaaaguauuucaacaggcaaauuuuguauuucaaaauuuguuuuuaauuguaugcuagagaagguauguaaguuuuauuuuucuauguauaacucuugauaaaauaucuuuuuauauauuuuuguagcggaaguugggugcuacaaauaggaaaaaaugcaagucuuagggaaauuaauguguuaccuugagcauugauucuuagaguuuaauaaugaucaucaauaauaaguaagaacauuucauguacuaagugacauuggcauagauuuaucuuauucagaaaagagucauaauuucacauuuuuucucuuuuacaguuaauuuggcuaucagucuuauuuuuuaauacaaauuuuaagcauucauuuguugccuaauugaacuuauuuaugguuauguaauuucuaagaaauugauucaaauugugaguucuccuuaguuguauguagaaaaaaaguuauucgaauuauauauuacauauauuauaaaauaagaacuaucauucuuuucuuuaaaaacguauuuaaaaauugugaauucaguagccuaccuauucaauagaagauaauuuuagaauaguuggucucaauuauucauguaaagauugcaaacuuuuucaauuguaaaaauccaggguaauuguuuagucuugagcuccucuaaccauugguguguuguuuuuuuuaaccacgaaaaugauguuugcucaaggaagguguaauuagaaaggcaaaucauuuuuaauaaaguguaguacaugcuauaaccaacaaauacauaaauacauacacacacauauauacugaaauaccaguauuguuaugguuauaaaauguuuauuucagacaucagccagcuguauuauucauuuuuuaacuuugcucuauuccugccaaaaacccgucaggcccugauuuccuugccauaugccucuggcagcuuuuuauaacucaguuccuucaacaucuccauugauucaucuucaccucuguuccucaccuuuccaaacacaaaaacuaucagaagagcagggaccucucuaaagcuggugcaucucuucuuugugaaaggagaagacuuaaccccaaaagggccaucccuccugguugugugggaagggaaauaugacagcuauaacuagguugcugccuagaggugugagugaaaaguucaacagaguuggugagagggcaggagagaguacagaaaugcuaaaaauaaaaaaaauuaaaaaaauaaaaaaucgcagggaugccacuagacugggcaaagaguaaggugggaaccugaaacugaagacaaccuuagagcuaguugcugcuagagacacuggcucuggguauguccaugaaauggccaauuugcgaucagaagcauuaaaucuugauucagauaaaugauccaguuaaucuauuuaugaugaaaauacuuacugaacaaaucucuucucuacccagagaguuaauacuggauuaaaaacuuggagacaaagaugcaucuguuuagaaugccugugucucaaaaggcauuugcagaggcauuugcagaggcaaacgacagcaaaagaaaguuuccaauguaagcaugucuuaagugucuacuucagugauuugcaaauaagugaagugugaauauaaaaguacuuaaaguaaugcaguuaacuuauuuguacaugauaaaaaguaaagaauauaaugggaacagcucucuuuggaaaaaaaaauagugguucaauauccauacagagauuauaguguuuacagaaaaacaaaauuuguucaaaaagauuuccucaaauuaucaacaaaacaugggguaggcuuguuacucuuuuuccacuauuucucuaauacuaaauuagaaagaauagcuagaaaaauuugcacaaaaauuuacucaaaaauguacucacuaauaacacuauugaggcacuuuguuuuuuaaaauaacacgaaauaaaauuuguuagggcuuauuuuuuaaaauuaguuuauuuucauuaauuuuauuuugaaaauuacaucuaauacuauuuaauuagaaugauauuuaaaauuuguaagcuugugacuuauauuuuaccaaauuuguugguaauuuaugacuuuuuguauuuggaaauauuaaaaaucuuguuucacugauuuuucaagaaaaggcugaagaaugcugaacaauuuuuaaauaaaagacuguucaguaugaugcaagauaaguaugaaaacagcaguauuaucauuuugcuccaguauugcagucucuacucugagcucccuacaucuuuguuaaauuuauaaaacacagugcaaagcuuaugcuugaccugcugauuccuuuggauguucugcuucuacauuuuucuuuaauaaauccuuaguuauuacuagcuuucuuaggaaaauagcauucuuaugcuaacucauuuuuagacuuuaguccaauguuuuucucucaaauauuuaucugccacuuauaugcaaacucauuugugugaagacuauguuuuaccuagguaaauuauccugcucauaacuuguaaacuuuaucuguuuucugucuccauuucuuaaucauuaaggucaauauggauucuuacucucuucuucaaauuguaauauaauugacagguuuaauaaauauaggucagguucagguucagauuugaguguguguguguauguguguguggggguguauauauauaauuuuuuuuuuuuugagacagaauuuugcucugucacccaggcuggagugcaguggcaugaucuuggcccacugcaacuuccaccucccaaguucaagugauucuuguucuucagccucccaaguagcuagcauuacaggcauguaccaccacgccaggcuaauuuuuguauuuuuaguagagaugaaguuucuucauguuggccaggcuggucucgaacucuggaccucaggugauccacccgcuucggccucccaaagugcugggauuacaggagugagccaacacacccggccagauuugaguauauuuuuaacauuaauaaaaacauaggggcuaauuucugaagcagauuacugcguacaucuuccagauaaaaccaaaccaucgguaacuuuuugucuuagaauggcucccagcagauugugcacaaaaagacaaugaaccuuaugauuuucucacuaagaggauguaauagaggcagaauauauuacagcucucauuuuacuguuacuaauauucuugauuguggaaggaauguuaguuaucuugggucagauuuggaaggacccuaccaauguccacauuggugaugcaggauuuuacagaggcuuguaucaugaagcugauguucuaaaguagaaccucgacauugguugccuccuucuuauucuacucccuugcauuauuuaugugcugaccucagguaguguaauguaauaaugcuuuaauccucugugucuaaggacacaguacagugcuuuuuaggcaguaagcucuuaaaauuaauaaaugugcguuuuguugaauucucuaugaacuucuagguuaguauuuuauuguggaagaaaauguuacuagucuagaaguguuuuaaaauggacuauuuuuaucaaagugauacauggauauaguuugaaaaaucaagugauacugaaaaagcuucaaguggcaaacagcaaugcacuacccaugccuccccaucuuucagucccuguguuuauagacagcuauccucagcucuuccagguggaccccuauacaaauaauguacguaugcugcuauuucuugauuuacuaguuucaggcauuaucuuaacaucuaacuauggaagauaaaaacuucacuuucccacauaauccucacuuucucuuucugcuucuucaagugaagucaugaauuuugguuaaaucagugguuggcuuuaauauuauuauaauuuuauaaauaaguuuacuguugagccauguaauaaaugaugaugaucagaucucucuuauauaauucuuuguuucucuuaugguugauaaucaccuuauuuuaaauuugccuacucuucuguauagacagaacauuguuauguuuuuccagaggcuccaacauuucugcugcacuccuaucauuaacauucauuguguauucaaauacaucaguuccuuuuuauuucucuauuguuuucuuuccuggaguguuucauauuuugcucgacuauggacugauugcuuauaucuugcuaauaucuugaagauuucccuuuccucuuuucuucuuucagaauguucuuuuuccuagaccccuuauucuccuuuuucuuggauuaugccuuuguuugguuggugcacuucuuccagucacuuuuugaacaaaaguucauggagcauaaauuuuuugaguucuugcaugucugaaaauuuauuuacuucacuaauaaaauucuagguuaaaaaucauuuucccucggaauuucaaugauacuacuucauugucuucugcuuugcuauguuucuguugcgaagucaaauauaauuccuauucuuugugguaaucuaauuuugguuuguuugguuuuuacccacuuucuggaaacuuugucuccagaaucauugucucuagaagguuuacucugagucacacuguguuuaucuuucccaucuuccccaccagccccauuuauugaacuguguaguugauuggcaauuuaaaugggagagucauaucuugaaaucugaauuuuuuuuuaucuuuuuaauaauuuucuuccucccauucucucucucucuuucucucucuggagcucuggagcucuuacuagauauugacuuuucuggacagaaugccugauuuccauuccuaguuucauauuacuauguuuuuguucuaguuuuggggggauaucuuccauuuuauuuuacagcucuucuauggaauuuuugaaauuugauguuucgugugcuuaauuuuagagucauuuuuuguucauugauuuuuuuuucuuuaucaaagcauccuguacuuauuucaugggugcaguaucuucucauuugucuaugagaaaauuauagcaaacuuuguuuagcuuucuacaaugcuuuuguuucugcuggacucccuuuuuucuguuuguuugccuuagucucucuuuuggaugcuuuuuaguuugggauuccaaugaauaauacccacuucucccccccaacauuugaaccaacugaaaaauaaguguaagaaauauacagauggagagaaauuauagaugaaagcuguacuaaaggauauggcuuuuuagaucuauggccaaguuggccuucuuauacauacacccagcaucgaauuuugccacugaauggcugucagagcuaggcaacugcagaccaacccugcagcagaagucugcagagaaaauacauccugaagacuugcucacucagaugaaagucagaagaaucuaucagagcaugcuuuguucaugacuagcucagugagugaugggaaggaagaggggagcugaaaguguuaacugaaucaaaucuuugcacagggaaauaaagagcugccucucccccucaacaccuuuccuuaaaugucuggagauucuuuuguuuccauccuauuuugaaauggaaguuuuguaugcuuacuucuaaaguaauaucugucaagcuucacuauaguauggugaagugacaauucaacauuuuguucaugagcuucuaccccuaacuccaccccuugcuaucuagaguucuuuucucugacagcauucaguuuaaccaaaggagaauccucugauauuuccaguggggcauuuguggauguucacuuucugguaucaaagcuuggaguccaaccuuucaaugaauagauuuuuccuuaaucccuugguuuuaacaccagccucaauacuaucuuuucguauaccugauguuccauacaaaaaaaaaaaaagaaaaaaaaaugcaagcaguguugccuaucuaauaggaauagcuugcauaggggaaggaccugcaguucugacuucuugugcuauauccaguccuguuucaguccagcaucucaccaccagcucuuauacuccucgguagugccucucuacaggcauccaagguggcucuuccucugcuuugcagacuccguuaccacucggucauuuaugucuuccaaaauuuguugaaaaaugucauuauuuaucauuccuucuuuuguucucccuuuuuauuucuuugcugugauuuuagguuuugagaagaagaaacagaaguggccaagcuaccauauuuaacugaaagucuaacagguuuuauuucuacauaaccaugaacauaagaccauuuuaaugcucugcaauauauuucugaaggcuuuaguaaaccugccuuuaucuguuaucaacuuauaguaucaaugaauuacuucuguuuaucucacauaacuggaaauucucccauuaucuacaaauaggauuaaagugaaagaaggccuacaauccugaaaacaggaauguugauuuacuagagaaauucacuuguuuuacuucugaaaauauuuuccacaaaagacuaguagaugagcuccagagaauacaaaauaagucaauuguauugauuugucuuauagaaagacgaaaguuggcaaagcagccugaaacaguuucuguugcugaacucaaaagucuguuaguacucacaaggaaacacuuuuuagauuauuuugaugcugugauuccuaaaaugauucuaagaaagauggacaaaauuaaaaccuucaauauauuaaaugguaaguuuuuuauuacuuuaaauuuuaguucguguguguguggcaacuaugacauuuauuauuaaaacuuauaaaauguauuggucaaaucaaaauguauuucacaaauuuaaauaauaauagauacuuauauagauacaaguauguauguauaugugaugaacuguauuacucauuauuuaaacauuauaaauuuucuaguaacuuuuuucauuaaguauguucaguguaauuguuuuugggcagaggaagaagcacuuuaagaugaugccucucuuuagucuuacuaagcugcugaaaugugugaauuucuauuaagcuacauuuccauaaaguguggaaagcaaaaucuacauaguaaauuuaauagagguaaaaguccauaugauaagaugaugcauauuuaacauucaauaggggaggaacagucagacuucacugagacagcuggaaaucauuucguuauuuaguuguauuucuuuccgcuuuccugaguuccaguguugugaugaauuugaauaaccuuguuuaaggacacaggcuguggagcuaaauggucaggguucaaaucucacuuuuguuacuugcuaaccaaaugucuuuaggcaaguuauucaacucuuugccuguuucgucauguuuaaaaugggaauaauaauauaacccacuuacuaggauuauugugaggauuaguagguuauugugaggauugaaugaguugauaccuguaaaacacuuagaacacaaguaccaaaaaagauguuauuuguuuuaucauuaucaucaccaucgcauaucaguacccaaguuaaauagcauacagaguuaucugaaaggugcuggagacauuuuuagauuacuuguaaauggggcauguguucaauaagugagagaccauagcuccaugguuauagcauggacucuggagcaagacuagcagcuuacuugcugugugaccuugggcauguuuucugaucuuugugccucugcuucuuuaucuuuaaauuagggaugacauagguaguuaugaagauuaaauuaauuauuccuaaauugcuuaggcaguugccuaguauaaaguaagugcugguuaaauaaauaugaauuuugaggagagaacuacaaguaggguagaauagucaugaaggcugauuaggagccaaggaaguugauguaggucuugaaugaugcauaagaucuggauagagggaagauaagauuugccagguagaagcaccauauucagggucauggagguaagaaaaggcaaacugagaucaagagagagauuggcuuaccagaggauguguaugggagauaaggguugaaagauaggaagggcucaaauaauugcuagggcuuuuauauaaguuuaaggguauguaucuuaggguuaccuguacaaaggauacuugacacacugagcugcaggagagcucaucuuaaaaucaaaaagguuugagcaaaggaugaacacaaucuacagucagauuaugucacuccuuugcccagaccuucuugauugcuucuaauugcacauagaaugcaucauccuucauaugguuuguaaaaaccuuaaaugguaucuggcuucauacuuauucuaguaccaguacauuucuguuuccuuuuuaccacaggaaguccuuucuuuccuuggacauguuacauuucuuucuuucugcaguguccuuugccuggaauucuuuucuuccagccuuuagcugauuaacugacgaucguucuucagaucuugauuuaaauguaacuuucucaaagaggcuuucccagaccuuccccaguuucaguuguuuuauguuauacuuucucccuguaauuuuuuuuucaaauuauuggaucacauuuuaagauugcauuuauugaauaaaugaaagaaacuuggaagauuuuuagaaacugaacugaaauuagacaggcuaugcauuugaacaugacuccuaagaaugaaguugugauuuuuaacaucuuuuguugcuuugauuugaagaaauacaucuacuuguaaauuacauaaugaaagaaacacuaaggccaauuagauaucauauucugacgacucauuugcaagcaugcauauuaggaguuauuaauaauuaauaaaguuauuuaaucugcuuauuuuuugguaaaaacucuagcauguauaacaagugacaagacaguauguagaaaauggcuaauauaacgauuuauuuacacauugucacaaaguugcuaaagacuuugacaaagucaaaugugauaucugaacucauaauacaauaacuacaauaacugucuccuuugcaugggcccauuggacacaucaacacacugcauaaguaaguuuuccagguaauucuaucagaucguuauuuuauuacuucaaacacuuaaaaaggaucuucuggcauuuauuuauaauucuugcuuuauuaauuugcaauauaacauuuucuuugugauuuauucauauuuaaguauguaagguuauaauggccucaauucauuaaccacauaaugucaucucuuuuuguuugcugugauuugugauuuuauaggucaguuuucccuauuucccuguuguguugguucuauuguucuauuucuguguuuccuguaaaaugauuuuuuuuuuaaagcaguguucuugguuucucagagagccuuugugcuuuuuggcugucagcauagcccagcguuuugacugccacauaaaugaaauguguuuuauuuuauuguaagaauuguauuaaaugauuccacaaaagacaugagacauaugaauguuuucccaccuauuucuuaauauuuagccuauguaauuuauuuuuuagguuguauauuauauuguaauauuuaggaacaauuuaauguuuacuguuauuuaagauugcuuauauucuuuuaugaacucauggcaugaagcugugcagaaaugcaagugauuuuuuucuuuaugcuuuuaguggaaagccgcaugaacauucagcagcauguuauuuuauuauaaagcucauuacuuuuuaaaauagcauuucaccaccuuuacuaaaaaaugugaaguguuguauuuggaugguuagauagggcaguucaauauagguauugaaaauauuuuaaacuauucaagguuaaauaguuuaauaaguaaaaggaaaauaagaugcaguuugcauuaauuuucauuuauguuucuuguuuaaaaauuccuuuaacaggccaggcgugguggcucacgccuauaaucccagcacuuugggaggccaagguggauggaucacuugaggccagauguucgagaccaaccuggccaacauggugaacccuuuucucuacuaaaaauacaaaaauaggccaggcgcgguggcucacaccuguaaucccagcacuuugggaggccgagguggguggaucacgaggucaggagaucgagaccauccuggccaacauggugaaaccccgucccuacugaaaauacaaaaaauuagccgggcgugguggugcgugccuguagucccagcuacucuggaggcugaggcaggagaauggcgugaaccugggaggcggagcuugcagugagccgagauugcgccacugcacuccagccugggugacagagugaaacuccaucucaaaaaaaaaaaaaaaaaaaaaauuagccgggcgugguggcgggcaccuguagucccagcuacucgggaggcugagccaggagaauggcgugaaccugggaggcggagcuugcagugagcggagauugggccagugcacuccagccugggcgacagcgagacuccgucucaaaaacauaaauaaauaaaaauaaaauaaaaauacaaaaauaagcugggcauaguggcauguaccuguaaucccagcuacuugggagccugaggcaggagaauugcuugaacccaggaggcagagguugcagugagcugagaucacaccacugcacuccagccugggcgacagagugagacucuugucucuggaaaaagaaaaaaaaaaaaaaauuccuuuaccaaaucauuacuuucucaguccucucaaaaauauaaaaugaauauuuuuguuaauguugauaguuaaucaaauagcuaauguuaauaauuuucaaugaguuuauuagaacaauguucaaaacaauucuaaaaccagauaguuuugcaauccaaaaaguagcacaguuaguaauuuugccaguguuaaaacaguuugaauauauuaauacuauuuauaauaauuucuaauaagaacagaaacugucccuuuagguuuucauugaaaaucccaauauuaacagcaaucucaauauaguucacugcaguguauuaucuagaaagauaagcacacucuuacacauaauauuugauuaguagaaaauaacacugcauguuagugauuugaagguguguauguuuaaccaucuugguuucugcgagagaacaucagaacaucauaacuuaucuauuauuauuguaguuuugagaauaagguaaucucuuuuuaaacaauguaauuuuuuggucuauuugugcuaauuccuauuucuaguaugaaaaucacacagaauauccaauauauucucuacagaguuaucuucuuuucauuuagaacuguuuucacccaaaauagcaaaguuaugcuuuuauuccauaggaguccuaaauagugcuaauucaauuuugugaauuuuagcuuaugacauuuauuaugaagugauauuuuauuuuuauuugcaacaaacauuucuauggccuuuuguacaguuuaggccaucagagaggucuuuaauaaaugccuaagguaaguaugccuuuauagacacacauacacacacacguauguaugugucuguaaauacacauuuuuauuagcaaaauucaguaugauaauacuuuucagacuuauguguauuucuuucacuuuagauuuuaguccaguggaaccuaauuccucaagucuaauggaaaccaauccucuggaauggccagaaaggcauguucuucaaaauuuggaaacuuuugaaaaaacuaaacaaaaaaugagguaauauuugaaucuguaguaaagcaugugauagcucaguaauuugaaugaauuuuuuaaaauaguuaaauuauguuuaugagauuuaagcaguuuauuguuuuauuauaaaagaaauacauacuuacugugaauagauaguuaaucacuagaguaguauaucaauuaaaagggaagggcucaucuugcucugcccugcacuuguacuuucuaggucugugucaucacagugaacauuuugguauauagccuuucagaccaucuuccauagacauacacaguauaugaagauauaagaaaaucuuacuacaagaacauguaaaacaaaguagaaguacuugccucauuugaaccacuuugaucuuuuccuguuuuacauucauauauguuuauacagugccuaugaaugaacuguaugaggcaggauuuuuuguuuuauuuuguuuuuguuauuuugguucaguacauaguaggcccuuaguacauaauuguuaaaugaugaaauaaaagaggagaagcuaagcucucuuacauuacuuuucuccgaaauauuacaaaucacauuuuuauuuuuagcuucuccauggguaguauuuuauuacuugcuauagcuuuguuucauacacaugaaacaggcauuuauugaguaccaaccaugugucaggcgcugggaauaugaggaauaacaagcugugcacugccccucucaucuagagcuuagcuuuuaaugacagcagcaaucaaaacaaguaaccagacaaguaaauguaauaguuguaaauuauucuguguguaaugaaugaaauaaaaagacugggggagaaaaauuuuauuuguuguggggagggaagugguaguacucacuuagaugagguggauggucagggagaccucuuagaggacguuacauuugagcugagaccuaacggauaaaugggugaaguacauucagucacacaggaccaaauagguccucauacacaguucagauuucauuuuaagugcauuggugggaggauuucauaugaaagagugaugggauaugauuuugcaaaaauuuugcuuucuuacggcaaauaaauugcaggagggagagauuagagcagagagacagauggcucuaucuguaggcuaagugagagaugacuguaauuucaaacuagagcaguaguaguggaaauaaauuugggagauaacguuagugguaagcuggugaaaagcuuccuaugaugcauuagauguggaauagagggaaaggaaauguugaagaucauuuagauuucuggcuucagucgagugagugguguucuucugggguagauggguggaaacuuagggugaggacagcuuuggggagaaaaagucaagaauucuucuuuagggaugauacguuugaucuauccaaguggaaauaacaaguggacuguggggauaucuggaacucacucaauuuggaguuaucaucaguagggauuuccaaauacaugaugguugaugaguuacauggugagacuaugaggcaaaaagaaauggaggcuaagaccacuccuuaagaaucccugguguuuauagguuaggcaggagaagacaagaaagaagagugagaaaaggacagguuccccaugagagaaccucaauuucuugccuaccaauuuuagaugauaucuuauaacuucccacugggaaagaugaguaauuaacacccuuauuuuucuucccuuuuuaucuucuaucucuaaaccuuaugcuauuugcaguauacaagucuuaauuuuauuuuucuucucucugaguuccuacucuaacuuggcugacucuaccugcauauuuguuauccugguauuucuuuugauuacauuuuagauuaguucuguauuuucuuggauuucauauauuaaagagaagucugaugccacaucgauuuuuguuccucaauaaguauuuuauuuugucucuaaaacuuuuacaauuuucuauuuucuuuaauguucugaaauuacaagaggccaugguaugagauguuuuagauucaagucuuuugucuuuuuguggcucugagaaauaucuuauuauuucuucaauacuauucuucccuucauuuucuuuuuuucuuucucucugaaauaccuauuuuaauuaauauuaaacauucuggauugauguuuuuuaauuugauuuuuuucuuaauauucuaucucuaacuuuucugcucuauguucuggggaauuuccuuuaccuuugguuucaucuuuucuguuaaaauuuuugguagucauauuuuaaauuucuaauaguuugcucuuguucuucugcuguauuuuuucuagcaaccuauucuuuuauuaauaagacuugagaugauacuguaaggauauuaauuagaauuuucuuuaaauuuguuuuaucuguuucuugaauuaucucauuuccauuugcagcuguuuuauuuguucuucugguguuuuucucuuauguguaauuuuucuccagugucugguuguccuugauugucucuucauaacuaggaauauagggcccuguugcuuucuauagguaguuggcauguauuuucuuuccauagguuuaguccuguuccccacgucucucacuuauauuaauguuaggagaagggagagccgggguagagaauguuugucaggcuucacuuuagggcauacuuuaggguaucagcaggcaggaagcauuggugcuucacccagcacuaaauuacaggggcuuuauucugggccaucaccacugacacugagacaggcacuguaucuuuacaaauuaaaaucauuguauagcucccacccugcuggaguaugaaguccggagagaauuugaguguuuuguugacuguuuuuauuagauuaauauuuucaguuuaaaaacaaaggaauaggaagaggaaagaggcacugucaguauuuuauugacccuuaauauacagaaauauguuuaaaacuguaaugucaacauuuuaaucauguaauuaucaguaauuaugcuuaauuugaguaauaaucaggaaauaguugaguuaauaugaaguuaggaaauuaauuuucugugcagacauugaaauauuuuauuuaugcuaugguaacagagcuaaggugaucugauucagugcauagugaaaccucuaacugaaaccucuaacuggaaacaucuaacugaaacuacagugcuuuucacuugccgguauuuaaaacuuucugugaguuuuuuuucauuuauagggucauagaguagaaauaauaacuaauuuggaguuagucugguucuaucauuuuaaauagcuguaucacccugcgucuguaauguaaccuuuuguauguuagcaucuuuacuugacaagucggaauaaugauugcuuuuuaagcuuggcaugccgauuuucacuuuacaaaguacuuauuuuuaguuauuauuucauuuugagauaagaccuauuccaucuuuuucaaggaaacuugugaggauuaagaauauauuauauguaaaguaguuugaaaaauauaaaguccugcauguauuucagguauauaauaaugauucagugcuuauucauaaugucaucaucauggcuacaagagacuuuggggagauuucugauuauugucucauuucacgguugugcuucaaguaaucuuuccaguucauggaaaauuggaacauucagucacuucccucaaaaauuuauaguauugugggguuucagaacauacaagagaauuuagauuuaaguuuuauagaauugguaacuucacaccacugaauaauaggccaucauuaauagauaauguaauuauguuucuuuuaaguaguuaaaauacuacuucuugacaugauaacugcaaguuuuauugugaccuaaagauuuuuuaaaacauaguuagaaacuaaguuauuugcaaauauuuuacuuuauugucuguccuaaauguuuaauucucccauguugcugguguguuuuucugguuucugcucacaucuucuuuucccgacugugcuuuuuuuuuuuuuugacucuggcuucucucuggauugaauccacuuuuaauaaaucugcauaacauuauuuucccagaacugguucauuaccucauucaucugaacaguugcugggccacaaagaggguccucgggacucaaucacauuguuggaugcuaaagaauugcugaaguacuuuaccucagauggauuacccauuggagaucuucaaccuuuaccgauucaaaagggguagguuauaaacuuauaauuuccaguuaacuuuuuaaaaauuacuuuuaaauaaaauugugucucauuuccuuauuaauugauguccuaugcuacucagggaaaauuuauaaguuugaucccaauguuugucuguuggccuuaaucuucacuuuuuaccuuaucaaaauauccuacuguuuugugguauugaauauaagagaaacaggaauaagaaaagcaaacucaccauauucccuguagaagucaguaacuucuauuugguaugcaaaggacaaugcuuucuaaaaaaaauaggaauuugacuuacaaaauuuuuuuuuuaguucucuuuucuguguuacuguaguguugauauugccacuacucagcaugagcauugucaggcaugccuaauaguagcaaaaagcauggccuuucaccugaagaacaggaaaauguaauaaaaaugcuuuggaaacuaugacauugccaaguaagaauucagugucuacgugaauaaauuacaacuaauuugacuuccaagacaguuuucacuaaguuacuaguuaauaaaugcugcauguugcugacuuugacaaaauugacuguaaaauugugacaucaaauaccugugagaauugaauaauuuacuaauuacucuaaugucuuuuuaauuguuaauucauuacuuugaaaaccuuccaaaagaccuuaaaaauuguagaucacuuugaucacuuuuauaagcuuaaucggaauuauacuguauaaauauugccuuuaaaggugaauuuugcaaaggaguuauuugaaggcaguuauaucucagaaauauugcuggaacauuauugcuuuaugugcauguucacuagagagagauaaagagcaacugaaaauuugagagucuuaaugacuuaaugauuuuaaugacauaaaaauuauauaauuuuggaguaauuuuuuucccauaacuuugaaagauugauaaccuuuuguugugggaaucaagaaaguaaagaaauauacauguuuucaucuauuuaguuauuggauuacuguccuuucaaaucauuaagcacaaacuggcagagucaguugguuugccuaaacugaauuauuuauguaaguuguacucuuuuuacagaaugucuuucuagaugcauuguaggggagauaaaguuaguucuuucuggaaacuaauuguaggugauuuauuuaggaaaauuugaugugauucuucaauguuaguaaagaacugcauggcuaucaaauguaucuucuguuaacauuagaguugaaggaugaguuuucaugguaauaaaucaggaaccuauaugcucuuauuaaauguuuaccugcacaagaagccauccaaaauacuguguuaaacaaaguacaaacaugacuccuauguauauaccaaggaaauaauaaacauugacaaaacacauauuuaucaacauguuuauuuuagaaagaaaaacuugugagugaaauuaaacaaaaauagguaagguugcugagggcgauugauaugagaaaugagagacaauaugguaaaggaaagaaguaaaaugcuagauaaagauuuccauuuuacaaaauuauuuuaauaaucaucgaaauacuggggucauuguaauuuacuaauguuacuuuuuguggaauaauuuaaauggaugcauuugaauauaaugucugcuuuuuaggauucauuaauuggcaugaauuuuacauuuuaauguaauaauuucgaaugcuuaucauaguacccuagauaauuuucaguggcaggacaguuuucauuaccaaugccauaggggggaaaaugugauagcaaauuuauucuuaguacucuacuauuuacuuacccuucuacauaccauuuccaacucuucugaacucaagccccugguauuucauuuuaccuaguaacuauuuaaagaccacuguugcauaauuuccccauuuccugaacuucugagcuucaggaccaugauccauuacauuacaacagugguuuccagcucagagaaggacggcaccuaucggaauaauccagagagcuuaaucuaauugcagugacccucuucuuucccagauuuugauauaucgcuguaguucuagguguggaaaggcuugaacaugaauauuuuauguaaacucgacauaugauuaguucuaacaugccaguugauugaaaaccuacuucagaaaaagaacugaacucagcaguuagucucuauacccucugauauuuaaaaaguugcugacucuuaaaguaggugccagugacuacauucucaagcaaagaaagaucugggucccacguguuuuaguaggaaguaaauacuuuuauuguuaccaaagauucaaguugacuuuaauuauuccccugcagaaaaggauuuaacuaaaugccuaaacauuaguuuacucuaccaaggaaaaucuuccagaaauaaggcugccucuuggcuggacgcaguggcucaugccaguaauccuaacacuuugggaggcugaggccggcggaucacuugaggucaggaguuugagaccagccuggccaacauggugaaacccugucucuacuaaaaauacaaaaauuaguuggacaugggagcgggugccuguaauucuagcuacucgggaagcugaggcaggagaaucgcuugaaccugggaggcagaaguugcagugagcugagauuacaccacuacaccccagccuggacgacagagugagacuccguccccaccgcccccccaaaaaaagaaagaaauaauacugccucuugaauuuccauuauaaaucauauugcauuuuuguuuuacccauuucucagaauaguuuugugcaauaaauaacaucauaacuuauugagguacagaaaauuuaaguaaugaaagccaaggccuaaccuugcuucauuuccuuauuauacuuucuggugugccuuaaccuuugucccauauaaaauuccaauuguagaggaaaaagucagauuuguuucauuagauacuuucuuuaacuuucuuuuugucaguaaauaaacuuugaauacaaaugaaaaauuuuuuguuucagggaaaagacuuuuguuuugacaccagaacuuaguccugggaaacuucaggucuuaccuuuugagaaagccucaguaugucauuaucauggaauugaguaaguuuuuauuuguacuuuacucuucuguauguuguugauacagccugucuugugugaagagugacuuuaauaaaaugauauaaauugagacagagaccaagaggauaugucaaaaaccucaaaaagcaaaguagugcauacaaaaauaauuugucuucuguugaagaaguuauuugaugauuaaucagcuuaauagcauuuaagcauccuauuauuaguuacuauauauuuuaaucaaaauuguuuuggucccuauguuauaaauguauauucacacuaugggucacauuaauauuuccuggucaccaauuacauuguaguugcucagaaauuguuagauagggcccagcauuucaauacuagauauuuuuccaagaggaagacuuauacaaguaugcacauaauaguuuaauucucaauauccucaaacuggaaagagccuaggaggauaucaauaggaaaauagauaaacuaugguauauuuauauaaagcaauacuauucaacuauaacaaggaaugaaauaucgauacauccagcaacauuaaauaucugucugugugaaaaauacuugaaauaaggauuugaggccagacacgguggcuaacgccuguaaucccaacacuuugagaagcugaggcagguggaucgcuugagcccaggaguuugagaccagccugggcaacauggugaaacccugucucuacaaaaaaaauauaaaaauuagcugggcauagugguguaugugugugccuguaguccuagcuacucaggaugcugaggcaggaggaucgauugauauugggagauugaggcugcagugagccaugaacaugccacugcacuccugcugggugacagaaugagacccugucucaagaaaaaaaaaaaaaaaaagaauuugaagacuuugaaauuagcaguaugaaguauaacauucaauagugauuuauuucuaaaagaaauccuguaugaaaugcuaauuugaaucuaaaugguaagauaagauuuuuaaauuguuuugugaacaacagaucggcaacucggagauagcuacuaaauuauaaaaagauaagauaugccacccgauccauguuuuuaguucugcuauuugacuaaaggauuccuuguuugagaggauuauuauucucccuuuaacaugaaaaagguagggauguuucccaaauagccuuaaauuuagcugaagcuuuuacuuaaacuauauuuuuagccauauacccuucuguggauugauuacaaaauuuuacuucucuuuuuucuuuucuagacagucucacuuuuucacccaggcugagugcaguggcacaaucuuggcucacugcaaccuccguuucccggguucaagugauucucaugccucagccucccagguaacugggauuacaggcaugcaccaccacgccuggcuaauuuuuauauuuuuaguagagacaggguuuagccauguuggccaggcggucuugaacuccuaaccucaggugauccaccugccucagccucaaaaaguucugggauuacaggcaugagccaccgcacccaccccaaaauuuuacuuuucauuuauacuaaguucauuaaauuuaagugggaacaucuuguucuacuauauaaacauuugauuaauaggauauauuuuucuguuuucccccuucugauuuuauuaaagacuuagaaauuaaacauuauagaaaaguuuauaaugaaaaccaacaauuccuuuccuuauuacuaccuaacugcaucccaguuuuuagaaaaaaacaauauauauauuauuuguuugguuuaguuucccuggugguuaucucucauuuuaaaaaauacccuuaugucaauauuuuuaacugucacaauauaaaauauugacucugcuaugaagauuugguucuucuucucaaguugagcucuccgcuauuuacuuucauguuuuuaaauauauacacauuuaaacuucuccuucuuauuccaucagcuauaaagcaguaucucccccacuuuguuugauaagaauuuuaggaccuguuaaucuguuaaucuguuaaaggaaacuaauuaaaaauuuuagguauuuuguauuuaauuugaaugugaaaguugaaaccagucaacaguguuuauauuauuauuaugaaaaguagcguucacuguugagaaaaugugcuaguauuaacauuugcuuugcuacauggccagaauaccccaggacacaucuguuuuucucuucuucagcccuauaaacacacugaagcacugauuugaauaaaauaagcuacaauaauuacauuuuaacugcugacuaaaguguccaucauauaaucuuauuuagauuauuucucccaaaauuuuaauuuaguuuuguuuauucugugucuccaucucgcuacucuuuuuuuucugcuguuuuuaauuuacuauagaagaaaucuugauauauacaaauuuauaaaauuugucaaggauauguucuucaugaucauuuaucaaaauauuaaauuaagauuuauuugaguacuguguccugaagggcuuaaaucuacacagagcuuuauuaacuuauacacauacaauguuaugaaauucugauucacuguaaaaaguauuucucuucuccacuaccuaccuacucccauaaacaaauaaacaaaucuaucugugacucacuuuuuuuuacuguaaauuuaugcucauuaaacuggggacauugagacuaggcugacaaaguuguaggaggugagcaccaugaauucagaaacauguuuuuuucaagaagauuuggguguauaguaugagaaccgauuuauguucaacauagauuaugguguagaaacaaagucaaguaacauuuuaaaguaaauaugaaacuacaaagaaaguucucuuacguuauugugggccuuuagaacccuggagcucuuucucugauacaaaggaauauuuggaaagaauguguuaauggcaugggagcaaaacaauguuuuuuaaggcaaguuaaaauauuaaccacuguuggcuuguuuguuuuuucacuuauuuacccuauccuggaauuuaagaugccauuaauuguaaaauacacuguuuuauuaaacagcuaauuaaacucugcugucauacucugacaaucauuugaucacaccaggcucucauugcuuugaaacuuccuucaucuauuccaagagauuuggcaguuccuucugccuuaauugguauugguugguuugugauaggcaguauuuuguguauuucuuaguuacaaaacaaaaacagcuucauugucuuauggguguuuuucuuuguuaggacccauaaagcauuugcuuauuguuuuguaagaaaauauggaauuguggucauucauccaacaauaaauuuuuacuucacuaauaucaaauauacacccugccccuugccucucuguuucuuuucucuaauuuacaaaguaaauuuuuguuccgauggcaaaucauaguauaaucauuuuaaagauauuuuaaauggcaauuaacaucaacauguacagugugcauaauucaguugaagcuaugacacuaugaacagcugugaucaagagauguuaaaaccggaagaaaaaaaucugcaucuuagaaauaaaaucuuaagguagaaagaaauauucaucuuagaaucaaaauaugcaucuuuucucucaaaaauuuucuguauucaagcucaucaggcauuauauugccucuugccagacucuugaaauucacauuuccaauuuuacucuagauucuaccaauuacccaugauagaagucggacucaucaguaacccuuaggguugcuucugguuuuuaaugaaauauguuucuuaagcaacagacuagagaaagaauauuagcuagagagaugccaagaccuagguucuacucccuacucugccaccaacucacauucagauuuagagaucaauuuugucaccgguuaaauuaaacugaguagaucagagauuuuucaguccuaguuauaauuuagaaucaucuaaguagacuuuuuaaaaaguguguauuuuuaauauuuaaauauaauuaauuuuaauauaauaagauguuuugauguacguauguauagugaaaugaucacuguagccaggcaaacuaacauaaccaucaucucacauaguuaccucuuguuuugugugccaagagcacccaaagucuagucucuuagcaaauuuucaauauacaguacauaugauuaacuauaguccuuguacuguaugcuagauuucuagauuuauucauccuacauaacucugcaacuuuguacccuuuaaucuacaucuuuccauaaccuuccccauccccauaaccacuauucuacucuguuucuauggauuugaguaguuuuuuaagaaucacccaggcagauuuuuaaaacugucaaagacagaguauuacccuagaccaauuaaaucagaaacacugagcaaguaguauuucuugaaagcucuucagaugguucuaaugcucagccauguguugaacaggaguaagaugauucuuacacuuuacauagagauaguauaccaaaaugguuaaagucaggcucugaagucaccaaccuggguuuacauucuggcugugcuacauauugucagcauacugccagcuuuacugugguagaaaauaaaucuaaugaugaugauaacaauaauaguaacauacauuucuugacugcccuguuugcauguuucaggcacugauucuaaguguuuauguguacaauucaagaaauuaucacaauagcuuuuucagauaaguacuauaauucucauuuugcagaugaagcaacagaaucauagauaaaauuaaguaauuuggccaaguucucacagcuaauaaguagaggagccuggauuuaaauccauggacucugacuccguaagucuguaucaaauauguaagugucacaagggaaagauaagguucuuaaaaccuccaucaagcagucagauguucaggaaaugauaacacuccuugggaguugaacuaaaucuuuuggauacaaaaaucugauuuuaggcaguaucuuagaauuuugcagguaaaaaugacaggucacagagaaagguuuuaauuuguacagugcuaccaucacauaugugaagccauuuguguuuuuuuaaugcuguuguagauaaggaagaaagugaagaguuguccaaggucacacagcuccuaggugaucuuccugauauccuuguuuguuguacuuaacaaccuaggauuucuuugaguccagaagcauucacugagcugacauuucauugaugcccugaaucagauucagcuagaaaccacaugcacagacagccgaaguguuugaaggaaaaucugucaauuaguuaauaaggugggaacugaguuucaaagaaaaaauucuaaauguucuaagcuguuuggugagccaguuuagaaugccuuuauacccuuuuaaucuuuguguugagaauaaacuugcccuuucuaacagaagucagcaguucauguugucauauaucagccauacugagaaaucagggguugguagaguuuuaaaaagcauuaaaacagcaacuguauuauuuugaaaauaagccaaaggauuaacuuaaucuguugcccagaaacacaagugaaagagaaacacaagugaaagacauuuuuuaaucuuuugccauaucauauagcaaacuagaagaaaacugaacuugggagggaaauaggccagccacucaaccuuccagcaauuauuaggaaauuaaacaagaacucuuaaaguaaauguccugcuauuuucucauugaaaggggaaagucuguugcucucauggagguuuacauuuuaaugcucuuucacucauuuuagauauugcuuggaugaccgaaaagcuuuggaaagagauggaggauuuucugaacuucagucucgucuuauucguuaugaaacucaaacuaccugcaccagagaaaguuuuccaguaccuacuguguugagcccucuuccaucuccuguaguuucgucagauccuggaagugucccugacggagaaguuuuacaaaaugaacuucgaacugaaguaucccgauugaaacggagaucuaaagaucugaauugccuuuaucccagaaaaaggugauauauuacaugcacauaaauaguauauugacagaaaguauuuuagucucgaggauuuuuauuuuauuuuauauuagucuuucagguuaauuucuucauggcaagaaguuuguuuuaugagcuguugauaauuuugcuuauaaguuauaaaaauaaaugauuugggaaaaaaacacaguuucuugcuuuauaugcuaauauacaguccauuagcacaauggauuguaaaguuuuuaagccauggaacaguggagauuucaccccauagauuaagcugcugagcugcccuguugaagagacuguuuggggaugggaguucucccauuagcucuuccuuuccuuuccccucaguuuccugccugcauuguucccuugagcaagagauuccaugagguaccauuuuuaaaacaccuguuacauauaaaauauagcuuuaaacacugcauaaugauagaauauaugaaacuuuucuggaugcguuaguuugcuaacuaaaugaaauauccagauacuugaucagaaguuagaaguuuauguagugaacacuaauuuuuauugaauuuauguuaucuuuagaaccuuugucaaacuuagguucuuggcaucuaaagcaaggcuugaauucuuauuguauuuaaaccuugcaaaaaguaugaacuauaugaaaacauaacuuucagaucuuuuuuugaauaguuaagaaaguuagaauaagguuacccugauauggaagaacucagucauuuuuaugaggacuuuauaaauucaugguacuuuuuauaccugauaaaauuaaaaagcagcaguuacauuugggguacuauauuuauagccauauuucuuauuucugaccuauggcuaauaaaaauauauguguuccuaaaaggaauguauacuguggcuucugggucagcagaauugagggcuauaagacccuaucuuguaaagggaaaaauuugggccuugucaggaacaaauguaaacauuuuaggaagauugaaguaugaaccaguuuuauaguuuauuuguauuuguuuuaacacuaugacuuauuuugcaagggaguuccauggguauaaaaagauacagguugugguguuucuguucaaauuaucuuaacagaaaaguauaaauauuuaacagauuaguauuaaaucuauaaauagcagcacucuuggcaugcauagcugauuuauuugagaaauuguaaauuggagggaugggagagaguauaacaauauuguuuguugcuuucucuauuagccaaaauccuaguuugcuauucauuaccuucuauguguuaguuacucaucugaagaacuaaggaacaacuuuauaauaugauguuuauugcuuacuuaaggcaguaauagcaauaaauuuuguuugcuuuucuugaauuuauguuauaauggauauagugguaacacuauaacauagugguauaguguuauauauuauguaauauauuauguuauauauuaucuauuauguaauaacagugguauaauauagugguaacacacugguaagacagaaaaugaacuucgauguugauucacuuaauggauauaguuguaauauuuaagacagaaaaugaacuucgauguugauucgcuuaaucuacguucuugauuuuuuuccccugcuauauagacuugugaaaucugaaaguucagagucucuucuuucucagacaacugguaauaguaaucacuaucaucaucaugugacauccagaaagccacaaacagaacgguccuuaccagugacuuguccauugguuccaauuccuagcugugaaacuccaaaacuugcuacaaagaccaguucaggucaaaaaaguaugcaugaaucaaaaacaucaaggcaaauuaaggaaucaagaucacagaaacacacacggguaaagauuuauuucccauuuuucuuaguucuacauaggaagacuuuuuaaauuugauuacuuuaaaauauaugucuaaaaaauuuuaugaaugaaaugaaacgaugucuagaauuuacugguguaagaaggaugauaggaaaguagguggggauauaauugaaacaagauuagccacagauuaaucauacuugaagcugguuaaaagauauaucaagauagaaauuuguuauaaaauauucugugcgugucaaauauucucuacuuuucuaugcuugaaauuucccauaauaaaaaauaaauauacacuuacauaucccugcuguguguaacuuuaacacucagauuucaauucagaacucaugauuugaguuccuuucuuaagacacuguagucauuuccugcuaacauauuauuccugugacacuucugaccauguaaauguuagaucuuuuuuuucucaaucauuuugucuuaaugaaccugucugucuuuuagcacagcaaaaugaauguguaauucacaggauugaacucuaaagcugaaauaauagguuugugccuuuuccaagaaauauucgucauauguuauguucuguucaagauacugaaagaaguaguuacugaaacccugaagaaacacaguauuaccgagacucaugaauguuucacugcaugcagccagcgucucuuugaaaucucuaaguucuaucuaaagguacgguaucuucucuacuaauggcaaaauuuaguucauguucuaauguuccuguuugacauaaaaaaaaguuugaguauuuuuuauacugagagcguauacuugcugccagauuuauuaaaugauggagauagaaaaauugaagccaaaauacuuuauauuugauuugauuugaguucucauauauagaaagcuacauuuuaaccaauauccuauuuccccuaaugugcauuugacuuacagguaauaagcuucauaacauguuuaauuauuaauuuuuuaauacaguuggcccuccauaucuguggguucuauauccauggguucugcauccauggguuaacugcaaauugaaaauguucugaaaaaaaaaaaaaaaggaugcugcaucuguacugaacauguacagacuuuuuaaaaaguauaugggaaaaugugcauaggauauaugcaaauacuacaccauuuuauauaagggacucgacugucaguggauuuugguauucucagugggaucauggaaucauccuucgcagagaccaagggaugacuguguaguaaaaaggcuacuggacuaaauaucaaaacaccuaguuucuaauuuuggauccauuaucagcuaguuguaagacauuggacaggucagucacucaagacgaugguuuucuaaaacuuagacaauguuagauuauguccagccuuaggaguuucugaccugaaucacaguuaucuguggguuucugguuaaaacugcagaucuaucacauauccaagagaaaggacaagaaaaaacuggaaauguuuuuaauacauauugaacaauaacaaaaaagcacauggaagugugguguaacagagugaaaagaguuacaauuuaauugggugccuaguggaauacuagugagaagcauguuaauuccacagaagcugaggugcucaggauuugaagacaccagcuaucauggaaagcaggggcgaggguccauguagaaagcagggaaguuuaaauaaagaucuacaaagugaccuggagauuguccaacuugcuuugcaugcucuucuccccaaauguucacuacaaggucuaucaugcauagguuuuuccacccaccucagugacacuguaggaaauagucgcuggggaaaauauuggaagcugcaguggaaaagcuaacuggccaucuugucacucuaccuugaaaagaaaccagugacaaucucugcacagaguuuccagucagauuuuuagugucucacuuuuaaauaugacuagacagccauggauuagcaggcuuugaggaaagcuucuaacacaauugaugccaaaacauauaggaauaaagggaacucugaagaagcaggaaguugaagaaaacuucauaaaaacuauaauucucauagaaagaagauaaucgcauccauaaaacuagaacaggaugcuguuuccaaaaaaagcauaaaacaugaaagcuccauaacuuuaaaaauaugauaaagucaauuaaauagaaaggcugaacaguugagaugaaaaaaauuuaccagaaauuagaaucaaaugacaaaaacauuaaauccaggcuaagaaaauuggaggauuaauacagaagauccaaaaugcuaauaauaugaauuuuguauuuuuugaacaauuuucucuccuuuguucucaaaguuuagaagagagaaacuuguucaaaaauauaacaaaguuuuccaggaguggacacaagcguccuagcuuguccaagccaaugaaugaaaauucuucaacgagucacauaauuauggaauuucacaccucuuagcauggagagaacauuuucuaaaagcuucccaggaaauaaucuaguuuauauauagugaaucaauaaucagaauggcauuggacuucuccacaguaacacuguaugcuagaagauaguagaaaaguaucuucaaauucugagggaugugcauuucuagaauuaaaaaaagaaaaaagaaaaaagaaaagaaacuucugagggaaggugacuuaccuaguauucuauacccagucuggaaugcagucagguaugaggauuuaaugaagauacauucaaacauggaauaucugaaaaagaauuuauuuuacccuuuugaggaaucugcuagaagaugaaguucaacagaacaagggacuaaaucaagaaacaaaacaaaaacuaaucuaaaauggaaaagacaaguccuaauaggaccaggccuaggcagcaacuagaacaaauuagaggaggcuaugggagaaagaucuccagguuuaaaaaauuuaauuaaaaagaccaaaagcagaaaggaagcugaacugagagauuauccuguauacuucagggcuugaaaaaacuuugcuguacauuuagcccauuuauugccaguauuuaggagugaaaaacccagaauuauauacauggaaagcugagcaaaugaaaaaagcuaacagguaguuaacaggauaaauagaauauuggaagaaagauaaauuauaaccauaauacauuaauuagcacacaauugaaaguauuuacauagauacaauaguguaaacacugccuauuuacaaucaaaaauugugguacaacuguucuucaaaggaagagaaggaagguuuuguguacgagaccugaauccauccaugacguucucccuaacaucaguucucccuaacaucaguagucagugucuaaaaguguuuaaucaccaaguagcaacauaagcauaguaguuagaaacauuaagguauaaauaagggaaaaaccugaaagaauugaaaguggcugccuuuauggagcguaacuuggaaguacaacagauaacugcuucuuaucuuuuuaaauacaauuccauuucuuuuacuuuguaauaaucacuaaauuuuuaaaagugagacaucagcuuccuuuuguaugucauucuucuuuaugauggagucaaauagccaaaaugaagaaaaaauaucuuuuaccugauaaauaaauacaaaccauauguuuguuucuggaguaaugcagcauuaguggaugcucacgguggaggaugggagaguaaugcagcauuaguggaugcucacgguggagggugggagaguaaugcagcauuaguggaugcucacgguggagggugggagaguaaugcagcauuaguggaugcucacgguggagggugggagaguaaugcagcauuaguggaugcucacgguggaggaugggagaguaaugcagcauuaguggaugcucacgguggagggugggagaguaaugcagcauuaguggaugcucacgguggagggugggagaguaaugcagcauuaguggaugcucacgguggagggugggagaguaaugcagcauuaguggaugcucacgguggaggaugggagaguaaugcagcauuaguggaugcucacgguggaggaugggagaguaaugcagcauuaguggaugcucacgguggaggaugggagaguaaugcagcauuaguggaugcucacgguggaggaugggagaguaaugcagcauuaguggaugcucacgguggaggguggaaguuauuuuaggucagcucuauugggaauaggagaggagagugagauggacuuauguauauguguauguauuuugguuagaguauuuugauauuucagaauggaacuaaauuauaaucuaguacuuagauuuuuuuuguuguuguagucugucccuaaucacauuaauacguguagaaugauuuagaauaaucucaaguguauuuaauaauaaugaguuguucuuuguaauuuaaugugcagauuguaaaaugcuguauuuuauuauguuuaggaucuuaaaacuucaaggggucuauuugaagaaaugaagaaaacagcaaacaacaaugcuguacagguaaagaaauuauucccaagaaacuauauucaauuaaauugguauuuuauuucaggguugcucugaugccauuauauaugcagcaguaaucaguuacuggucuuuuucaacucugucccuaugaaaacucuuuaagaaacuucauaggcuuauuuaggcugaguauuucauaguauuuaguagauugcucugucagcaaaagaguuucuaaagugacacuaagaaagcaaaagaaaaaauaaauuagcuggaaaaaccaauccauuuugguuagcuguuuucaaaguuuaguuuaguuuauuugauugaccauuugaaacauauuuucauauaaaggugagaaaauggagcagaaucuucauuucauccagugagaacauuauuguacucaguauuggaaguccaacaaaaauguucuuccauuagaaaauaaaauguguauuuaaguauaagauuucaguaucuuccuuuuuauuugaaauuuucuaccauguucuuuugaaguuuuuacaauauauuuuucuauuacuuguguuuucaagagaaaucuucuguaaucauauuuuuucucccccuaggugauugacuggguauuagaaaagacaagcaagaaaugauacauaaucauucucuuuaagacaauuauaaauuggauggagcuauuauucacuacuucuuuucuuaguuugaaaauuauaaacaaauuuuaagcuuuauucaaagaauagauguuauauuucuaaagaauuucaugaauauauauucuauauuuguauaguuugagggaugcuauguuaauguauuuuuaauuagauacauauuuuguaaaguguuacuauauuuuaaaguuauuuuuauauguuuuaaaauguuuacucuuauuuaauuauuacaauaaacagaauuuuuuuuuuuuacuuuuugga

SEQ ID NO: 17777 - RNA, 63219 nt, Homo sapiens
ccgccccguucccacuucugcugccgcuagggguagcggcggcggcggcggcugcggcucgggagcgcggcugcuuugagggcucgggaaccuuacagaguggggacguggggaggcuagagggugagaaagcuggcgggagaguagggcggcgcuggaggagggcggugcguggcugacucauccucuggaagaucagacugacagagacacacacuagcccgccccgcccgcccgcgccgcuccuccucagccgggaggcgcccgcccgcaccgaccgcccgcccucuccgggcgcuguccgggcccggccgucucagagaaaguuuuucccaucggaggggcgggagccgccgcgggccuuuuggaaaggaaguggggacggaacaggaggcgagagccgcgcgggcccgcggagugcauggugcccggcgccucggcugccuggcaggaggaccucggggcggggucgagcugagcccagcuccuucucgccucagccgcgccagaaaccgccuugccggacggccgcgggggucccagcuccucagcucgccaugucccggcugcugccgcugcugaggagccggaccgcgcgcagccugaggccgggcccggccgccgccgccgcgccccgcccgccguccuggugcugcugcgggcgggggcugcuggcgcucgcgccccccggcggcuugccgggcggccccaggcggcugggcacgcaccccaagaaggagcccauggaggcgcugaacacggcgcagggcgcgcgcgacuucaucuacagccugcacuccacggagaggagcugccugcucaaagagcugcaccgcuucgagucuauugccauugcccaagguaaggggggcagguggggggcgagcccgggggccccgacgcccuccucuucucgccagcccaccgggagcccgcugcggcccuggaucuuggacccccgccgccgccccccuuccgccccccucgccugucuggccccacgccugggacggcugggggcggggagacuuuccgccgcccgaguuucccccaggcagguaggacgggcgcgggucgugccaggcagccgaggccagcgcuagcuacuuccuccccagccuccgaauccggagcuucggccuaaaaugccaguuaacgcuguugggauugaguuuugauuugccccgugccuccccuccccagcccuccugucccuuagcccuugcugcuuucuugcgagcgugcacccgugcagguggcaugcugugccugcuccgagaaagugcugcaaacccgccuggcaggaagaaacuuuuugaacgguuaucaaaugaagacguauggguggguagccaaaagaagggguguagcuucgaaagucagggaugcucauagcugcuuguuuccacacaugucugauugcguuaauuucagcagccaaaggaaacauuuucuccagaaauggaaagacagauucaaguuaaacuccaguuuugguuuuucccagagguugaaagaaugaaauaaauaaggagguauauuuuuuggaaaucuguggcucuguaguaaaagucagacugaugcucaaaaguaauugggaaugaugaaagcaaaacgauuuuuaaacuagcauguuaaaauaggauauuucuaaaaggaguccagaaugggguagggcagaauuugagucuaggugaaaaagcuaaaaguucagaaaauaaaaaggaugaaaggagcaaacgacuaaaauggaugucuuaaaauauuucugccacuuaaauacaguuauguaaacaaaacacauugcuucaguuuguauuacauucugauguguuugaaaguuuuaaaaaaguuuacucuccucucuaaacuugguagguacauaaacaucucauagauuccaaaguguagagcacauugauucggaucaugccauuugauuugccagacuugaaaguauaucuuuagcugaugugcaggaauggaggaaagaauuaucuaccucauguaagcaggacguuaucuguacuacuucagaaacuuguuuuaguuguggcuuuuaaucagauguuuucccccucaguucaggaaauuguggaccaauuuauaguggaugauugauuccagacauuguuuacccacagugcuuuuacaggaaaauguaacguccgaucaauuccguuauucaauguguaaucaugauguuauaugcaaucauaaugaaacacuagcacauuuguaaucuaugugugcacucaguaugcaguuuaaaaauagucaauucugaaaauaugcuccuuggaaaaauaauauagucagucauguacuagaacauuaacuuuugaaucuuucugcacugacaagacuauuugaacacacauuuuaccuuuuccaaguaauuucuuggaaauucugcauugucaacaaguuacaagauuggagggcccuaugaauauaguuuuguggcaguucuugaaaaacauguccugcaaggugacugaauaauuuuuuucucauacauuauuauuuuuuacaugccagcaguauugcaguagcaaugcuacauuuccuaauaaagauaauauuuuuaaauuuaacgugguuuuaaauauucugaaaaggaccuaagcacuuuagucaauggagaucauuagcaucaauuaaacuuaguuauguuacuaauaugagagagaaauuaguaauuuaaauugucuucuuugcucaggagaaacagucaaggauauuugaaacaaugguuagucagaugcuuaucucuccucuuuauaugcuaaagaacaucaaaguuuaaaucagcuauuuuugcugaugucgaugacaaaaugauuguccuaugaaucaaaugacacagaugcugcugcuuuguuaguguauguagucuugguguucacuuacuguuuucaguaucaauacauauaguuauggagauaacuagaaucaucacuuaggaaauuaccuuauucauuaaucauuaagguaaaagggauuuuauuauguugggaaugcguacagcucauuccauugcugaaaucaacaauuuuuuuccagccagauaaaugaaaaacucccauguuuucuuuuauuguugcuuuuugaauaauguuuugaaguacucaaccgauguauuguguguguguacuaaguguacuuucuaacaaaauuaauucuauuuaaagggcuauuucuugccauaggcaaucuugugugucuuuggaaagggugcuuguauaaacuaaugaaguguuuuggauuugguauggaaauguuacugaaaaaauaucauccaugcuuugauauggcaguggaaucugcuguugaaauuuggcacauuugcccuuaucuuucuuauauguuuaucaguaggcaugugauauaaucugugaugagauaaagcuuuggaaucaguucguaauagauaaggcagaccuugugggauaucuuaucauaguuaaauagaauauugugauuuuuaaaauuacaaaccaauuucuuucccaauuuaaaaaaaaguugaguuugcgccuucaauuuaccugcucagccugaucucucuucuuccagaaacagaccauauucugcugauagagcauuauucauguuuuuacaaguaguacuggcaagcugacauuauuacaguggccuuucaauguuagccaaaauuuuuaaaacaaauuuucuucccaauuuuuguaauuaauauuuccauuuauaauuauuuuuuaaagcuuuuaaaauauagcaauuugguauugaaaaauagacagugcucauuguauuaguuauccauugcgguauaacaaauuauccuaaaacacaguggcuuaaaacaagcauguauuaacucauaauuucugaggcucaggaaugcuauagcaucuuaguugaguauuucuggcccaggaucuuaagaaguugaaaucaagcucucagcugggguggcaucaucugaagucuuaacuggggcuggaggauccauuuccaagaagucucacucacauggcuguuggcuggaugucucaauucccucccaugugguccuccacagggcugccugaguauucucaugacauggcaguggguuuccucuagagcaagugaugagagagcgagagagcaagagagagcgaguguguuugcaagacagcaccugugggcaccuaagcuggaagccacagacuuuuauaacacagucuuaguagugacaguccaucucuuuuguccugacacauugugggagaguacuacagaaggugugaauacaagggagugggaaucaucggggguacaucuuugaggcuggcuuccacacuuauuuaaggugguguaauuaaugcucaucagagaguuacacagagagacaagaacuggcuauuggagagguaaaaugagagauauguuuugaaaaaaggagccucuuagggaauauuuuuguuauaauauguauacuauaagccacagacuuuuaaaacgcagucuucgaagugacaguccaucucuuuuguccugacacauugugggagaguacuacacaaggugugaauacaagggagugggaaucaucggggguacaucuuugagguuggcuuccacauuauuuaaggugguguaauuaaugcucaucagagaguuuacacagagagacaagaacuggcuauuggagagguacaaugagagauauguuuugaaaaagggagccucuuagggaauauuuuuguuauaauauguauacuuaagauauuuaaaaaaugagauuguuuuuacauauagcaaauaaaagauguauugaggugaacagagcaguuuuucuaucaauguuaggucucaauuagcuugcauuuuuugauuacucuaugugagugguaauugugugcuuuugacauuuuuuaccauuuaucuacgucuguauacauuaaccaaauaauucuaaacuuuaaucuuguagucccccauuuuuugugauuguuuaagguagggugaagagcuuuguuuugagaacuugccauauaguauaagaggacguugacaaaaugaaagacugaaagauaaagagcuuauacuaaauugaguaucuaaaacacuuaaaaauaaauuaggcuuucuuauggaaucccuguucacuagagaucuuggaccuuuaacaagauuauccuuauuuuuuuucagcccauugcucaggauuaugugagaaaauagaaauucuuuucuuaaauuuuuuuuauuuuuugagacagagucucacucuguugcccaggguggagugcaguggugcgaucucagcucagugcaacuccaucucccagguucaagcgauucuccugccucagccuccugagaagcugggauuacagacaugcaccacugugauuggcuaaguuuuguauuuuuaguagaggugggguuucaccauguuggccagguucaucucgaacuccugaccucaggugauccaccgagcuuagccuuccaaagugccgggauuacagcugugagcaccgugccuagccuaaauauaaauuauuuuaagcuaugagccucuggaauggauugggaauaguuugcuuuuguccaauaagaaaaagggcaagaaaaacauuuuauacugcaaauaaagauacgugaauaaagauauuucagugccuuuguugagauaguaaaaaggaauaagggaaguauagccccaccuaggcccggcaagaggggaagaacaaggacguggauaagaaguaugaauugaggcaagaggagugagagaucucugaugagccaugggcuucuauaaguugaguuacacucaguuaaaugaagcuuugcuacaaucaguuauuuuaccaauauggaaagaaccuaauuacaguaguauauuucagcaagcuuaauucugaguucuuuagaguuacgggguauguuggaauggucuuauuacuagggauuacugccaguagaagacagauaaucaaguaaucaaguaaaguuuuuuuuuuuccauuaugaaaggcauauaugcuguuuaacaguguuuaaucaucacuuacauauaacauguccagaguuacgugugacuucaaauaacaacccuucuaucauagcucaugauuuuguggaucaagaauauaggcaguugcagguacagaguucauaggaaauaaaaaaauaaaauugaaaaaaaaaggauauaggcagggcucagcuggaugcuguuucuuaugguaucuauggaggucauuacauaaacuuuggcuggcugauggucuggucagaagguccaacaucgguuuguuuaugugucugguacuuugguggauggcuggagggcuggccucaacuggaacuguugacccaaggagauggauguggccucaccagcaugacaauguuagcaugguuguaauacuuaggucagggaucccagagaaaauguuccaagggggcuggguagaagcuguaagacuuuguauuaguuuucuuucucuuuuuugagacggagucucgugcugucacucagucuggagugcaguggugugaucuuggcucacugcaaccucugccucccggguucaagcgauucuccugcuucagccucccugaguagcugagacuacaggcacacaccaccacacuuggcuaauuuuuguauuuuuaguagaggugggguuuugccagguuggccaggcuggucuggaacuccugaccucaagcaauccuccugccucggccucccaaagugcugagauuacaggcgugaaccuccacgcccggccuguauuaguuuucuauugcugcuguaacaccacaaauacaguggcauaaaacaacauauucucuuagaguugucaaaguacaaaguccaaaauaagucuuaaaggacuaaaaucaaagugucagcaaggcucuguccuucuagagaguccagggcagaauguauucuuugcuucuuucaucuuuugggauuccuugguuccuggacacaucacuaaaaucucugcucccucauugaccuuuuugccucccuauuauaagaacccucaugauuauauuuagguuuuaccuggauaauccaggauaaucucacucucucaaaauccuuaauuuaauuacacuugcaaaauucuuuuugccauauaauguaacauauauacagguuagggaauuagaaugugggauaucuuugggggccauuauucauccuaccacagacuuguuaugaccuagcuuuugaaguuccagaacauuauuucugcugcauguaauggucaagcaagucacuaaaaccaguucagauucaagggaagggaaauuaaaaggaggacagaaaggugauuccuuaucagacucuucaccucucuauuaaauaaacuuuuggguaauuguuuuccuugauuguguugucucuucacuucuaaauucuugacuaaauuguaaauauuagaaauuugggaaauauggcuuccagguaagucaaacacuuauauguauaguuuaauuuaucaguaauuaauuugcuguuuuucaccuuaauagucauuuauugccuauuuuuuauuugugacaaauuguuaugaucaaauuuguggauaggaaaauugaaguaauauaaagucagcaauuuauagggucauccagagggucagguggaacuacagaucacgaucuugaaaguuugagaugaugugauauuuugccauuauuaguggagauuguuuucauuuuucuaaaaauagugaugaguuugcauaaccacacucuugucugguuuccuuuggugugucuggguauaaaauaacuugaacaaauagggacuaaauccuugaguguagauuuuauuagcaucuugcccaagucaucugaauuaguuaguauguagcuuuacaggacuguagccuugucuuugacucacagguuuaugucugcuuuaaguaaaggaaaacacauaaaaacaaguaguuauauauuaaaauuaccucagacagacaauaagagguaagaguaaauaagagguucuuguagauaaaagacuguagguaacaaaaucauuucuccuaagcucugagacauuuacuuugauugcuuuugaugauaaaauauuugaacauauugcauuuuuuaucugccuuaguaaaaauauaaugagcauaauuuagcuucuaccagaugucggaguccuuauauacuauauuuuaauacaauaaguuucuuugagguuacuucuauuuguagacaugcuaaucauuacaccaaaugccuccagaacacugcuguuucaguuggcaugcuuuuuagacucugucauagugguagugaaaugugcugggcuuagucugccccucccuccuccucagugcucucagacuuuucuacucuauucucauucauuccuuguaguuaugguaaacucuuuucugcuguguaaggaggucugcuucaugacauccuguuauuguuucuaaagucugauuuuacuucugccaauugucacucuuccauuguguuuaauuuucuucuuuuuccugucuuuuuacuuccucccuuugcuuuucagcaggguuuaaucuugauagacauuucaaggaucacuguucucuuuuguguuuucagcuaacuaguugcaucuaucacauuauuauugauuuuugacucuagcucuuguacuaaagaucuuucuuugauaauaucccucauaauagguuuuauaguagauucuacugcaaaggcuaugguugcacaacaaaauccuuuacauucucuuacuaaaguuguacuagauaauagaauugcucuagauuaccuacuggcuaaguggggaagaaucugugcaguuguugauacuucuuguuuuuuuuuuuuuuuuuuuuuuuuuuuuuuugagacggagucucgcucugucgcccuggcuggagugcaguggcgggaucucggcucacugcaagcuccgccucccggguucacaccauucuccugccucagccucccaaguagcugggacuacaggcgcccgccacuacgcccggcuaauuuuuuguauuuuuaguagagacgggguuucaccguuuuagcugggauggucucgaucuccugaccucgugauccgcccgccucggccucccaaagugcugggauuacaggcgcuucuuguuuuacauggaugucuacaucagguauuauggagauucaguuguaggggauuaaugaacaggcugcuugguugaaaaugcaucagaauuaagcaguuaacuguggaaaugacuuaaaauggucaugguuaaagacacaauugacaagaaaauuugguuauuucuguggccuacaauaauuaauuuaaaauaaucaccauaauuaggacugauaacauaccaagacacaccagaauuuuaggaggcuuauacaauuuuggacuauauauuaguaacauauccauaaacuauaacucaaagaagauuaaacaucauuucuuauuugacaaugcuucccauguaauuuaacuuaccagauaagcuuguuucuuaucucucucuuggaugcugcaaggacccucuguguaacgucucaaaguuaguuugaggucaaaagacuaaacuuucaauuugaaauuugauuuuggaagugcaucaaauuugucaaagauuuaacgcacuuaaucaaaauaggaucaaagaucacuguaaaauaauugucauaccuuuagccaaagugguaauuaaaagguuuuuaaaagcaaaaccauuuauucuucgauagaggauugacucuauuuuccacacaaucagaaauccuaauagauagcaugagauggaaucugucucuccucuccccucuuucuuuuuuugcaguuuacuuaaaagguaaacaaacacauuuacucuuucuuucuucuuaauacuacacaaaauucuuguucaaaagagaaaaccaaauuuuacuuuuguauuaguauauuaccaauacuaaaacuacagcuaauuuuauuaaaagcuuauaaacaaauuggauuuucauaaaccuuuuauaaucucuuagcauuuuuucuauuuuuuuuuuuugagacaagagucuugcucuaucaccaaggcuggagugcaauagcaugaucuuggcucacugcaaccuccaccuccugggcucaagcgauucucaugacuaagccuccugaguagcugguacuacaggcguacaccaccaugccuggcugauuuuuguauuuuuaguagagacaggguuucgcuauguuggccaggcuuguguugaacuccugaccucaagugaaccaccagucucugccucccaaaguugugggauuacaggcaugagccacugcgaccagccaauuuuuucuauucucuuucuuuuuccaccuugcuauauuaauuuaguuuuaucuguaucuuuuaaaaaauuccuucauuuugaaacaaccuucaaauaucuucuaaacuagauagaugaaauuauuuuuucucagcaaauacacauuuucaugcuuuuuacaacuuuccuuaucaaaaacauaucuuggccuggcacaguggcucaugccuguaaucccagcacuuugggaggccgaggcggguggaucaccugaggucaggaguuuaagaccagccuggucaacauggugaaaccccgaaucuacuaaaaguacaaaaaauuagcugagcguggugacgggugccuguaauccuagcugcuugggaagcugaggcaggagaagugcuugaacccaggaggcagagguugcagugagccgagauccugucguugcacuccagccugggcuauaagagcgaaacuccaucucaaaaaacccuccaaaaaaccgacaaaaaaaaucuugcuuuuuaaaaauuauuuauuuauuuuuuauuuuuuugagauggaguuuugcucuguugcccaggcugcagugcaguggcgcaaucuccgcucacugcaaccucugccucccggguucaagcaauucuccugccucagccugcugaguagcugggauuacaggugcaugccaccauucccggcuaauuuuuguauuuuuuaaauagagacgggguuuucaccuuguuggccagacuggucucgaacuccugaccucaagugauucacccgccucugcucccaaagugcugggaucacaggugugagccaccgugcccggcccaaaaucuugcuuuuuuuuaaacacucuguauacagacuuguuuccucuuauaucuaguaguuuuaauuauauauauuaacuuauuaacuacaggauuuuuuuuuuuuuuuuucgugagacagaguuucgcucuuguugccuaggcuggagugcaauggcgcagucucggcucaccgcaaccucugccucccugguucaagccauucuccugccucagccucuggaguagcugggauuacaggcgcccaccacuacgcccagcuuauuuuuuguauuuuuaguagagacagggucucgccauguuggccaggcuggucuugaacuccugaccuugagugaccuacccgccucggccucccaaagugcugggacuacaggugugagccacugugcccggccuacaguuuuaacucuuaguagccuuaaugucuagcgaaaaccugugaaguugucuugaacuguuuuguaucaguauuuguaaaugaaaaccauuuugcauuuuuuuagaaagauguuuucucaauuuuuuuguuuauuaacagaucuaaguauacuuaaccuuucugugccauaugaaugaauuauauauaacugacaauucagaagccaguccuauuuaauuuuacuaacaauuuaaaaacuaguuuuauuuaucaaauauuaacacauagacacacagaagcagaucuuacagcuuucauaaauaauuuucauuugcuggcuuuuaaauaauuuuuuuuccccauucuacuaccaaucuuccaauuaucuguuucauugcccuaagcaauuguuagcugggcaacccuaaauuugcauuuucaaagggauggcucuuagaugaaacgagguagaaaauuuauaucuccaaagcacagagcugagauuucaggccuaaauaauuaauuguauaaucauuugcccaaaccaaggaagaagguuguugguaaaggcccagcuaaggcaagagagccaggaaaagcaccuuaaacaaagguuagauuuguuuugugaauucaaaccaaugguaagaguuucuagugacucaguucucccucucuuccuggugcacagaggcagacacccuuacaaauggagauuuuuuuuuuuuuuuuuuuuuugugacagagucucccucugucaccuaggcuggagugcaguggugagauuuaggcucacugcaaccucugccuucuggguucaagcgacucuccugccucagcauccugaguagcuggggcugcaggcgcgcgccaccaugcccggcuaauuuuuugcauuuuuaguagagacugaguuucaccauguuagccaggauggucuugaucuccugaccucgugaucugccugccucgaccucccaaagugcugggauuacaggcgugugccacugugccuggccgagauuuuuuuuuauagauguaaauuucuuuuucagaagaguuucaaaauagccagcuacaugccagaaagguaugucuugaagacuuauuuaguugaauaggcagucuuuuuaacuuagcuacuguuuccuagcugaaauuauugaguuuagggugaaggccauuaaggaaaagggcaaagaaagcguucucugcgccuagacucaauaugauagcucugaaaaagaagcaaggcuacuuuaccugagguccuaacuuuuauaaacacuuuaucuaggauagcuuucuuuuagccuuuagugugguauaauuacuaagccaaaagguuagcagauuuaauuuucguuaucaauuaguuguuuaagcuuuuuauuugcccuuuauagucuuuuuccuuuuuuuuuuugaaacagagucuugcucuguuguccagacuguagugcaguggugugaucucagcucgcugcagcuucugccucccagguucaagccucccuugugcuucagccuuuugaguagcugggaucacaggcguguacuaccaugccuagcuaauuuuuauauuuuuaguauagaugaggguucaccauguuggccaggcuggucuugaauuccuggcuucaagggaucugccugccauggucucccaaugugcuggcauuacaggcaugaucuuacagucuuuaaaaagaggcaguaaaaauguugaaaucuuuuuuagaaacuucugcacaucaauagacaucguuggaugagacuaauugaggauuccucacuuucaaauguacugaauuaccuuuaguaagauuuugcuaucucuuuaaguguuugcugcuuccagggcuuaauauuuauacauguauagguaggcauagccggaagguggaguacucaguucuucagaaauuaaggaucucaucuauuuggcuuuggcucuuggaucaccuugaucaauuuaaacagugauuuuucccuacguaagggugaaagaaaaagaaacaaaugggguagaacacaaaaauuccucugaauuuccaaaagccaaagcuugcauccccggcaguguugccauuuacuaccaguuucugucugacccagucagacaucugaggccucuaacuggauccaggccaguuaaugauuagauccaauucuguccuggacccaguccaguuucugucacaacuuccaaauucaguucagauaaaaaaaauugcucaaacucagauagcucaaaacauacauccauggagcuuuggaauccuagagagaagcaccccauuugcugcgagagagcaguagacacaauggauccuguggguaccucacuuggccgcuuguuucuggggguugcugggagcucgacuuuggaucgcacuucugacaccaucuguuaagggaaaacuugagacaaauuuaacagaguuuauuugagcaaagaaugauuuaagaguugggcagccccugaaccagaauagauucagagccacucugguguuguugcauggucagagaggauuuauggauggaaaaaggaaagugacuuauggaaaauggaagugaggugcagaagcaggcagauugguugcaccuugacauaugccuuauuugaaugugguuugaacaguuugcuaccuaugaaugcauuggaguauggcugcugugauuggcugagacucggcuauuuguuagaagaguagauuaugaccuguuuacauaccugcuuggguuauaguucauuauguauauggagaaaccuucaggcuuaaaauauguaaggaggcagcauuaggcuaaacuuaauuuaaaaacaccauguucacuaccauuacuuaccaauuauugaauacuuguugugugccagacauaaugagcugaguuuuuaugugauuauuuuguuuacuucucuuggagggagaaggaauuaucucuauuuuauagauuaauauacugaugcgaagauuagcuugccccaaauccuucaaccagugugucagaguagagucaauaacagcuuuggcugggcacaguggcucaugccuguaaucccagcauuuugggaggccaagguggauggaucaccugaagucaggaguuugagaccagccuggcuaacauggcgaaaccgugucucuacugaaaauacaaaaacuagcugggcgugguggcaggugccuguaauccaagcuacucaggaggcugaggcaggagaaucauuugaaccugggaggcggagguugcagugagcugagaucaugccauugcacuccagccuagcaauaagggugaaacuccaucucaaaaaaaaaaaaaaaaaagauaaaaaaguaaaaauauauauaaaaaaaaagguuugucugacuccaaccucucuuccuacuuacuacuuacugccccucucuggauacuuauauccaggauuuuaaacacauggggaaaauaacaccucauggucaauaaaaguuuaauuuuuaaacuaacuggauguacugguaacauaucuuagucuccuguaucuccuguguguuugcauaauaugcaccauucaauacaaaagcaaauaugguauucuuacuuugaaaauaaggggaaucaaugugcaaaaaaguuaauauauagugugaaaaguuuggaaaagucagaaagcuaguauuuaggauuuguaacucauaaaucucuaaccuuuaguuuuccuuuagauuuuggaagauuuuuuauauuuguuuucaaaaugaauuccuaacucgaaugacuuuuuaaaacgaaaucuaacauuuaaccuauaggaaagcucuccagacuuugaguucauuuucagcuuuacuggguauugugagauaacuauauaaagauauuuaguaauuaauuguauauaucaacucuggagcuccagaguaagagucaaguuugggacuucuacccauauagguaguaacuagggcuaggcaguauaaauagagugauaggagaagaucccaggagaaaaugcugaaaaacaccaguguuuauuggaagagaacaggaagaagaacaagaacuagaaagagagagaggaguaauguccagagagacaggaaaaaaaaaaaaaagauauccuagaagcuaaggguggaagaggcauuucaagaaagagggaauaagaccaggaacgguggcucacaccuguaaucccaucacuuugggaggacgaguugggaggauuguuugaguucaggaguuugagaccagccuggacaacaugguaaaaccccgucucuacuaaaaauacaaaaauuagcugggugugauggugcaagccuauggucccagcuacuugggaggcugaggugggaagaacacuauagccugggaagcagagguugcagugagcugagaucacgccauuacacuccagccugugugacagaaugagacacugucucaaaaaaauaaaaauaaaaaaagagugaucugaugcuuuagauaggucaaguaagaggaauauuggggcugaggugugugugggguccauuagauuuaauaacgugaaagagauugaugucuuugucagagcaguuuuaaugauagcuaugugaggagaagccagauuuuaguuggcugagaagggaguaucaauaaggaaggauucaacuuucugaaggaaacuuuggauguggaagggagauguugggcaauagcuugauuuuaucugaggucaucucuuuacucauaagucagaaaugugaauuuacuuuaaguauauguuacugguguagagagaaaaggaaaacuccuuugcccucugaagauucacugacagaaggcagauuaauaagagaaauggccuacaaauuuauuggcaugcaugggggaaaaucacagagugauuacccgcuauccuaauggggcccacauacuuauauagccuuccuuauuuaagaagggaggggagagauggguaaaacagguauguauuaggccauucuuaugcuguuauaaagaaauaaccugagacuggguaauuuauuaaaaaaagguuuaauugguucaccgcucagauuaaggauugacucguagagauugggagaaggauccagguagaguuucauguucuuccuacaauacugcuauuccccuccuucagguuucuacuacaaugggcacuuucuuagggcuuucuugucuuuuuuguguguaucuggugugauuucuagcaacagaaccugcaagaagguguggacucccccaguuuaugcauacccuaguagcuucauacugccucaaaaucucccacucugccuucaccuguucaccuacuauuuagcuguacccucuuaugguguccaguugcagcuauccuaaguaagcaaguacuaagauccugucuguccuugcaggugccugccccucuuuugauuuagggccaguugauugcucugugacuucaguucucuuaugguuuagaaauaagccaucaauuugaauugaauuugacuguguuucauuauaaaggugggaugaagccccuauguuauaucacacagugaaaacuagaccccugcuucccaaauuuuaauuugcauacaucaucugggaaucuuauugaaaugcaaauuguguuucauuagguuugaaguggggccugagauucugcauuucuaacacauucccagggauuucagugcuacagguccagggaccauauuuugaauagcaagguuacagaaaguauuuuuguuuuuaagauaggaaagaguugaagacauguagauaguagcuucaggcaugcuugaauugugaaagaaaauaggcaaaugugauaaugauaauauaagaugugguacauuuugugaacuggcugaauuuuaugugcaugagaaagaucuucugguuuaaaaaacguccuagaauuuuuuuuuuuucugcucaaagggacuucuuaaugacaauuugaaaaaaggugaauuguuaacccugauuuuguagcuaugcaacaaucacauuugagaaauaaaugccguguaagagauguguucuuuuugccuaucuucuuuuacuucccauuauuaccuggaauacacuguccauugguuagucuaauuucuuuauugaacugugaccuccaucauacuuuuuucuuuucugcuuuucuucauguuguucuccuguguuuuucccaccgaauuuuuuuauuccuuuuuacauuuugaaacagucuuaaauuuacagaagaguuucaaguauggcacaacaaacuuuuuuucuccucuccuaaaucauuggauaauaaguuucugauaugaugcccuaucauuccucucacagauugaguuccuuggcaagcaguuucugagacaaagguuaacaugcaaguaguugauugaguagugugcuggugaaauucucaccuugggaagggaagggaaagaagcaggcuugggcagagguagaaguaaagguguaauauaguuucaguggaagccucagcuaacaccguagggaguuuuggagaugggaugacacuuuuguguugucuggaguugggcaaaaggguugggccucugcuucugugaaaacaagcuauuagauguggagugcccugggcagggugcagaucccugagcgaggcagcauucuucagcugugucggucccccaagaugacugauuguugagggcugucuauuaucaggacuucuggcagcuaaggaucagauuauguaccacauuguccacugcaacgggaguacugugguauggauuuccuauaaacaagaacauugcccuggauaaccacaauauaacauggguacuuuacuaccaucuaauacucugaugucauucaaauuccaccaauuaucucaguaauucuuuagagcaaaaagauucagaucagaauuguguguugcauuuaguuguuaccuauuuuuaauuuccauccaucuggaacaguuccuuagucuuccccuugaguugcauugaucuugacacuuuuggggauuacagaccaguuuuuuuguagcaugucuuuggguuuuuuguagcacgucuuugagagaaaccaauuuggguuucucucuuuccucaugaauauauuucaguuaugcaucuuugacaggaguaucacaggauugauguuauauucuuuuucauccuaucauuuggcccaugauuucaauuuguccuuggugauguuaacuuuggacguuugauuaacaugguaucuaucugacuuaugcacucuaaaguuacuguuuuccuuuuuauaauuuauaagucuuuugugaagugauacuuugagucuaugaaauaucccauucauuuuagcaauuuauaucaauauauucuauucaguagauuauaauucauuacuaucauuuuugaucuuccagcuacccuauauguggccagugggaaccccuucaagcugguuucugugucuuuuugacgugucuucauuacucuuugaauaauuccuggcuugaauacuccacaagauguuccagacucaucuugcacuuuugcugcccuagccuuagaaucagccauuuauacaagagacucuuuuuuuuucucaguguagauuaguauuuagaaaccaagaucuggguguuaggugugcucauaacuauuaggauguugcccuaagaguggacagagcuaguaaauaaaugaauauauguauuuauauauaaaagcuauauuauuuauaguucuaugugucuuuauguauuauaaagauucauuacaguuucuucaauacuaagcuaauaacacagggcauguucuaguuuucucacuuuccguauuucuaacuccauucucugauggagaaauuccuagcuccuauuauuuuuaauauauuuauuuauuuuucaccacugcuccugucaccaaaaucccaucaccacuacugcccacauauuccuauacagaugcccuccuugcaccaacuugggcacugacacccugagccacaaucccuuccccuuaguguguggaagccugucucaaccaacugguucuuuuuuuuguuuuuuuuugagacagagucucccucugucaccuaggcuggagugcaguggugcgaccucagcucaccacaacuucugcccccuggguucaagcaacuuuccugccucauccucccuaguagcugggauuacaggcgugcacuaccaugcccggcuaauuuuuguauuuuuuguauagacgguguuucgucauguuggccaggcuggucucaaacuccugaccucaagugaucugcccgccuuggccucuuaaaaugcugggauuacaggcgugagccacuggacccggcccaacuggguucugacaccuuauaccagaccaaccugccuguguggauacaccucacacugcuugagcucuaaaacgcuguucuaggcuucuguggcuuccccugccuccuauacagaugccugccucacucauuucuuccucauggcuuuuggacagaacuuuaugggagagggaagagaaaucccaccuccccucacuuacugaaauccugcaauacuuuaaggcuaaauccuaccucuucuaggagucugucucccacuucuuagggaaauaauuucuccuuucuggaaucuuaccuguauuuuuauuuuauuuuauuuuauuuuauuuuauuuuauuuuauuuuauuuuauuuuauuuuauuuuaugauaguaaauucaaggaauuuaaguggaaaacauuugacuucuaagaaagagaaucuuguuccuuugauuuuacacuaauuuguauaggcagaaaaaaauguauauuaaauuuuaaugcccuauuucucuggauuuaugcaaauucauuaauaauucauuuuucauuauuauaggcaaucccugcuuuauauaauuucuauaugcaugaaucucaguaaccauguuuuaguuaaauaacaccaguucccaacaacucaguucaaauuucauuuagaacaguauaacuuucaguaauuguauaaaguacaaacuuugcugcuagcuccucaguccauaaaucacucuguagaaacauauguacaucguaaucaugaccaaucacauugcuuuucuuuaauagucuguuggugauugguuacuauaugucugucauucaguucacacagagacagcaaagcauguagguguguuuccuccuugucucccagugauaacgugauguuuuacaaaaauggauaaucaaaaggaaauggaccaaaagagauaaaagcgcagccaagaaacaaaaagugaaaaugcugaagugaaauucugggaaguguaaauggaguauagaagaaauagcugacugugggaauauugacacugcuauugaacugcugucauuuaagagacuccagauauacauccagaggagguuagggaaggugaacuuauggauauaaaugaagaaagugaggagguuguggugaaaagaugaagccguuucaggggaagugacccuggcaaaaaguucacauuaaaggaacucuuggagauauuucaugacguugaaaauguaaaggauaaaauguuauaaacucauccagauuuagaaaagugugugacaauuuaucaagguauggaaagaugcucgcugcauuuuguaaguuauaugaugagaaguuauaugagaagacuagcacuguuaaaccugcuucugauaaguuuuuuccaaagaaacaacacacuuuaucagcguuucuaauguuuuaaaguauacuaaauaaacauuaguuuuacuauuuucaaaauuguccuuuacauuuauaccugucaauaagagaguuuuucauguuuugacaaaaaaauuugaaaggucacagaaugauuacaacuuuucccaucuguuacuaaggcugcuuugcacaguuuaaguuugcguuaucaguuauaugaccccacauuacugugcaaaguaaagacugccuguauacuagcauguggcacuucuaaguuuuauauauauuuuaaaguuuauauauauauuauuuauuuuguugcaugcauauauuuugauuuuaaaauaucuuuuagcaugcagauaucccaaaccugagauugccauugugaagcuugcgaaggaaguauccucagcagagaccccugauagcuuugguauaguacagucuuacaguguugauugcaaguagugaagcaucuauuugauggaacuucuugcuuguuugaaauagacugccuaauuuuucuguuuuugcguuaguguuuuugacugucuguaugauggaacaauaacugcaugcucaacuaacugaaggauuaaauuuuauaacuuuaagaaaaggcaaaauauuuauauuuaauuauauuuaaauagaauauuuaaaaauuguugaaauaaccauagcaagugaaacauaagaagcagcaaagucuaugaauuucuuuaggacaaaugaguagguaaaaagggccacacacaguggaaccuucagaauauugcgaagagagacuguauuuaaguacaaugacuaaacuucaggaaauguucaguauuuuaaaaauauauuuuugaauaguuugacagccuuaaauaaguucauacuaaggucauucaugaaaguuuuuuagauucauccaccauucagcuugauaucuaacucagguuacaugcuacggugaugguagaagugugugugugugugugugugugugugagagagagagagagggaaagagagagaguguagggguauguuaugaaagagggaguggugagagagagagagaaagauuaaaacaaauaucucucugucccuguuuuauuuguuucugauuacuauuugauuuagauacuuugccuaagaaguauaacacaguguaugaaagggagucugaaauauuuuguggaccaauugaaauuuuguagggauaagaguuaaauaaaacucagacuguauguauaaugucaggcaaaaauagcaaaaacuaagcuguaagaacuuuagagaaauauaggggcauaguguuuuuacacacaugcacacacacacacacacacacacacacacacacugauguauuaguacauugucugcaaaaauaccccaguauacucuuacuuugccagcuccaauauuaaaaauuuuaaaucuuaguuugcauguagaaguuaaacauuuaaugcaaauguauuuugaagaauaaaguguuaauuuugaaauauucugaagauauuuuaauuagcccucaaauacuuauuugauacuuauucaaauuuauucaaauaaaauucaaauuuuauucuauuaagaauaagauacuuauucuuauagauaauggcacacaauaucacuaggagaucaggagcugcugaaugauaacugauaguaggacuugccugucagugcucuugccuuuugagacucaguguuugguuauaucccuacuuagaguaguaugcuucuuuaugaauguuuaggugguacaucucuugaaaggaucaugaagaccugaacucauuuuuuguaacauaaaacuaagacccagagggcuuguaaccugcugaagauuuagugacuaauuauauaucagaguagguauuuguguuaggucuuuuggguuuuuaguucggugcuguuuuucacucuaauacauuucuucaguguuagcaguggauuagccucaggcuauaggguauccaguuguuuuggaaccauguaauaguuuccaguuguucugaaaccauccagcagaaaccaccuaauaccuccauucaaaaaacauuuuauuugguaacuaugauguaucauuugauuuucuccucuuuauuuuaacuucaauuuuuuuuuaaaaaaaauguaucugaaggggaauuacauuuuaugaggggaaaaaaagcaauuugaaaaggauauuaguauuuuagcuaauugcaguuuuauuucaauuucaaauacuaaugaauaaccaguguuuugacaauguuuuauauaugcacauacaauugauucuugguucuuccauauuuuucuauugagaauuuauuaacugaaugagaaguagaaugggaaaaugagaaucugaguucuggaccuagcugugugucuuugaguaagucacuuaacaucugugggccuaaguggcuacaucuucaaaguggagaaugaagucaguauuucacagugagugugcuucugguauuugggcuggauaauucuuuguuaugaaguacucuguugugcauuguaggaaguuuagauuccuuaaugcuggugguagcauuucccagucauuaucauaucccagacgacccugcauauccaaaccucuucuaguggggagggaccacuucauauugagaacuacuggcaaauggucucuaagaauucuuucagcuucaacauucugugaaagaauucuuauuuggggcaugauugaaaaagaagguaauauaucauacaccgaaaaaccucugcugcuuccuggauacgaaacaauuuuauuuuaaaaugaauaacuuuuacgaaucuguguagcccuacucacagaucuaccauuuaugauguuccaagauaaauuauuuuauucuagcuugccuuaggcuuuuucucuacaguauuauccauagcuauaugauuuuuuaaacuaaaaauuauauaguaccaucucuauaucuaauaaguaaaagcaacaagauuuuuuuuuaaguuguacuauuguuuuaauaucuuagccuuuaaaaaaggaauaucauuguauauaguaauuauuuucuuuaucuuccauaggcauaaaagaagggaaggaauauaauuuucuguguuuagaaguauauauaguuguugaagcacacaaguuauaugugugaaacuacaggucaguaguauaucugauuauccuuaaaaaaaaaaacuaccaugaaaugcaauaagaaaaauaaauuauuggccaggcacgguggcucacgccuguaaucccagcacuuuuggaggcugagguggguggaucaccuaaggucaggaguuugagaccagccugaccaacauggagaaacccuaucucuacuaaaaauacaaaauuagccagguauggcggcgcaugccuguaauccuggcuacugccuguaaucccggcuacugccuguaacccuggcuacugccuguaaccccagcuucucgggacaccgaggcaggagaaucgcuugaaccugggaggcagagguugcggugagccgagaucacgccauugcauuccagccugggcagcaagagcaaaacuccgccucaaaaaaaaaaaaaaaaagaaaaauuauuguaccucuaguauuuacuauuauuuaagucagaguuaaauaguuaauagggaugguacauuaauaugguugauaaaggugaugauuaauugaauacuauaguuuacuuugugauugcuucuggccaacuccuguccucagcuguuauaccacuggucucaaccagucuggaauucauuaguugcuucuagguaacagguugcagugaagucccagguugcuugguaaguucccuggaagguuaacaaugugacaguuuuaguucuuuuauuuacuuauuuauuuaauuaaaaaaucaauaguuuuagggguacaaguaguuuguaguuaccuggaugaauuguauagugaugaggucugggcuuuugguguacccaucaccugaauaguguacguugugcccaauagguaguuuuuugucccuugccuuucucuugccucuuccauucuaagucuccaauuuccauuacaauguuaguuuuuauaagauauaaguagaaauuucuuuccuacauaagguauauguugcaguaauuacuuuuaaaugcuaaauaaaauuacaagauuacgcucaaaugccuuuauggguuuuacguaagacauauauauuuagaaauaauuaaaaaguccuuuuacaauuaaaauuucuguuuaaaaagacagguuaauuaaaaucuacuaaauuaaaaguuaagcucugcuguuucuaaagagcuuaacuuuagaaagcuuaacauucauuuuucaauuuugaaugucagguuuuguaaguauauaacuuggccauauuaauuuguuucuuuuuaaaaaaaacacugcuguguugcuuuauaaaccacuuuuggugcacguuagacuuuuuggcauuugauuugcuuaaauuauuuuacuuauaacaugguuugcauuuuaaguuuguauucuuuaauauguuguauauuuauuguaaauuuuaccuuacucauuugaacuuuugguucuauuaaaggacuaagcaguuauucauaauguucagaauuguggguaacugagacccuugguccccaaauuguugcugaaacucacuaguuuaauaucuauuauuuucauaaauuuucuaauuaggccagacugugauuuguguugucaugucuacuuccugcacuuuugugggaaagauauuagggugaguuuggaauaaauauuagguggucaaaggucagcaacugcauaauuagacacuuaaagaauacugaguuauuuguaauaaaggaauaguauaugcauuaagcuguuccuuuucugucaucucagggugaagcugcuuugguacuuuucuuauuaaguuuauuauaaauaauuuggauuuuuaccuucauuugugauuuuuauauugcuuuuuacauccaugauaauaggcugaaauaucacguuaagagucauuauuuccaugaaagcauaauaaaaaaaauagacuaggaaauaagacucuuucuuuuucagauuuucuuuuauuucaaguauggauuuacacacccuguaaagugugugcuauaguuucacucuguguccccacucaaaucucaucucaaauuguaauccccaccugucgagggagggaccugguaggaagugauuggaucaugggggugguuuccccuaugguguucucaugauagggaggaaguucucacgagaucugaugguuuuaaaaguggcaguuuucccugcacgcucugucucucuugcugccauguaagauaugccuugcuuucccuucacccucugccacgauuuuaaguuuccugaaggcuucccagcuaugcggaacugcaagucaauuaaaccuucuuucuuggcagggcacgguggcuuaugccuguaaucccagcacuaugggaggccgaggcagacggaucacgaggucaggaguuccagacaagccugaccaacauggugaaacccugucucugcuaaaaaauauacaaaaauuagcuaggcaugguggcaugugccuguaaucccagcuacucuggaggcugaggcagaagaaucacuuaaaccugggagguggagguugcagugagccgagauugcaccauugcacuccagccugggugacagaacgagacuccaucucaaaauaaauaaauaaauaaauaaauaauaaaccuccuuucuuuauaaauuacccagucucagguaguaucuuuauagcaguguaagaauggauuaauacgguaauguuaaauuuaauggaacauucaacaugaaaaugacaaauuauaguuucuauuaaauaauagagcucacucuauaugccauuagcccuguuucuguguuacagcaucaccauuguuguaaacauguuuuguaauuuuaugauggaggcuaaaauguagaaacuauagguguugcacauuucuuuuacuaaaaucuauugcuuuucaauuuaggauguaucucuuaguaguguuaaaagauaaucuuuagaaaaauuaaaguuagcaggauucauuugaacaaagagacaacucacguguugggcagcucucugaaugcuuacuggugacaaaccagcacagguuuagagaguuccucccagcaacacaugggcaggcaguauuuauagacagauagaagugcuauacagaaacagccuuuuguuuacaaguugguguuuuccuuauuuggacaugucugagcaguuugcagccugucauuggcugaaaggucagcuccuaugauuggccaaagcucagcuacuuguuacaagaauauacuuugagguagguugcaguguguuuacauaugaaauuagauugcaguuugcuacauauggaggcagcucuaggccaaauuuaauuuaacaauuucccccuuuugaucagucucucaauuuugagagauugaccaaaauuuugggcauugacaccauucuuugucacucaccaucauaacagacuugcuuggucucuauggaauucacaauuguuaaugucagguaagcugaacguuuauguucucuucauguuuuuauuguucuaaccauagcgaggccauuugauauauauuguauggcuauacaugagcacuuaauacucuagagaggauaugguguaccagggagacuauuauggcuaucaggaggauaauacuaagagacugaaguauacuucuuaacaggagcuccugucaauugaaccaaucaaaaucaaauauauaaaaaaugagccaaaagaagaaucuacuuguuuuaacaaaguagcuuacuuaaugauuucuggcaacugacuuucuaucauaccagauauauuuaugcaagugcagcaggagguguuagcuauugcaugcagucuucuuuguucagacagcagaguccaaaggaaugaugcugucugaaacaguuuuagcaagagaauuugaagaaguuugcugggcagcuauagccuuugcaguagagucagcuguaguagcuaauguuugagacaaauuucuaaucauaaccucauuuacauuuaugccaagccagggaaggaguauuuuaccagaaaaaauaaaaauaaaaaugccuauuuagagugauuuacaccugcuggcaaauuccccuuuauuuuauagugcaaauuaagagguauagaccaauguucauuuuccaguugguuauggagugacagugauaccauuagaaucccuaaaccacauugguuccuuauuuuccacuuauugauacauggaguuacccacauaugugguugaucauaaaauccuccacagauaaaaauguaucuuggaggugcacaacaggcaguuccuuaugaaaugcuuuguacauuagaggccacuauuagagaagcacuagcaauauuugucuaaggcuccauuauuggaaucauugcaagguuggaggcuacugacaaggaauuaggguuacacauuugccuauaaacugucaaaucgucuuccucugguuuucuuauacaauuucuggcguaauuuaacugcaaaacccucacuauagguuuugccuacuguuaguaacaugacauaucuaacauucaauugcagaagauguugguuaugaaaucuuaauuaucacauuaucuugccauauauaaacagaaaaggaacacaggccaaagaggaaaagaggcacagguuucauagugacagagaagucuugauuuguaaucuugggaaagcuguucacauccaggaugccaucugcuucuggguaaaauaaauagcuuuccuggucagccuuaccuugaggucucugauugguauacagucugaagagucuagagaggcccucuugaguuaagagauguggaucaaagacucgagguccugaaauuuuacugcagagaacauguugguauuguuuuuuccaacagaauucaagggcagucauucuaggucuuuuucaaaagaccuaaacuccugguucuagauagugaaaggucugauugucaucaguuggugggucaugaagggcuucuuuuaccugaugauaauauacuuuggcaucuugcauuuaaaccucucaauacugaaucaagucagaguuuauaagagugguagauacaugagguucuauuaucagggacauaggacuuccaguaacuguuauauaaggggucaaucuauguuuucuaguggaguggaucugauugccaucaauugguaauaccuuugaccaaggccaucaagucaauucaguuagcuuuguuuaaugccauuguguuuguagaaccuuauuuguuuuacaacuuguccauugaagugagcuuuguuuaaugccauuguguuuguaauaccuuauuuaauuguuuuacaauuuguccauugaaaugaguaacuuuaucacuggagauuucuccagaaauacccuauaaaagaaacauauuuucuaauaaccuuuuaauugcucuuacagcaucggccuuaugugcaaucagaaagcuucuauauaaucauaaaaccuauguuaaaugugguaauugaaugaaauucaucuguaaguggucaaaugauucauuaggugcuagaaauguauuaccugagguuuuuuauuaucuuaccagaauuauggguuugccaaaccaaacauuaguuauaaaccacuuuagcaaucuuagaacagucacucgaacaauuuuucccuguaauuuggaucauuuuaucucuucugugaugagucuuggagugcagagcuuuuaauaauggaaguuuucaggagucaggaaugaccaggcagcuguccaggcuuuccaugagcccaugcuuaacauuggauuuauauccuuuuaaauaacaauuuuauuuaucuaauucaggugcauagcacuuguuuauuauauagguuaucauagauaauuugacuuggauuaaucucauagaguucguucaaauugcauaucuuaacaauuucaguacuggcugaacuacugugaaaaucugccaaggcauuuccuuaguauuuaauuaauucuuguucugcuuuauguuggguuagcaguuuuaugaaccaaugaguuucuuccuuagaguucuuggacucaguccaaugguaugaucuuaaaguuaucagaaacuuguacuucucagaguucuuuacaugaaucuccuugaagauguaacccuuuaggcuuauaguugcucaggaaaguacaagaguaaauaaccaaauaugaaugauaaaacuuacaauggccaugauuaaauaucugaugagaguucauuacagugaugauacaguugacagggaaauuugauuauuucuguugcauacagcauuugaauauaauaacuagaaugaugacugauuguauuauaccagaaccaucagauugcuaugaauuucauacaguuucugaaacacauccauacaaaugaaacucaaaguuuagcauuacuuauuuggcaauacuucucauauaauuuaauaugucaaauaagcccaguuaguuuaauaucugucuuuuuauauaaggagaagcauucuuuugaaugcuuauauacgagauguuucaagggcuugaccggaaaaucaaaguugaggucaaaaaaaaaaacuuuauuaagaaucuaaguuugggaaauguguuaaaaauaucaaauguuuaaaauccgugauuaaaauaggguuacaggucacugugaacaguagucauucauuuaacaaaagugaaaauuacaagacuagacuucaaagguaaauacagaaagcuacauaguuguagagaaaacuuagcucuaaauuuuaauagagaauauuuuguuuucuuaaguggucaaacacccaauaaaagcaacauggaccacaagaaauuacuuugguaaaacacagaaucuguuuccuagaucaauuaccuaaaagguaaagaaaaacuuuucacaauuuccuauuaaaaguagaccaguaguccaagaaauucuuacuguuuuaacacagggaaccaaauucuaauuuuguauuaguauacuuuugguauuaaugcucaguuuuuagaaaaacugauaaauaauucccuucuaaucuuagcuggcuuugucacacauaaaauucuuuuuacaagauucguccuuugcaaaccuacaacuuucuucugcauuuagauuuuguuuuauacuuuuccuguucucaucuugggaugaccagucauucuacuuucaaacaaaaauuacauuuuucccuuaaugaaacaaaacagccucauacuuuauagcuuuugcuuaccaaaaucauguauuacuuuucuuuuauacuuuauauaaaauuauuucucuuauuucuaguaauuuuaguauauauauuaauuagaauucugaacucuuaaugacuuuaauuuccaaaggacacuaggaagcaaauaauugugaacuauuugucacaccagccaugugaagauuugcaaaucuaugaaucauaauaucuggaagcguguacuuucucauagcacaguuugucaguguggcacagaacauguuuacuaauggccccaaguaucuuuagucucuguaauaagaaacuguagaagaagcaaaauguuaucuaucuucuuuggauuuuuggcuaggccuauuugugcacauuuuucucagccuuaaauuuccauucuugaugauaagaauguuaaaaccuucugguauagggaagacaucguucacaugggacuuuuaucucuauuuaacucacucguuuuuaauaauuaugcuuggauugcuuagcaagaugggacaucaaacagcuagucaucaucuuaaguuacuuuucuugcugaugaauuuuguaauguagagauaacauaaguuuauuucaccaguaaaccuagguaggaaaagucauguaucuguguuaauuuuaauguuaaugacugugaagauaugucuguuuuaaucaaaccaauaauauucuuauuugccaaagauuacccaagucgugugagcuucaaaaaucauuugggucauuuccuauuuuucugagcaaauacuucauuuaucuaagugcuuauuuuucuuuaagucaaauagauagcauucuuauacacuuuaauuuggcaauaucauaaggaaauagaaaauaucacacauauauagauauacaucauagaugcagacauauauaaacagaaacagaucuuacaccuuucauuuaaaacuuuuagccauguuccacauacaauaauacaacacucaugaauuuauuaaagaauacauggauccaaauuguuuuucuggccaguggaauauuuccugcccagauagcuacaacuuuugaaugauauuugugaaaaagacuuuaagauguuuuuacuugccuucuguaaagaagcuuuugaagaggccgucuuugauuuauuuuuuaaaugccucugcuugccaguuaaagaaugcaucccauugcuuuuguggcauugggauccuuucuuuucugauacaccucacaagugagcaauuuaaucuagguuaaaacuucccuauuguggccacuguaauucuaaguuguccuuaguaagauuaaggacauuuuuuuuuuccaaaaauacacagguucugggccuguaauuuuucucuauaaaguuagccagugucccagaagguggagucccagacucuuuagauuuaggggaaaccacuuugaaaagguaccuaccugaguccuccaacuggauccaauccaauccaauccugaaucccaucuaguaaaaaaugcucaaauaaagucagugagcucaaaacucaaauucaugcugcucaaaucagagggaucaaugugcacaauuggcucuggcccuuugcuuggacacuuggugcuccuggagguauacuucagaucucacuuuugaugccaaauugcuaaaagaaaaacauuagacagauuaaauauaacaaaguuuauuugggcaaagaaauaacucaugaauugggcagcacucugaaccuuaaaagguucagagagcuucauccagcaaugugggcagacaguauuuauagauagaaaaaggaaauuauauacagaaauaacuuuuuugcuauagcuugugucugucuuguuuggacaugugugagcaguuugcagccuguaauuggcugaaagcucagcugcugugauuggccaagauucagcuacuuguugcaagaauauuuuauauauauauauauauauauauauauuuuuuuuuuuuuuuuuuuuuuuuuuuuuuuugagacagagucuugcucuguugcccaggcuggaguacaguggugcgaucugggcucacugccgcaagcucugccucugagguucaagugauucaccugccgcagccuccugaguagcugggacuacaggcgccugccaccacgcccagcuaauuuuuguauuuuuaguagagacgggguuucaccauauuggccaggcuggucuggaacuccugaccuugugauccacccgccuuggccucccagagugcugggauuacaggcgugagccaccaggccuggccaagaauauauucuuaagguggguugcaguugguuuacauacuguaucagcuuacaauucacuguguacucaggcagcuuuaggccaaauuuaauuugacaguagcauaacuuauuuaaaaaagaaauauaucaggcauaguuuauccuaaaaaguauuuuagaugcuuuuguuaauauuggacugaagguuuuuuauaaagaaguuauuuuuaaagggaaguauaauaaagaggagauauacagguuaaaucuuauagugaacauucagacuuguuuuguucuauguauuggaaucuuguugucaauuaaaauaaguuugaaauuguugcuuggaacuuucuuuuaaggauuuugucuuaaugacauuuugccugcauucugaaaacaugaaaauaugaguguaacauuaaaaaaauaaaaaugcagugagauggggguaacuugacauacuuugucugcgaugaauuuugcagaaauaaaaaaaaaccacccuuacauauauucucucuugcuguugcucuuucucacucuuugguucaguaaugccacuuauaggaaucuauucuaaggaauuuucagagcagugcaaaauaauuuagguacaaauuaauguuauuugaaaguaugaaaaguaacaaauaucuaauaauaggcuauuaaugaaaugacuauaucauuaaauacacuuucacaaauaaaauuauuuucuuaaaaaauuuaaagaugugggaaauauucauuauuuaaugcuuuguggaaaaggcagaauacaguuuuguguauauaucuuuauaggaaaaagauugaaggacaauacgucaaaacauuuauuucugauaaacuguggaugcuuuuaaguuucuuuucgcuuuucugaaucucauuaacuuucuauaauuauauaaucuuuauaaugaaaaauaaaccaaauaaauuaaguauuuuagauguuauuuucuaauuuuuaccucaaaauuccuuuuaauaaaaaacaaacucaauauccucauccuuuuaacauaugcaacuaugaguauaagaauguaauacuuuuauauaaaaauggcuuguuuaauguaaaauauuugcagucaaaccccuauuauaacaaucaguuuugacuaaaaugcggagucaaaggaaaaggcuuuguugacuucuuaaaacucuacuuccucaugaacagauuggagagucucauuucaaacaauuuucauuugacuuacuacagcauaaaucagcaguuuauaguaacugucuuaucuuauuuaaccuuuagcaaagacuuuaaaaugugaaaucuaaaggaaagaaauuuauauguaaauauuaucucauggauucuuguagauaauuuuucuauccuauguauuucuucacauggaauccuauuaagagcaacuuuuccuucauuggaaaaugucuaagaaagaggacauguaaagaaguuuggauguugguuauuuuugccacuauuaugaauaaacucuuauacuucggaaagcagaauauuuauuaugccauuaaggcuuuuuguucuguguucaugaggaauagucaucugguuuucucuucuuuguaaauuucuugguuaggcuuuguuuuuaauguuguucuguccucauuaaaugaguugaaaauuauuuccucaucuauuuuuuggaagagcuuuugaguuuguaggauugauguuuuuucuuuaaauguuuuaacaaaauucaucaaugaaaccaucuagguuuggaaggggugugugugugugcguguguguguguuuacauauaaaguuuuuugguaacaaauaaauuuuguuagagcuagucagauuuuuguuugcuuaaucugcuaguuuugguagguuauauuuuucaaggaauuuguccauuucaccuauguuguugaauuuuggguguaacguuuuucauaauacucuuuucuuuuuaauaucugugggaucuguaaugaugccccuucuuucauuccugauaugaguaauucuuauucucuuuuugucuaucaguauagcuagagucuuauuaauuuuauugaucuuuucaaagaaccaauuuugacucuuuauuguuugcuuucuguuucauugcuucuuucuacuacuuaguuuauguuuacuuugcucuguagcuucuuaagauggaacuguaguuuauuuauuuuagaccuuucuucuuuuuaauguaaguauuucaaacuguaaauuucccccuaagcauucauuuagcugcauucuacaaauuuugauauauugcauuuucauuguuacucaguuugaaauauuuucuaauuuccuuuuugauuuccucuuugguccauguauuuagaagauguuuaauuuccaaauuuguuuugucauauaucuuauuguuacugauuccauuauagucagagaacauauuuaugauuuuaaucaaauuuauuaacauguuuuguggaucagcauauguucuauuuugaggaaugugccaucugcacuugaaaauaagauguauucuacaguuguugagugucguuuuguauaaauaucaauuagaucaacauaguugguaguguucaaguuuauaucuuagugauauuuuugccuaguuuucugucaauuacuaagaaaaaggcuuuuauaucuccaaguaugauuauggaaguguuuguuuugcccuuuaauucuguuagauucagcaucgugcauuaugaaauucuguuauuaggcauaaacaugcaguuguuaugccuccugaugcauugacccuuuugucauuuugaaaugucccugguuuauuucugguaauacucuuugucuuuaagucuaccucaucugauauuaauaaagcuccagccuuuauaagccuacuguuuguguagcauauuuuuugccauccauuuacuuucaaccuauuaaacuguaauccuugggauaucauauaguugggucuuacuuuuuuuguucguuuuuguagucucugcauuuuaauugcaguguuuaguccauuaaaauugaauguaauuauugauaugguuggauauaaguuuacuauuuugcuauuuguuuucuguuugacccucuguuuuuuguuucuguuuuccuuuccugcauucuuuuugcuuaauugaacauuccuucagauucuccuucaaguuacuuauuagguucuuaacuauguucucuuuguauuucaucuguauguguaguuacucuagggauuacagcauguauucuuaacuuuuugcagacucuuauagcuaauauuggaccauuuuauuuucaucauagaaauguugcaacuaaauuaccaaaucaguccauuuacugccccguucauccuuaauguuaugaugucauauguauucaucuacauauuuuauaaacacuauaagacaguguuacaauuuuugcauuacacagucaugucuauuuaaauuaaaucacuaggaaaaaguaaucuuuuauauuuacccagacauuuaccauuucugaugcucuuuauuccuuccucaagaauuuacuuuucaacugcuauuucccuucagacuaaagaauuucucuugcacuuucuguaucgcagguugacuguuaacacauucuuauagcuucaguuaucugaaauacauuuugccuucauucuuaaaggauacauuuuuggauguagaauacuggacugacgcccauuuucuuucugcauacugaaguuauuuuuuuguguguuuaauauguauuuaguucugacugcuuucaagauuuuuuccuuuaugauaauuuuccuucauguuuauuccacuagaaguucacugaacuucuugaaucuuuugaaauuuuugucuugcacuaaauuugggaaauuuguagccauuauuuauucaaagaguuuuuguuccuaguuucucuacuugccuuuuaauuacaaucauacauauauuagcauauauuagcccuuuuaauauuuagccauuggucccugagacucagguuuauuauuuuuucaauccuuucagucucuguuguucagacugaauaauuuuuauugaucugacaucauuuucacuaacucuucucucaccuucauucugcuuguaagccuauccaguuaauuuuuuuuuaauuuuuaauuuucuuucuuuuuuuuuuuuuuuuuuugagacggagucuuguucugucgcccaggcuggagugcaguagugugaucuugacucacugcaaccuccaccuccuagguucaagcaauucuccugccgcagccuccugaguagcugggaugauagguacccccuaccauaccuggcuaauuuuuguauuuuuaguacagaugggguuucaccauguuggucaggcuggucucaaacuccugaccuugugacccacccaccuuggccucccaaaaugcugggauuacaggugugagccaccgugcccagccccagcuaauuuuauaauuucagauaauguaucuuucaguucuagaacuuuuuauugguucuuuuuucgauauuuucuucuguuucucugaugagauuuccugucuuauucauuuaagcauauuuuuauuuacaucuuugaauacaauuuuaauugcuccuuuaaaguuuuugucugcuaauucuaacauuugagugacuuugggauuggucuguauugucuucugaaaaugggucacauuuuucuuuuuccuuguuugugaaguaauuuuguauguauccuaguuauuccuguaauugcuacauuguagagacucuggauucugucuuguucaucugaaaagcauugauuuuuguuuguuuuagcaggcauuuaaugguuagguucaaacugcaaacucuugugggaugccuucaaaucuuuacuuauuuugcccuuagucgguauuuuuggaguuuucccugcacaugugugguuccacaagccagcuguagacuugaacugaauguaugcacagaauuuaggacucuuccuuucugacucuauccuuuccaggauuccucucucacuuucuaguuguuugguuaccuggcaccucauccucugguucuucagacagagacugaggaauuuucaucagagcuuuaguugcucugcauguugugacuggagccugcccacaggcugaaagcugcaacaaacagguaacuaacucacuuagugucauuucuuuuucuguguugauuccccucuagaucaaccugguuucaauaauuuuccagugcuuucagguaguuaauuuguuguauuuuuguuuguaguuugugguuguuccaugcaggagaauuccucugauaagagguuacucagccauuauggaaaguaauauggcaaaugugguauggugaaguacaagcuuaauaguuaucuuauuguuuuaaaauauccagaaaaggaaaagaguaugauguauauaauacacacagacacacacacacacacacacacacacacgcacacacacacacagauggaaagaacuguuuuaacuccauaguugauuuaauaaaacauuggagcagaacacauuuccaauguaaguguagauaguuuauuauaugucaaaagaaaauucugaaauuaauucauaaaauauauauauauggaaauaaaccuucugggauguauugugacuauuuucagggauguuauacuggcaguaauuacauuuuaaaacccauacagaucacugaaaccuugggcugauuuacaaguuccguuuuguauuuuauagguaauuuuuuuuuuuuuuacuucugauguauguuuuguuuugauucaguuaacauaagaaagaauaacuucugauuuuaaaaaaaauugggcugggcaugguggcucacgccuguaauccuagcacuuugggaggccgagguggguggaucaccugaggucaguucgagaccagccuggccaacauggugaaaccucaucucuacuaaaaauacaaaauuagccaggugugguggcacacaccuguagucccagcuacucgggaggcugaaacaggagaaucgcuuaaaucugggagguggaggcugcagugagccgagaucgcgccacugcacuucagccugggagagacagagugagacuccaucucaaaaaaauaauaauaauauaaaauaaauuaauagauacuuccuaauaagauugucacuuucuaggaaauguucuuuucaugauuccucuuguacucuguagguucuuugugaagcaggaggcagaaucuguguuuugauuuuacuuucaccucugugccaguaguuuuccucccuguuguaucuccuuuauuuuauauuucuuucucuuaacauuuguuauugccucugguuuuuaauuuuuuauguguaguaggaaagaaagaaaggaauauugauuacauuauuugauuuuuuucuuuauuacuacacguuuuuuacuugccuagcccuuaucuuuucuucuucgcuguuguagaauauuuuuaauguuuuacucaaugaguugggaauuugaagaaguaaaagcaaggacuccauauacucucauucuacuggggagguccugcuuguugaauuuuuagguauuucaagauguuccagucaacugacaaggacuucucacagugucagaacuguagugaugaugagacuaaugcaacuaacaaauaguucugguauguaaauaaccacuuuugcauguuuacuucaccagaaaauucucuggaguauagcaguauccuguauucuuaguuagaaauuuggcaaaccacuuggaugcuuucaaaggagauuuugaguuaaugaugcuaaucaaaaauaagaauauauuuuaaucagaugugaaauucuguaagauuaguauauauaucuucauuucuuaauucuucuaaaaaaggaaaaauaaagcuuaaguuugcuucuuagaacuuucuaaauacuaugaaaguuaauuaaacucgagguuuuaguguauuucuuacuguaaagccauuauggaacuuggaaaauaccagucacuaauguggaccauauuuccuuuuauguagguuaucaauggagauuugacuuuuacuuuuuuauacuaaauuccuuaguucuuuuguuguuauaaaauauaaauaaauauuuuugaagauguacaucuaguuuguaaugcguuucuuuggauaaucugguuguacuaaaucuuuagagugauccacucuauggguucuucucuauaugauaacaauuaauucuguccaguugguugaucauaaagaagguagaauuuucuaccuuuuuaccuuaaacaaauggugagaugcuuauuguuauaagaccagguaggcugcugccuguaauaauuguuaauuuuuagguauaauguugacacguaaagauacucucuggcuuauacuugggaaaacuuuguuacuugugauucugaacaacacccuacuuuuaaaaguuguuuuaauguauggaauacccuauuauccaguguauagguuccaaaaguuaaaauauucaguuauauuauauaucaauauaauauaucuuauauauuaauuaauauauaucaauauuauauaauacuauuaauauauuauaaaaguuaaaauauucaguuauaucaacagagauuaaggaacaaaauacaauucagugaagucauuguuuucauacauugcuuuaaaaauauuuucuucauuuuaaagauaucuagaucuauuugaauauucauguuuuccacuaucaaugaugcuuguuuguguauuucuuaagucaucuaggguugccaucugaaagaagaguaccuuuauuucuaaaguguuuuucuaguguaauuaaugcaaacagacucauuaucuagauguaaggacuuuaaagaaaucugaaaaacaaaaaacaaaugaacuuacccagggcuagaguccauguuaagcuuguaacuaagcucaguuucauuugcuggccuucugauuuaauccauacugauuaauauuuucuguauggacaaauguggucccuuaaccuaaagauaauuuaugaauaaacucugauauucucccacguuguaaaucuucugguauuuucuucauuguaauaaaaaauaucacgcuguaguaacuaauucuugccccacauccuuuuucuccccuuuagaaaaauuggaagcuccaccacccaccccaggacagcugagauaugguaaugguucuauaauuguuaaauauauguucaucugucuuuuggccuugaaauaacuguaucauucauugauagcacagaagagucaguaaauuaaaucuuuccagauagaguggauuauccuguucauuauaugaagcacaaaguuuauaaacuuggcuaaggauguaacacaauauuguaaaauaucuaauauuguuaaaaauaucuaauauuauuaaaauauuguugccauuuagaaauagaauuauuuuuaugauagaaguuuucuuaauuucuaggaaaaaggauguauuuacuuuaguuugaauuuaaguuggguaaaugcagaacuagaauuucuaggcccaaggcgagauacaacuguucucugguagagaaaauguuuccggcuggcuguuuguaagaaugaaaagaauaaaguuuauuuaaaacuacgugaagaaggaccuuauuacaaugcugcuaguguucuuucuuuucucuauuaugauaggaauaaauauucaagaauauaccaaaauaauguaaaacaaguugggauguuauuauaaagauggaagaagugaauuauuuaacaguauagugaauuagaguagguuguaaauuaaagcuaaauaugaaacgugauuugcuaacaacuggcaaguuauagaauaguguuucugagaguaaauugaagaagccacaaauuaguaggagaucauuauauacuagagagcaaauuuauauaauuuuuaaaaaaaccuaauggccaguuauuuuuucucugacagguagaauguaauuuauauuagagauuaguaacuuuccucaaauaccaaaacaauuuaaaaauucuuuaacacuuguguucccaaguaauuuaugauucucccaccuuagauucauacaaucuauaguucauaauacuguauacuauuaucauuuuuuguaggugguauugaaauuuacuguuuguauggcuguguuaucauaccuaaaccccuuuagggcugggaaccaagucuuauuuaucuuuguaucucaggugcccaguggagugcucuguacauguuuauuuaacuuuuugaaaaacuauauuuuuuccuuuuaguuaaaauaaauuauaauuuuuaggacauauuuauauagguauaaacacuaaaaacauacaucguauaguucaaagugauuguuuguaacagagugccuugguuuuacugaccaaguuuuuacuaagauagcaauuaguguaaucuuaacuuaaugggcuuaucaccuaauuuuaagauauuuguaacuggccaguuuuagagaugcuauuaaaagaaucccaaaaugcuaauuaauccuaaccaguuucaucauuauuuuucaguacuuaaguagcuuucucuucacuguaaauguuuuauuuagugauuuuuuagaauuucauuauacucuucuaaccuguuaaauuuguaauguguauugguucuggaagcugcuuuuuauaaaauuuugaguguucaguaaauaaccagauuuaggcaauaagugaaaaaacuaaggcuagacucuuuaauugaaaaaaaaucccauuuuauuaauguuuuacuugauuuuuacaaccuuuaauaacaaauaauauucuuuguaauuaaaaauguuguccuugaucuuggacauuuuuacuuaaaacaagacgaaauuuuaaaugaccuauuuuauaccuauuauguacugguuuauauaauauuguauagcuauaauaauauugaauauaauaguauucuuauacuguauauaguauugucccguggucuuagucauuuauagugguuguggguagaagugcuuuuuuuugagugcuuauuagccuuuccugcuaggugcagagcucaauauaguaauaucgaauuuuuauaacuucuggauuauauuucaauuauacuuucuguggagauaacugcauuaaaagaaaaaaagacucuaaaaauuaauagacacauauaaccaguugguuuaagggauuauuuuuuuggacguaguacaaaacucagcauuuuaauguuuguugagaaaaguccucaguugaacggauguucacuauaccuuggcaauuuuauagauuaauuagaauaaagucuuuuaccuauucccagcuuuuaaucuauuucacagucugccuucaauucucccaaucuggaauucucuuccuuuccagguuaguggucuucaacuuaaugaaauaauauuuuuugagcaucuaccaugcccucaauauucugcugaagauguaaauaugaaagaaaugagaauaaauguauaaaaaauauguagguauuaguucuuccuaguuacaauuuuuuuuuuuuuuuaagauggagucuugcucuguugccaggcuagaguucaguggugcaaucuuagcucacugcaaccucugcugccuggguucaagugauucuccugccucagccucccaaguagcugggacuacaggcacgcaccaccacacccagcuaauuuuuguauuuuuaguagugaugggguuucaccauauuggccaggauggucucgaucucuugaccucaugauccgcccgccucagccucccaaagugcuaggauuacaggcgugaccuaguuacacuucuaauaucucagaucauugaauuuauauacccaauagaugaaguaagguguguuuuugguagcaagaggugaagugauaguuugauuuaaaucaaauauugauuguuuauaguuugcaauagcauuugggaauauugaugaauuuugaggggggaaaaagacugcacauagaugagguaauauagaugagauaaucaccuuuuucuaacauuucuuuaaaaaaauuaguuaguaaaagcacccaaauaacuuuucugacauuugauuuaggacauuuucauuauuucuaauacagaaaucgauuuuauaauaucagacuuuagucauaauagaaaaagagauuaaugucaguagcaaucagguaaaaugugguacucauauauguuuacuaauuuguucuguuaauuguauguauauauuuguguguguguguguguguguguguguguguguguuaccaguaagaaaacacaaaagucuaacacaguuauuuuuacauguuuuauacuuuuucugguuuguuuuguuuuuucccaauauaguuucuacuuauagcaguagcagcaucuauuggcucuggaaaaugagaaucaaauucuagagauuaucaagucuguuuaggauacuuugaucauaucaucuguuuuugucauucuaaguuauagaaaucuuaaaauauauuuuucuguuuuugauguuuuucaguauucauccacaaugcgauaccuuucauaggguuuggcuuuuuggauaaugcaauuaugauuguugcuguaaguucuuucucucacugcuucuauuuugaguucauaaauuaauguggucuacauuuuccuaauaauuuuucuauugugauuauaaaguuuuaauaucauaaugaacaaggauauuuuuuacuauaucucagacuauagcucaauuuuaauuaagcuauauuuaauauuuauuaaucauuaagacuuuagguaaagcauuuagacaaauagacuuuugguagagcauucagacagaacauuaaaggccuauauuguccuauucuaauuucaacauucuuaauaaagaaaaauaauauguaaaauguucugauguucuuuaaugguguuggcaauuaucacauauauagguaauuauuugauuuaguuccuuguucaauuuuccaaugugaaaauguuuuaaagcauguuuugauacauagucuagccuucagucuagccauuguuuaaaguuucaauucaauuaagugacuguaucucccuuuugccuuguuccauuguaguguuaaaaaaaauuccccuuuguugugguauuuuaauguaagggugcuccuuaaaccuguuuaagcucagagauggcugacuuaccuuucuuacuacuauauaaggccugcuaauggauaccaauauuagguucauauucuaaagucagaaguagauccauaauuaaaaugcaagucuucaaaaacugcccagugcucuguuuucaagaacauaccaaguguuagcuacagcuuaugaauuuaucauaaugggguuuucauuacaauuagauuugauuuacauuaauuguuuaaauaaucuagccaacucagauuuuaguaguuuccgagaaggcagugugguucuaaauaguugaauaaguuucucacauucacagauacauaaauuggccaguuuuauucuuauauacauauuaugaaaaugccauaaucagucaaaaaacuauucacuccucuuauuuuguccaaguaaaauagauugaucacaguccaguuauuauggcaauuaucaacuuucaauacauauuuuuagaauaccuuaugugaagucauucuuuucagauauuagcauuagauugaagguaauagaucuucaguacauuuagugggaggagaaaaaaauaucauauacuuugaauaccaguuuaugaguucccagguggggucuuuauuuaaacuuguuugagaaaaucgaagugcuucacaacuagaaacuuuucucaguuaggacuuagagaguuuguugucaguuucacugacucuaacuuuuaaaaacauuuuguaaaugauagcuaaaguguaggagacuacugaaaaaguggaaugaccuuaggauuguugaaugugaggaaaauauacaugagagaugcagguuuucuuuuugguguuuuggagaucacguguacuacaaauggacauaaauagaagauuugguuucaaaguaggaauuuuaaaaguaauuuacauuguauagauuauaaaauuuauguaaacaugguuuauucaagaaugguuuuguuugcuauauagucuagccuuauguccagauugauggggaucagcuaccaaaccaaacacccacauucuagagucaaauuauuguaguaauuuguaguucacuauuugguguuccccaggucugugccucauuguuaguauaacuaagagugcacuauuuuuccaggccugagauggcugacuccaaauuaguaauaccuguuauucuguuucuauugaaauccaguuucaggggcuuaugggccauuuuguuuauuuuuucuuauuuuuuuccccagcacauccagaacacagaaaaucaguuuuuauuuaaauaauacugaaauaaauguuuaagccacugacuucaaguuaagaguaguagguguggcaaaaauauuauccugugauagcugcaaacucauucagagacaauaaaauuuuccagugaggcuucguuauauagaaugcugagacuaaaacauauaaauaauguaacuguagaaucuaugaaaggggaaauaagugauuauuaucuuaagaauguuuuucaucuuuuaauuaaaaaaauacugaucaaccccucucauugugggacagcuaugacuguuuuaagauaguaaguugaggagauaguugauucuucuuuuuuuuuauaccauagacauuugauguuuuccuccuuccuguuagguguacuuucccacccuaguuguagucguaaaaacaaauucaaacaaaaacaaagagguguguaaccucuuguaauagauuuggccuuuauauugguugguguucauauuaagccuuuuguuucauaguuuaaaaaauauuuuuauauuauuggauugcuuuuuauaacuuauauuuuaggguuaguuuuggguuacuuuacuuacaguuuaauuggauagaauuuauuagaauucuagaguagauuaauuguauuaaggauaaugaaccagguauaacuuuaagacaacuauuaguauucgguuuauuuauaauuucuaccucaccuauuaacacaaaauuugauguaacuaugggacacaguaaagaaguggauaguccauugcccccaaaccaucuuugacuuuauauggggcuuuuccugcuguuagaaggaccuucagcuguguuacauucaaccaaaugauuaagcacuuaacuauuuuuuaaauguauguauugcaagagauucuucuuuggccacugccagcgauucauugcuguuaaagaugccauauuuauuagacuguuguuaucaggugccucucuucuauauuggugcuccaguuuuuuugcauucagauaugaugauacauauguuuauucuuuuucucugccuguuuuuaccuuuucuuccucuuuauuucuucuucagaaaucuguuucuugggguauauuuacaaccuugucauuugaacuuugugcaucaggacaaaagacuuuugaacuucagugcaucagacuguuggguccauauucgacaagaauuauaucuuaaagugaugcagccaaaagcucuaggggaaagaaacuugaggaaaccucuuuucaguuuuguaaauaauugaugaguaaugcauuauuucuacguaaaauacagggcguuuuuuucccuccacaaauaucauugagauuugaagcauuuuuuagaaauguucaagcaucaguauucaagagaacucuugaaaauuaagucuucuaauggcagcauugcucagggauuagaauugaauuagcacaauagauccuaggauuucuucuuuauucuguuagaauaguuuaauugucuucacuucaguuccuccucuuuaaaaugaaaguaaaauaugagccccucuuuucuucagaggaaugaugauauacauauagaaagucuuaaacucugucauuaaauucaguggcgauacgauggggcuuuguuuugaguguagaucuauuguacuaaaugccguugcugcuuauaaauugaauguauaguuucacuacuuaaugguucaagagcuaaguguuauaaggauaauuuuauaaaccccaauuucccuagaaacugguuuagucuccuuuuaaucuuuugauagaguaaauaacaauaguauagauguauaguucagaauuuaaaaucaaugugagucggucuuguuuucaaagagcuuuaaagcauuuuucucugugguagaaaaauagaaauucuagauuuuuaaugaugaacuauauuucuacauguguugcuaauuuuauuuuuagaagccuaauuugaaugaauaaaauguuauugauguuauuucuguaugaaugcauauauuuaauaauuuaaugaauuacuauauuauaugugcauauaugauguauguaauuuugcagcacuaacauguugauuuaacuuguaucuguuuuuauuaaugcuuugcuauucuuuuauagucacuucagcuuuaauuuuuaagauuaauuuuuuaucauauuucagggaacccauauugaaaugucuauuggaauuauuuugggaauuucaacuauggcagguauuuaacaguaguaaauguuauuauuucauuguacacuuauaaaacauuucaguagauuaaguuuagaggaggguaauuuauuugaaugaguuuacucauugagauaucuguuaauuuucuucauccuauucuucugauucuuaguuuuguacauguagcacuuuuucugaaaauuuuagguacuuuauauuauuaguuauuggauaacaauacucugcuauauugauuucguuaagacaagauuuucuggcaauucaguguuaccccuaaacauuucuacccuuggucucuuuuauuuauuuauuuauuuauuuauuuauuuagagacggggucucacucugucacccaggcugcaguucaguggugcaaucucagcucacugcaaccuccaccuccagguucaagggauucuccuaucucagccucaugaguagcugggacuacuggcgccugccaucauuccuggcuaauuuuuguauuuuuaguagagacgggguuucaccauguuggccaggauggucuugaaugccugaccucgugaucugcccgccucggccucccaaagugcuaggauuacagaugugagccaccacgcccagccuauuauuuauuuuuuauuuauuuauuuuugaguuggguagaauuuuuuuuuucuugaguuggguagaaaaaucaaagaaggaaauacaggauuaaacaucugucuucucugucccauuuaccacucuauucuucacagagguaaaauuugggaagaguucuauguuguauuuauuguagaaagcauuagguaaaugaguuaaugaaagaaacauauuuuucuccuugacuuucuugaauuucauagcuguacaugcaacuuuaccaauuccuuuaaauauuauaugaaagauacuacaaaauauucuacaauuaauauugaaaccaaaauggaaauuggcugccauaacaaaaaaaccuacuacuuaauggagguagaauagcauaauuucaaaauuguguucuauuucaaaaccuugagaguaagagcuguccaaugaguuacuuuggauaugguugcuguuguuugagaaauaugagaacucuuccaagaucagugcuuuauugauuacauagugauauaauuauuauucuuuuauguaacaauuauuuauuuuucaaauuuuuagcugcugcuuugggaaaucuugugucagaucuagcuggacuuggguagguucauucacuuauucauuuguauauucuguacuugcugucuuucuguuccccacucuucuuuaauugagaagcauaacaaaagaauauuucauuuuucuuuguuuucuagaauuaaaauuucaaauuuacuuuuucuaaacuaauaguacuaaaucuuugguauccaucaaauauagaugccugggugauaucccaguuauacauuauuagugucucuggagagggagcccuggcaguuguguuuaguaauuuucaugagugguucugauguaugcaaaaguuuauucuaaauuuaccauaauguaagcaaaauggaauuuguguuuacugaaguauuuauauguauuuuauagacaucuccaaggguaagacaggaguaaaaggaagaaccucucucauuauuccaccucacccuacucccagaaaacccaaagagaagggauauggcucgaauuugaggauacugacuagacauguuuucuagaggggggaacuuucaaaggaaauaauggccaaagcauauauggguuuggcuguuuuuugcucucuuuacuuuauguggcaggaauaaugaaacaaacuaaggacaucuauuuagaaaaggccagcuuucucucucucuuuacauucuuguuccaaguagcagauggccugaguugcuuccugagcuuggggaagccugggggaguauaaauuagacuaaguggacauuauuaugauaaauaugcucugucuugcucugucuuugauuuugucucuucuuuccuugacucauuugaguguuacaauuucagauuugaauuuuuucuuagaaguuuacuuagcccuauaaucuaggcaaagcagcuuuuuaagugaucuaaccuuaaccuuuuauauuagacuucugcacuggaguuuggggccaaagccacaguuaaaaacaaaguuucuuuguuuuaggaccauggcaagaauuuuauauucuucgaauuccuggcauaaauguaucaugauaucaucucuuaaacauucuauucccaguuuccaacauuaaaguaaauaaugagaauauuacagucauuguauagcuuucugauauauuuaauagaaccaaaugaucuaagagauuuuaaagccauuuagcuauauauugcaucauaaaacaauuguuuuuguuuagagaugaagauuuuucuggaagucuuuguauuuaaaaacuauuucucuucucucuuuugggggguaucauucaauaacaaauaccacauuuuaggcauucucagaugcauuuuaacguaucugauaucaggauccaucuuauuguugguaguauacauaguuuaauuagcaauauuuuuucuuucuuacaguucauaaaguaaggauguauccaauaaaugauggcaacuuagaauugauaaaauacuugagauuggccugacaguucuaagguguuuuuguuaguuuaccaaucugaggaauuuuggaaacuuuugcugucugauaaguuacuaauuuguaucauauguuaaagugcuuugcuuugaguuuggaauaauugcagaaauucuaauuaucuguacaaauuguuacauaccuugaauuguuuuuaaaaauaauaauagagaauacuugcucugucauuaauuuuccuuuguguuaaauauguuaauaaaauauuuuuaaacaauauaugcaauaaaaauuaaaaguuguaaagaauguuuaugucauuucuagaguacaagugcaaauguaaaauuaucuuguuucuccuuguaguaauuaguuuacuauaugaggacauuugcaugucuuuuuaaaaaccuauauuuuguccucaugucuuuguuuuguuuuguuugcuuuuguaaaggcuuuauugaaacauaaccuauauaucauauugucuuguuucuucaaagacuugcaggcuacguugaagcauuggcuuccagguuaggccugucaauuccugaucucacaccaaagcaaguugacauguggcaaacacgucuuaguacacauuugguaaguaauuuacaugguuuaugauaaugaguuggguagccagagcaagauucuguauaguucaggcccuugagaaauuugagacuaaaauugguuugaauggaguuuuuaacaaaaauugucuagacguuggcaguuuucagaagaacaguaauuuguguuauuaacuccuuauuuuuuguagguauacuuaauuuuuaaaaaauauuuuguaauucacuuaguauuagggaguaucucuuauagguuggggucuaaagaacauaaaacgaauaauaaacugugguuauccuugaggaacuuguuuagguggaaaaccaaacauauaaacaaauuauaauuugguaugacauaugcaguaaugaauuauguacaagauauaaccaugauacagguaagggaauuaacacuguggggaguaacuucuuuugguggggagauuucuugguuauuauuagaucuaagccgauuuuugaauuauagaugagacauuuacuagaugaauaagaggaguuccaagcauacugacuagcaauuagaagaggaugauaaaaaaaggguauauuuagguaaauacaagaaccgacuuuaggaauauaauauauaguagcuguagguauaagcagcagcaggagacaacauuggagaaguaagcagggaucagacaggaaagcuauuguaugugaaugcuaaggagcuugagccucuuaccuaagugauggagagccaggggaguuuuaaguaagaaguaaacuggauggaucaugaugccaucaauaaaaucaagaaaaaaaggaggaggaauaagcuuguaagggaagauaaugaguucuauuuuggacgcauugaauuugagauacuaauaggacauuugaguggugacaccuaguaggcauuuagguuagagucaagaguuagauaggucagaguuagugauaauggguauugucacuccuucauucaacaaauacuuauuguuuacguauuauaugccaaguagagauacaggaguuuugaauacauugguuaacaaaauaagaucuuauuucugauagaucuuacauucaagcagugaggagacagacaauaaacaaucugauaaauaaaaauauuuagcauauuagaaguuuauauguguuaugagaauaaaaagggaaaacagagcgagguagaagaggcuaggagugcuaggauggaagcagacugcaauauucaauaggagagucacuguaggccucacugaaaagguagaugauuguucaaaccaugggagaagaugagauuucauaggagagugguucucaaaauguggugccagcaucagcaggaucaacauuaccugguaacuucuuagaaaugcaaacacucagucuucaucuuagaccuaucuauuauuguguaaauuauugcagcuggaugggguggcucaugcuuguaaucccagcacuuugggaggccgaggcggguggaucaccugaggucaggaguuugagaccagucugaucagcauggugaaacccugucucuauugaaaauacaaaaauuagcugggcgugguggcaggcgccuguaaucccagcuuacucaggaggcagaggcaggagaauugcuugaacuugggaggcagagguugcagugagccgagaucaagccauugcacuccagccugggugacagagugagacuccaucucaaaaaaaaaaaaaaaaaaaaaaacaaaaacaugcaaauucagcagcuuaaaacaacauauauuuguuaucucucauuuucugugggucagaucaggaauagcuuaaauggguccucuggaaggcugcaaucauguccagcuaggacuucguuccugucuagaagcucaauuggugaugaauccacuuccaggcucacccaggucuuuggcaaaauuaauuuuuuuguggcugugagggaccuaaccucuggcuugcuguugcacucucauguccuggaggccucccuccaucuagagcaagcuugugcaacucgcuuuugguaauccaaaaguuuaccacaaauugguaaacuuucuuaaaacauuaugagauuuuuucugugauuuuuuuuaagcuuaucagcuaucguuaguguuaguguauuuuauguguggcccaagaaaauucuucuucuuccaauguggcccagggaagccaaaagauuggacaccccgaucuacgggucaccugcaguucuuugccauguggcccucucaguagacccucucacaacauggcagccugcaucuucagagccagcaagggagaaagggaaugagucugcuggcaggauggcaagauggagccuuauguaauguaauauaaucacaggaguaacaccccaucaccuuuccuauuacucaaagcaaguuagagcauccuaccuaugcucaaggggaggagauuaugcaaagacuuaaauaccagaaggaagguaucauggaggccgccuuaaaaugugccugcuacagauucacaaaaugaaaaguucuggagacggaacccagcaauuuguguuuuaauucuguuguacauuaaaauuugagaacuguuguuccagagaaaaugugcagaauuaaagaacccuagaaaauaccuaagagcucauagucuuaugggagcuaucaaggacgaaguuuuaagaaguaaugaaugauaaccaauuccucuugauauaaagaaaucaaauaaaauuucugaaaauuuuuuuuuguuuuuggauuugguauguaguugcucauugauaaucauuucugagcaauuucuauggacugauggaagaagaaaaaucaaaugacaaugaauugaaacacuaacgggaggugaagaagaagaauaaaauauaaaauuaauguuaaguuagauggaauuuauuuuaaugaagauauugaauguuuuggaaguaaacaauuuuuaccugcaaaauauucauacagaguacaaaaacauacacauagguaauauagaguuaaauucaucacuaaucacuuuaaaucacuuuaaaucugcaauaauuacuacccuuuaaaauaugaguaguagaaggaucacaacuauaccagggaaguguuugcuuuucaaucaaaauguaggaagaguguggagaaacaaaaugaggaccuauuugcuuguuguaauuuuuacuuuauaaagguugaaaagucuuuuaagaaaguagaauguuaauuuugggcuuuuccuuuuaguuuacauguguccauaucuuacaauuuguaaguaaagugagacuagccccugauaccagcuggaguuuugagggaauaaggauauucuaacauucuagcaauuugucuuaaaaauuuuagcauuaaaguugggaucagaaguuuauuuuccuggggcauaauaauuguuuucuuucuguauuaaaagcagguucauuuucucuucucuaugacaaaagcaucagauuacuaaacuaguauuacuauauugagugugugugugucugcguguguauugugauaaaccccucacugguuuauggcaacagugauucuguuccuuaguuguugacucugcuuguuuuuagaaucaaaucuucuacucuguaacauaacauuuugauucuauacagccugaaguauuugaaguuagugaccagccaucuacucaugacaaaagcuaacucugaaauuuacccaugauagaauaaauacagauacacaugcagguuccaguugacacagguguauuuuaaaaccucacuuguaauuugguuguuugaaauucaaaaaauauuuucuuauaaaacaguauuacagaugggacucaaguucuacaauuagccccaguguaguuaacuauggggccuagaguauuguaagacauaaugauaauguauaaauaaauguuuucacaauggaaaaauuuguuucagguccuggaucagggagugagaaaaguauaucacuuuuuuuccucuucuccacccuauugacauuauaucucuugagauaauugggucagaaaucacugacugguauuccuaaagugaggggcaaggaaagccuugguugcaagaggaauuuaacagaaugggugggaagugaaaguggggccuauuggcaaugguuauuuucuguauaugggaaagucaggagucugaaauagaauauaaugauuucucuaugcauauauucaaaugaguaaauauguuaaagucaaaaaacaagaagcuaggauuaacuuuaucagcauguggaaugaagaaaauuucuucuuguuaaaacucugcaugaaugauaccuuuuaaaguuuuggcauaacgaaaauaacaguuuugacuauuaauaucaagcaguggucauacuacuaauaccacuaccaccaccaaaagccucaaaauaagaguugaaaaauuuuuaugcaagcuauugucaaaauauuaaugucuacuauuaaauuuguuagaaaaacuguaggaugugggcugggcgggguggcucacaccuguaauuccagcacuuugggaggccgaggcggguggaucaugaggucaggagaucgagaccauccuggcuaauacagugaaaccccggcucuacuaaaaauacaaaaaauuagccgggcgugguggugggcaccuguggucccagcuacucaggaggcugaggcaggagaauggcaugaacccaggagacggagcuugcagugagucgagauuacaucacugcacuccaaccugggccacagagagagacuccgucucaaaaaaaaaacaaacaaaaaaaaaacuguaggauaugauagcuaaauagacaauguauaagagaaaacauuucauucaagacuaaagauuauguagcuaucauaguaacuguaauguuugauagaacuuauuuugucuuucccuguguaccuaacuagaaguuccuggaggagagagacagacugcauaagauuaguccaucuccaugguacacccaguacagaguuugacacauaguagcuucucaauaaauauuuguaugaggaaaugaaacuuaauugaaaaguauauaaacuugauagucaucauaggaaugcaaauuuugaaaaccauuuacaaaaauaacaauuuuaaauuuuuauaaugaucugggugugguggcucccagagccuguaaucucauuugggaggccaaggugggaggauuucuugaagccaggaguucaagaucagccugggcaacauagggagacccuggcucuacaaaaaaaaaaaauaauaaaaguaacaaaauuaucuaggcauaguggcaugugucuguaguucuaguuacuggggagacugagucaggaggcucgcuugagccaaagaguucgggaagagaucaggaagauggcuugagccaaggcugcaguggguuaugaucauaccacugcguuccagccuaggugacaaagggagacccugucucuaaaacaaauaaaauaaauaaaaaugaaauaaaauuuuuauaauguaggugaaguugcaggauaauugguaugugugucuacauuuauguauacugaaauugcuauguaaguaugugcagcguugucaaggaugaaugcuucaugaagaugcacaaauauuaauacuguuugacuuuuaaacaaaucauuggggaagaaauauacauggaaaugcuuauuguuauuucacuuauaauguugaagaaguagcaguggcuauggcgguaaagagagauuuaaguagaauauagacccgucaauucaguugaacuuagaagucuuuaaguuuguguagcaguuuggaaaagaguuugugagaaaauguguggcuaugcagggguacggauugaggaagaaaacaaagcuauguuuacauaaugauuauaucuacauauaauuagguauacacagggauaaauauugaagaggaauauauaugaaggguagcaaauccaaauauauugagaagagcuggugagauuuuuucucugccuucuuguuaucagagauaaaguaacuuuaaaaauguucucuuuuguuuccuuagggcaaagcuguuggggugacuauuggcugcauucuaggaauguuuccuuuaauuuucuuuggaggaggugaagaagaugaaaaacuggaaacgaaaaguuaauccucuuagaauaccuauaaaaagauguaaacuaauguaccucaguaauuaaauaugcugucacaacauuuaggaauuaagacaguaacaguauagauaugggaucaaauaauuuagcauguauuauggaaaacacuaacuuauuguggcuugaucuucuuaggacaucuuuuuuaaaaagcuguuuaguaucauuuuguguauauuguugaaaugcuuuuucaucaauagcagucaacauuuuauccuuucuuuuuauauucauaauguuauuuaagugucauugauguacuguauugacuugggguuugcuuauuuguuacuuaacauguguacaugcaugaaagcauuuuucguuguucccugauaguuacauuucaaccuugggauuuuuccaaauuacuuaagauguuuaaugucaguuaaagauuuuuuuacccucuuuuugggaacaucaauuuuguacuguuaugcaguaaacauuuauaauaauauaauuucagucauuucuuaacugucacaucuauugaaaauggauauagauacagguuuuaaguauuuuaaguauauauuacuuauuuuaauuuucugacuuuacuauuuuaagggccagaggguuaaucacaaagagcaauuauguggucucccugcuacaugaaaccguguauacuaacaagcguacaauuuuuaguugauuuuuuuuaaccuuuuaguuucccaguuuugaauaauuacaugguggauucugacuuuugaggggaagcaaaugauuauuuuagagucuuugaaauggggauuguggaauuagauugaacuaagggauuuaacaugaugcuuggaaauuaagagacuaaagcuuuuuuuaaaaaaagguggaaaauaggaacugucaagaagguuuaugguauaaaugaugaaguugaagugauguuugaaagauuaaugagauacaauuuauauuauuugguaagguuuuuuuuuuucccuccaaagaugucaucuucucaucugaauggaauaagucugaauaccccauauucauacuccuaaucucauuauaucuuauuuagugaauuuuauuuaugaauaauuucuguugaagugaaaacuagauauuuaauauuuugcuuuuuugcuacauagucuacucaaaaauuacaugaggagaaauccuuuuucccuuuguuuuucuuuuuucuucuuuugugguauuuaaagcauauuuuagguugaaguuacuuauuucuagucuuguacuucuggcuuaaguauaaccauguaagaauuauaaauuuuaguuuucugaacccuuaaacuuuuuuagcauguggucuguuacacaugcuaaaaaauuagucuuacuuguaacagcguaauuaaacacaucauggaggagagaaacuuaaaauuaaaauaguauuuuggcuuuugaaguuauuuguguugcuaaauagaugcagagguuuuacagcaguuuauuuuaagguuuuauuuauacauaauuacuuugaacucuucagaguagauauuuuuucacaaggcaguuugucauaaauucucucaugcgcuucagaaugcauaagugccauccuuuaaucauagacuuugaggagagaaagcauaaaaauauagcauauaaucuaaaaauaaauauauaacaugcacaaauaaugugacauucuuacugaaucaaaucaugauucuagaacuugagaucuuaaauagaauuucgguuuguaucuuccauauaauaaccacacacagauaaccacacaaaaaauccuuuguaaaauuucugauugauaggauuagagugcuuaaauuuuuggggggggaagggugggguaaaguguaagugcuuucuuuugucccuaacuuguguauugauggcaguccacucuguuuucuaaaaauguauuuuacuguggugcuuaacuucuuauuaauuaaaucccguaucagaaaccuugccugugacuuuagaaagggcuuuugauuauuguuuuuucuucuugcucuugaaaguaaucuggucccagggaauuacugguuuaacugaacaucuccagaauuauuuaaggugucaaaauauauaaccuucacauugaaagauaauuuuaauuuaugggcauaauaaaaauuugaaucauucagguaauuuucaaaaaauggagaccauuugucuuuaacugaagguauauguuuaagaucauagucuacccuaguauggugcuuugccacaaagugauuucugaagaaugguucuuuuuaagauaaugacuucauaugaucauuguuucauguuacuugccacaaauaacuuuaauuuagguugaaacuggaacuguuuguuucucauauuagcuacuucucuauuaggagcacaagaaccauaguuaaaugcaacaugagcuacuuuaguccuguuuguuuaaauuuguguuguccauguauuaugauuuauuaacuuguugaugcauguaaauugggugcauuuuguugccauguauguuaaauggugaccaauguuuuuacaaaggaauugaacaaaaaaaguaucuuuuaagaaauuuggaaugugguuuugauuuugaaauuugauuucuuacuaaucucagagggccuugguauauucuguuacuaaagcaaacaggauuaaugaauacggauuuguuacaagguggcagcaaugucacugagauagugaauggaacaauuuaccaccucccuggaaucugcaccugagauacaacaucagcguaugagugaagagugagcccauagaaaagcuuuagauagacucacauaagucacacugauggguauuuacagcagauauauccaagcuguuuauguaauagucucauuuacuuuauucuuuuucucuagaacauaaauuuugaagguaauggaaguuuaucuuuuauaccaaaaguuuguaugagccauuuugaaguaaaucuuucuaauuuuagaauuauauuuucucgccaucuuaagacaguauauuaaauauaauauaaccuuuuucuuaguggcuaagcauuaucuuuauguauauuauuauugugugguaaugcaguaccuugagaaucuaguuuuuauaguuuucauuuuuuuuucugaucuugcuucuggcaacuuuuaucucucuaaucugcuuuuuuucucaguugucuggacuuagaaacugguuagccuaucuuaccauaaauuauuugggaaauacuaaaaaauuggcuuuggauccugacugagaugaugaugaugauaguaguaguaguaauaauaauaguucccuuuuauuaaacacuuauuugguccuuuaugcacuaguaauuuacacacauuauugcauuuaaucaccuuaaugacaacauuaaguuggggcuauuaucauuaucaucucuauuuucucauagcuaaauugaggcaugaagagguuaguuugccacuacgaauaaguggacuggaauccuauuuuguccaaguaugaagccugucuucuuaacugcuaggcaguagggacaucaguugcaugggcuuugcaaugucugcucucugccuagguuccuuuuuaccuccagauucauggagucauuuucuuaucuauaauuuaagaauauugugcuuacaauccaagauucauuuaagaaaucuuguguucuuuauuacauacuaugugcuaggauguucaaggcacugagugaacaaccagaacaucuguacccucaugaagcuuauucuuuugggguggguaguaauaggggaagagaacacagaaaagcaaauauacuuuuuuuugagauggagucuugaugucacccaggcuggagugcaguggcgugaucuuggcuuauugcaaccucugcuuccuggguucaagugauucuccugccucagccuccugaguagcugggauuacagucacgugccaccgagccuaauuuuuuuguauuuuuaguagaaacgggguuucaccauguuggccaggcuggccucagacuccugaccuccugaguagcugggauuacaggcacgugccaccgagccuaauuuuuuuguauuuuuaguagaaacgggguuucaccauguuggccaggcuggccucagacuccugaccucaggugguccaccugucucggccucccaaagugcugggauuacaggcgugagccccugcgcccaccugcaaauauacacuuaaauauuguuuaugucagauggugguaaguucuauagagauaaaugaaacaagauaaagaggauagaaaguaccaguggucauaagugaagauggucagugaagaccugaaggaagcgaagguacaaacaguacagauauucugugaagagaaaguaucaugcuagguacuagaaaguugguguuaagaaaaucucagauaugugaaauauguuucacuuuggaauucauuguaaaauguuuucuuuuuguuucauauu

SEQ ID NO: 17778 - RNA, 75339 nt, Homo sapiens
gaacacagcugacugacuacauguccugucauuuucuuuacaugcacgauugauaaaacaaugacaguggcacagucacuuggcaucacaguaauucuuagaagaacgucagucauaccagagaccauuucacugauuuuuuauuagggcaagugcauguucuguaacauauuucacuugcaagcaugaaagaugaggucucucucuuucuacaugggccgcucccggggucuggucacaauauaccaccacagugggggcaaaucaccuuccuuucgggcagggggcaaagcuucaguuaaaggaccaccagguggcguuuccuccugcagcugcuuaaccuagaaggaggcaaggaaggaaucauuaccaaaggaaucuaauugacuauaaaaaucugucugcugcagugaagggucagcuuuaugucuauggugugucacugacauuacacacuaucugaucacaauauugaaaaguguuuuuuacauauaccugcuuuauuuucauauccacacuuuuagaaaagucuccuuaaggguuuucccauucuuuuaaauagcaaagccuacccuuccuauucuucccccuaccccuuuucaucaccucauuaucuggaccuccucuuauucugcagacagaaaaaugacaacuaucauuccaauucuccuugucacagcccccacccacugaccagaaaaacauuuauuguugugucucagcuaaguguucuccaaaagcaccauuaagaaaccucaguucauaauaugcuggggauguuaauucuaagcccccuuccuagcaaccaagaacaaaaauaaaucacaaaauuacauguaaaaauaugcucaguucugccaagugcugcccuacuaccuccaguucuaguuauggccaagauaaauguccuaacagaagaucacccauucuggauuguggcugcccugggccuccagucacacgugcugcuuaauaguguugaagugaugggauguguaaaggaggaauuguuugauguuaucccagugaucaauugcagaaugcaccugcggcucaccaugcauauacuucaagcuucuaaacggugagacauuucugacaaaacacugcccccuuuggccacagugcccuuccuucgggucccccuuggccaaacacuuccaaaggucaauauccucaguguuaucaccagaaccagcacaacuuccaaaucaugaauucaaauaucccacuauccaaccacacucucccuuucccacucauuuguuuaaaugccuccuugaaacucagacuaccaauucacagauccucccaacuuggccuucccucucugcaucugcccccacuggcuugacuuuguuuuuuuuuaaauucagcuuagauuccaucaugacaacagcuuccuuucgaauaaccucaagucccuugucacucucugagcaacagacaaaccgaaccauauacccucaggccugugcucauacagcuuaguauugcuaaagagaaaaaagauaugggagcaaaucggagucauuacccacugauuauucccaaccucaaaugggccuuugccaccuggccauccuacuacucuccagcaagcucuuccucgccucaugacuaucacaucuuguccacauucuccaaauaugcugcacccacucauucugggcuuuuccucuuauuucacuaaaaaaaggaagcuaucacacaagucugucaucuucaaaacuucuaacccaaauguauuuauauacaaucuuuugcccaauuauaaugcacaaagaauccuuuuuccuuuucuuuuuucucuauacucucuccuaaggauuccauacaucucuccauggcuuuuaaaacugaaaacucccacguuucuguuucuaggccaaaucucuccugggaguuccagauuuccacaucugaaguuggcuucugacaucugcacuugaugucucacaggauucucaaaacuucacacuuccaaaaugaauucucgauugcugcucugacaccugugcccccuuccccaaucuucccuaucucaguaaacaucaccaaacuccagauguuaaagcuuaaaacccagaaaccauucucucuuuuuuuuuucuuuugggauggagucuugcucugucgcccaggcuggaaugcaguggcgcgaugucagcucauugcaaccuccaccuccugggauucaagcaauucuccugccuuagccucccaaguagcugggauuacaggugcacagcccccacgcccagcuaauuauuuguacuuuuaguagagaugggguuucaccauguuagucaggcuggucgucaugaacuccugaccucaagcuaucacccacuuuggccucccaaagugcugggauuauaggugugagccaccgcacccugccccagaaaccauucuugauuccuccccaucccucacccacccucaacauccagucagucgucacaucccuccaaaugauguccugagucaauuuccuuccauauccacuucauccacccuaguguuagucaugacaaccuuuugacuaaacuucugcaauaauccuagaagggucucucugcuucuccucuuccccucuccaauauauucuucacacuacagcaagauugagcuuuuaaaaauauaacugaccauccuaacaugacugaaaaaugccuaagaaaauaguggagaggcagguugagggaaaguauagcaagaaggcaaaaaagucagacaaaggacuaaagagaaggagaucugaagcaaaaucaaagacaaagccaaaacgaccagggaaugcacuuuaacuuacuuguaaggugauuauaaauguuaaauugauacacuuagauacuaaaguauaucugagaagcaagggcccagaguaacugucauggcuggaaucuggaccucugcuuguggggagcaaaacuucacuccaucuacauagcuaaggaauaacgaaguacaaguagaacgcaccucucguucccagcuuucccuccgcaguuucuuccacuguucucucuuggcaaaguaaucaggauacauugccuucucagaaggaugccagucaucuaagcaccauucugggaccugucaggagaggaaaucaugguaucaauccacaggacacauuuaccuaucccugacagggccugcucaggagauguaagacaaagaucaagauauauuuuuauaaccacugcaacuaccagacuguuucuaacucuaagcaaggaacagcagaggauaaguaggaagcaaagauaaaggaaaacaccuuagagucaaagacugugcugaaaaauagcaccaucaucaguccaaggagaacuggcuucauuccuccccuaccugccuucucuaaauauccagaguagucuuaucuuacuuggaacucuuaauuagaguaucucagaaauauuaagcaccaauccaaguugguuaacuuuaaaguccaaaaugaacuuuguuauagcaaaaaguauacuguacgaccuuaaaucugaauguagaaagaaaagucuuaaugacgucucagagagagaaaacugacaccuaagaaacaguacaggcacaccuuagagauacuggggguuugguuccagaccgcugcaauauagcaaauaucacaauaaagcaagucacaaaauguuuuugguuucccagugcauauaaaaguuuuguuuauacuauacuauaaaguguccaacagcauuaugaugucuguugagauggaguccuccuggugaagauuuugugaauauugauuaacugauaacaaaggacuuugaacaguacaucaacuuaguugauaaagcaguggcaggguuugagaggauugauucccauuuugaaagaaguucuucuguggguaaaaugcuaucaaaaggaaaagucaauugauguggcaaaccucacauaauauacauaaaaaauguacauaauuuaggccaggugcaguggcucacgccuguaaucccagcacuuugggaagcugaggcaggcggaucaccugaggucaggaguucgagaccagccugaccaacauggagaaacgcugucucuacuaaaaauacaaaacuagccaggcauagugguacaugccuguaaucccagcuacuugggagacugagguaggagaaucgcuugaaccugggagguggagguugcggugagccgagauugugccauugcacuccagccugggcaaaacucugucccccuccaccaaaaaaaagacauaauuuaaaaauacauuauugguugggugagguggcuccugccuuuagucccagcccuuugaaggcugaggcagggagauucuaugaggguaggaguuccagaccagccuggacaacauagcaagauuccaucucuacaaaaaauaaaauaaauuagcuaggugugguguugugccucuguuuucuuagcuacuugguuggcuaggacaggaggauugcuugagcccaggggauccaggcugcagugagcuaugaucaugcuauugcacuccagccugggcaacagagggagaccaucucccaaacaaaaacaaaagaaauacguuauugauaaaaacugccaacaaucaucugagccaucagaaaaccaaucuuuuuacugguggagaguauuauaucaauguugauggcuggugacuaaucagggugaugauugccaaaggcuggaguggcuuuggcaauuuccuaaaauaacgagguuugcgacaucaacugacucuuccuuacaccaaacacuucuauagcaugugaugccauuugauagcauuuuacccacagaagaacuucuugcaaaauuggagucaauccucucaaacccugcuacugcuuaaucaacuaaguugaugugcuaugcgaaguccuuuguuaucaucaauguucacaaaaacuucaccaggagacuccaucucaagaaaccacuuucguauucauccauaagaagcaacucuucaucugcucaagauuuaucaugagauuacagcaauucagucauauucucaggaucagcuucuauucuggcucucuugcuauuuccacaacuucugcaguuacuucuucugcugaagucuugagcccuucaaaaucacccacaaggguuggaaucaacuucuuccaaccccguuaaagcugauauuuugaucucuucccaugaaucauaaauauccucaauggcauuuagaauggugaauucuuuccagaaaauuuuacuuugcccaaauccaucagaggaaucacuaucuauggcaacuauaacuaugcaaaauauauuucuuaaauaauaaaacuugcaaguggaaauuacuccuugauccaugggcugcagaauggauguuguguuagcagacaugguagcaggucucaacaaugggcuuaaaagauucaguaaaccauguuguauacagauuugcuguaauucaggcuuuguuauuccauuucuagggcacaggcagaguagguuuagcauaauucuuaagggccucaggauuuucagaauggcaaaugaacaauggcuucaacuuaaaaccaccaacugcauuagucccuaacaagagagucagccuauccuugaaguuuugaagccaagcauugauuucucucaagguaugaaaguucuacaugguaucuuauuccaaaaaaaggcuacuucaucuccacugaaaaucuguuguuaaguauagccaccuucaucaacuaucuuagccagauuuuguguaauaauuugcugcagcuuuuccaucagcacuuguugcuucaccuugcacaucuguguuacagagauggcuuuuuuccuuaaaccucauggaccaaccucuauuagcuuccaacuuuuuuucugcagcuuccucaucucucucagccuucauagaaaugaagaguuaaagacuugcuuuggauuaggcuuuggcuuaagggaaugucguggcugguuugaucuuuugucccaaccacuaaaacuuucuccauaucagcaauaagacaguuucacuuaucauuuguguguuuaguggagcagcacuuuuaauuuccuuaaaaaaaccuuuaauuuccuuugcauucacaacuuggcuaaccagcggaaaaggccuugcuuucuacccaccuuggcuuucaacaugccuuccucacuaagcuuaaucauuucuagcuuuugauuuaaaggaagagacguguaacggauuuaaagugagagacauguaacucuuccuuucacuugaacacuuagaggcuaugguauggucguuaauuguccuaauuucacuguugcugcgucuuagggaauagggaacccugaggagagggauagaggcggaggaacuauuggucggugaaacagucagcacacgcacauuuaucgauuaagucugcugucuuaugugggcaugguuuuuuugugccccaaaacaaugacaauaguaacaucaaaggugacugaucacaguucaccacaacuguguguagauagaguaauaauaaaaaaaaguuugaaauauugcaagaauugccaaacugagaaacagagacagggagugagcacaugcuguuggaaaaauggugcccacagacuugcucagcacgggguugccacaaacuuucaaucugugaaaauacaauaucugccaagcacaauaaaacaaaaugcaauaaaaugagguaggccugcaucugacaacugucaggaaauaagucuccuagcuaccccuugaagggcaagugauuucugaggcugaggugugggacugaagaaacaaagucuauuucucagaaggcagucaucauaauucucaccuaccuuguagcaaucguaucucucauaggaggugcccccaggagagucagggaagauguauggcuguggaugcugacgguaccagaauucuuccucggccuccuucagcagcuggguggccuucgccauauccuuuucauucuuauguucuucaaaccgggcucucaucaaacaagcaaaguaucgguauuugucucuuaaaccaaaaugauuuugaagauuagaaauguuaccuacucacguggucaguguugcugucugacaggaggcugcacuucugauaccuucuggaugggcaguggaccuaccccaacccucccaauggagcagccguaucaucauggcugcuuccucuacagcccaccaaacagcagcagcaaaaaaauacuguauuaaauauauacccuaaccauuuuucuccucuuacauccaacaauggaaugaggauuuaaacaaaaaaaaaaaaaaaaaaaaagaaaagagcauucgcaagagaaaagcuauaaccucugcaggaucauucaacauucauugaaugacaacuuccauuuccuucuaucuugugcuagucacuaugcuaaauucuggagauacaaagaugaauaagaaagguguuacuuggcagaaacaguauugcuuagcucauacagagcuagguuuguauccugacucugacacuagcugcauaaacuuaggcaaguuaaagucaaguucuaaagaaacugggcaaagaucaguuaggagguuuugacaauaaucuaggacacagcugacgagggccugaaaguacggagcugugauggugacaggagacaggggagacauugagacuuccaaguuaugagaauaggcucuccagucagacuguaugggccugaaucuuagcucugccacuacuagcuguguaacuugggguaaguuacugucuucuggucaggugcgguggcucacaccuguaaucccagcacguugggaggccaaggcguguggaucaccugaggucuggaguucaagacaagccugaucaacauggagaaaccccgucucuacuaaaaauacaaaaaugaggccgggcaugguggcucacgccuguaaucccagcacuuugggaggccaaggcagggggaucaucugaggugaggaguucuacaccagccuggccaacauggugaaaucccgucucagcuaaaaauacaaaaacuagccgggcgugguggcaggcaccuguaaucccagcuacucugggggccaaggcaggagaauagcuugaacccgggaggcagagguugcagugagucgagauugugccauuugcacuccagccugggggacaagagcgagacuucaucucaaaaaaaaacaacaacaacaacaacaaaaaggccaggcacgguggcucacgccuguaaucccagcacuuugggaggcugagguggaggucaccugaggucaggaguucaagaccagccuggccaacauggcaaaaccccgucucuacuaaaaauacaaaaauuagccaggcgugguggcgcaugccuguaaucccagcuacucgggagacugaggcaggagaauugcuugaacccgggagacggaacuugcggugagccaagaucgcgccacugcacuccagccugggcaacauaagcgaaacuccgucuaacaaaaaaacaaacaaaaaaagucuucuaggccacggguuccuccucuguaaaacaguggcaauaacaguguguauaucuuaagguugucauaaacagucaauaagauaaacacacuuuaaaaagugccugguacaucccaaguguuaaauaaugucaguuacuaauaucauacuggaaagagaauuuauaaaaaccagugucuaauuauacaugguguaugaguauguguguuauuggcaaaggaauaaggagcaaauacuugagaacaauucugagacuuaaagcucaguaacugaauuacuaauaauaccauuagcggaggcagggaauuugggaaaagagucagaauggggagugacaggaaaacaaguuugauuucaaagaauuuagauaaauggagauugagagaacgguuggugaucuuuucaauuuuuuuuuuauuauuauuuuuugagacaaaguuucacucuugucgcccaggcuggagugcaauggggcuaucucggcucacugcagccucugccucccagguucaagcgguucuucugccucagccucaugaguagcugggauuacaggcacccaccaccacgccuggcuaauuuuuguauuuuuaguagagacgcgguuucacauguaggccaggcuguugaacuccuggccucaggugauccacucaccucagccucccaaaguacugggauuauaggcgugagccaucaugcccagccaacagucgugaucuaacaagcaauucgaacuacagcucuagagacaaaugagcgcagguggugacagcacuaaaugaggcugcccgaguacauacaacaacacaguaugccuaggauggaaccacagagaacagcacaaugagggcaaauggaggaagaaauuaaggcaaggauugagaaagaaugucagaucuaaaaaaugcugagccauaacugucauaguagcuaguuuauaucauuuuccucuagaacuauggacuuuaguauucccagcuauaguucaguauugcuugaauucuuuuuuucauguuuaacuuuuuuugacacauaauuauuguaccuauuuaugggguacaugugauauuuuaauacauccauauaauguauaaugaucaaaucaggguaauuuggauauucaucaccucaaacauuuaccauuuguguugggauaccugaaucccugauggcucaacuuccuucaucaucgauuuguuuacauguccauuuuccccacuaauccgugagcugcugcugcucaaaaauggauuuacuaacauuuauauauuuagcauagagcauagaaucugaauugcaaauucugucaaaucaauaaauaaauaaggaaaacucaaggaagaaacuaacaaucccaucacauuguacuuggccaucuuccugccaaaucaagagaaguaugucagugauuuucuaauagucacauauaugcaaucugggcuucgaggguacccucuguaauucuuccaggccuacuccauuuuccauagaguuuuuuucccagaaggccuucuuauaaaacuacguuuggagagucguaagacuggaguggaggcgaggcacucacacaucuuggguuguuagcccacccugcaaugaauuuaggugauuaaaaucuacacauuuuaacacuauguucucagacuagucucagacggauagaggucgaaagagaauuauguaagaggugaaaaagauguaaagguaaugaaaaggacuagaugaagcuaaaaagagaaaagcuaaugggaggggugggagaaugaugaugcuuuggagaaagaccuaaauuuuaacccuggcucagacacuuagaaacucuaucaccuugcgcaaguuaccagcugugcucaucuucuuaucuguaaaauaagcuuaagauaauuccuaacuccuagaguuuugcagacugaagaaaauaaugcauaguuuauugcuguuaauauuggaaaggagaagaucgugaagaaaacgauugagcgagcgcuggacccaugacaauuacaauuuuaggcacuuuccuuuauuucacuuaauuuuccugcgacccucugcgcuggucgugcguccguuuuacuaaacaaaaagcugacgcccagacccgacaagcaacucuacaaggucucccggccauaaguggcgaagccuggauuugaacccgggucuaccauaggauucugugaagcgagaggccaccuuccaauuccguucccgaaguccuugaaccuccagguacccaggggccucuccaccuccauggggccccgagggucaccuccccgaguccuggguccccaucccuuaccucuggacgcaccacgacucgagguggcguagcgcccgcuuauaaagccgcaacaccuuuugcugaugggucagguagggucccgacgccaagaacgccauuacggcgcugaccuuccccggccgcgcggagagccgggaaacugcacgccugcugcgggugacugagcggggccagccggaagggcggaguugccggcggccacuuccgcuuccgcuggggagguccuccaugcgcagucaugagucgcuucaaguuuaucgguaagaggagcguuuuccacgcccuugggucuuucugacuugucccgggcgucggucaccaaggucacaggacccaggaauugcgcccuccggcauuguaaggguugaaagggccgcucaguggaggagggcgcggggagguuucugggugcugguaaugcucugguucuugaucuagguucuggauucacgaggguguauuuauuuguaaaaauuaacaagccguacaguuaugauuuuugugcuguuuucaacaucuguaauguauucaguuuuuuaagaagaaaacuccaaaaaggccaaucacuauguuuccauucaucccacgugcaccucccggcccuuccccucugccuuggcggagaggcugaccgcuucuggggaccaauucacucaagcauucauucguucauaucauaguuagugagcgccucaagugggccuggcacuggccuaggaacacagggcacaaagcucccaguuguacugucaucaccaucugguggagaaacuagaaaacacaaguaauggggagaaaaacaaacuguacuuggcaaguacaaugauccagucggcaucaguagaacgagagggagaaugcugcgggauuuaaaugggcaugauccucguuuugugggguuuccagcuaccugaaggugggaaaugacagugaucacaccucugcuuuagcaagguaauccugauagcuauuauguagguuuugugggaaauagggagagguagggaagcauuucaagagcuuaaacuaggguaauggaaaagagagagaaauggaagagaugugugcagcauuuagcagcugaguguucauggccgguaguagagagugaacaaagaugacucaggguuuggaaaaguacuuaaauaugaaauggaagcaugacuaguuuggcggugaagagagguacccagguccauuuggauuagguuaaguuugagauaauuauaggacauccagguagagauaucugggcaauugggaauguggucuggcaaucaagagauuaggauuauacauuuagaucugagaguuauuuaagcaguauuuuuuuuuuucaaagacguugugcuaaguccuguggaacuguaaaaucuaguggugcaguuuucagacuggagaccuaagaccuauguacuguacagucaaaagcaaaugcaggggagaauauguuaagugccaggaaaaagguuuugaaauugcugugggaaagccuggaguagggguuuggggagggguugucaaauaagacauugccgugucuuagccuuuccauccuaaccuuugauauaauugaugagggagauggaauaaagagccaugaaguacuccguaaagaaaggccacauaacuuuuuaaaaguguguuuauguuauacaaccaaauuccugccucaaguuaaugucuuaaauccauccuccauguagacuccauuuugguguaucuaaaaaucaaaucagcuaaauguuucuuuugcuucaaaucuuucauuuacgcuccucaggauagccuaaaugcuuacacaccauacaaagcccuucugugguccaguccugcccacuuuucuagcccaucccugggcugcucuauaaacacuugugcaugcuguuuguuaccucugacaagguuuuagaguggcaguuuggggccaaaauauuccucugccuaccaacuacccuguugccugucugccuacucacuccuuaaaacuuauaccacauuauuuauaauuaaauaugaguaugccuuucccacuagaucaaacucuuaaggcagauacugguaugguauuuauauuuuuuuccuaggggcguaguacaaugacuguuugggaaaguaugaaugaguggcuuuagugcuaaggugauaagaaaauuaguaaagggauuagcaucagauaaaauaagcaagaaaagacuucuuaaagaaggugacuuuauuggaauaaauaauugaaauaaauuuuuuucuguaugguuuccuuuagccccacucuccuaaaguaaccauauuaaaaguuugaaguauagccuucccuaauuuuuuaauagauuguuauacagauucauaaaaauacaacauaucaagguuuuuuuuuuuccuuuugaaacagaaaugagaucauauuaugcauucuauccuugguauaugacuuacucugauauuuaaucuuucaguuugugucauuuaaaaaauucugcccaugaaucgcuagacuaauuucuuagccuaauaaugaguucugaacaauauuuugaaaaacaucauauuaaaucccuggaacaagcuucacaugggacaauugcaugaaaaauugaacccauuuuaugaaaauuaccuuagauuuugguuuaagacagcugaccauuguaauucuuucuacauuucucucuuuucuacuugcauaacaaguggcugccccuuagaacuauaccccaacaguggggguuuuuguuuguuuugagacagggucuugcucugucaccuaggcuggaguacaguggcuuagaucauggcuccagcauugaccuccuaggcucaagugaucuuccugccucauccucccaaguagcugagacuagaggugcucaccaccauaccaggcuaauuuuuuuuuguagaccacuguguccugcuauguugcucaggcuggucuugaauugcuggccuuaagcaguccuuccaccuccgccucccaaaguucugggauuacacguggagccacuggccagcaugagaauuucuuuagcccagcuuauacucucuuuucugucuccacaaguggaauucuauucccuggguguuauuuacaaacucuuccacucucaaaaauacuucuaccuguaacuauuauaugccagaaucucuacugcauugaucuuagacuacauaguacaccaaaaaaugagaaauaucugugcaagaagaaaaugcaaaauacaaacaacagugaaaauaaaaacaucauauuccauuccugauauaguuuagauauuuguccccuccaaaucucauguuaaaauuugcucuccaauguugaggugguccagugggagguguuugggucacuucccaacauccaucucauggggguggaucccucaugaaaggcuugauggccucccugugguaaugaguucacacuggcuccccuucccuuuccaccaggauuggaagcuuacugagauccucccaaaagcagauguuggugucaugcaucuuguacaaccugcagaaccaugagccaaauacaccucuuuucuuuauaaaucacccagucucagguauuccuuuauagcaaugcaaaagcagauuaauacaguuccuccaaaucacacauaacaccaccaugucuaucuuuccagaucuucuguaggcauaccaaacaaaauaagaucauacugaggcuacucuuuugugcucugcuuuuuucaaucacagucuccaccuuuccauuucaggaaauguucaucuuaacuaguaccaaaaucauacucaaauuuuuccuguuguuccaaaaaugucccuugguggucauguccaaaaugguaucccauuuagagccacacauuugguuguuccuuaaauuuuugaaucaagugcagagguuugcaaacuuuuuccuuaaagggccauauaguaaauauuuuagacuuugagggccacgugaucucuauugcagcuauucaacucugcccuuuuguguacugugauguaauaguaaauacguguguguucucugcucccauuucuuugugcacaacuccugaaacccuuggaaucuccuaagugcuaagugucuuuuuguaugcugcuaagaugacugauggcugggggcuccuggauagccucaggauggggguuugccuaggaaaacccaucaugugauuagagaguuggaaguuucagucccucccacccacucccacuucuggggaaggggagagaaacugaagguugaguuguucacuaauggccagugauuuaaucaaucauaccuacauggugaagccucuauaaaaacccauacaugucucuaugugucucuuccaccuggccguuuuugaauggcaucuuuuuacaaugaauggguaauaaguaaagugcuuuccugaguuccgugagcugcucuagcaaaugaucaaaccugagaaggggguugugggaaccucuuauuguagccaaguuagacaaguuguggguaaccugggaaccuacugcuuguaauugguaucugaaauggggagagucuugugggacugagcccuugaccucugcggucugauguuauauccagguagauagugugagaauugaguuaaauuauaggucacccagcuggugucagagaauugguuguugggagaggaaaccccacacauaccugacgucagaagugaauccucacgccuguaauccaagcacuuugggaggccaaggugggaggacugcuugagcccgggaguucaagaccagccugggcaacaaagugagaccccaucucuacuuaaaacaaacaaacaaaaaauucagaguauugugaguaugagaauacuguaggagaaagcaguuugcauuuuuuccuaucucacaccuugucauucaaaagcaggugauagacaguauguaaauagguguggcuauguuccaguaaaacuuacggucacugaaacuugaaguucuuauaauuuugaugugucacaaaauauucuuuugauuuucuucaacuauuuaaaaauguaaagucauucuuagcuuagaggcaaacaaaaguaggcaguggcuugugggccuuaguuuaccaaucccuugcucuagcgcauuucuuuuuuuuuuuuuuuuuuuuuuuuuuuuuuuuuugagacggagucucgcucuguugcccaggcuggaguguaguggugcagucugggcucacugcaagcuccgccucccagguucacgccauucuccugccucagccucccgaguagcugggacuacaggcgcccacuaccacgcccggcuaauuuuuuguauuuuuaguagagacgggguuucacuguguuagccaggauggucucgaucuccugaccucgugauccuccugccucagccucccaaagugcugggauuauaggcgugagccaucgcgcccugccacacauuucuuuuuuuaaugucacugacuuaccaaagcagcugugcugguugugccugugaaauaaaaauaaaauucuaagcccccuaaacuggcugaacagaaccccccucgaccaaguagaccccagaaaaacaugaaaaacuaagauucccaaacaugacaagaugagggguugguccuggucuccuuccuuacuaaccaauaccagacuuuuuuccuacaaguugaacagaaaccagcccuggaaaaacaaagauuggaagacuugcuccucugcugacuucagccaacugccugacauugggaccagcuccccuccuuuuuugcaguuucaccaugacagcugaccaguuucacaaggcauuccuuccuguacugagggcaguugccacccccucaggccucaucaaggcuaccaaaaaauuacuccugggauccccucucguuguauauguuucucauucaauuuaggcccuuugcaccuguccccucacucagcaucuuuaagccaguugauugaccuccuaugagauacuuuucuccucuucuaaccuaaccauaauuuacuguaaccuccuuaauguagcuaccauuuugcguuuuuuuuuuuugagacagagucucacucugucgcccaggcuguagugcaguggcgccaucuuggcucacugcaagcuccaccucccggauucacaccauucuccugccucagccuccugaguagcugggacuacaggcgccugccaccacgcccggcuaauguuuuguauuuuuaguagagacgggguuuuaccguguuagccaggacggucucgaucuccugaccucgucaucugcccaccucggccuccuaaagugcugggauuacaggcaugagccacuacaccuggccccguuuugccuuuaauaagagauuaacgcacccaaagacuguguugucuuuacagacacuuuucucucaccucauauagacuuaagggagacccccuuacccacuaauggauccuuucucaaaaauucugcuggcuuccauuaugcagccuaugugguggucucugugaugggaaucauugaaucaggcccccagccaacugcccgaucugcccaacgagcagaauuagcauccccucacuugggccugccuacuggccuggggugaaacgguuaauauuuaugcagacagcacguaugucuuuggaguugcccaugauuuuggcaugcucuagaaacaaagaggauuuuuuacuuccucuggacaaccuauuaagaacaaagacuaggccaggugcaguggcucacgccuguaauccuagcacuuugggaagccgaggcagguggaucacuugaggucaggaguuugagaccagccugaccaacauggugaaaccucgucucuauaaaaaacacaaaaauuagccagacgugguggcaugcaccuguaaucccagcuaugugggaggcugaggcaggagaaucacuugagccugggagguggaggcugcagugagcugagauugcaccacugcacuccagcccgggcgacagagugagacucugucucagaaaaaaacaaaaacaaagacuguuuuguuucucuuagaugccauucaggcucauugagcccuagccguuaucauagucgaaggacauuucucugacaagacagaagacagcgaaggcaaccaccuaguggaugcagcagcuaaagcugccacccagcauguggcuccuucccgaguuguacucaacccacuccuccuccuccuccuccuccucccccccuugcucuuccuucuuccuugcuccccuccccaucugaagaccuuuccagacuuauuuucacaaaagacagucuuggagucuggaagagggaaauggaugaaacaaaauugcgcuugcaauccccagacaaaauuacaggaagguccaaauggacauccaguccuacccagcacccugcaaagacaaacaaccuucauacauaaucuaacccauuagaauccagacaaaaugauucagugggguagacaguacuacuguaugguggcucucuccagcucuugccccaccgcuauguaaacuuugcaauaucuacccucaguauaacccaggugaacuccugaagcucccuccaggacaauuuccucuccccuagggucccuuaaccaugugacaacuugauuucauuuaguuaccaccaucccacagauuaaauuuuguucuucuaaugguugacgauguauucucauugagguaggucuuucaccuguaaacaagcaacagcuauggugguggccaaaaugcugcuugagaaaaaccauuccuaucuaggguguucccacugaauuccacagcgacagaggcacucauuuuaccugccaaauacuagaacaaguuuuuuaaaucugcccuuuuacagcacuuucacugugccuauuacccccaguccucugggcuaguugaacagucuaaugggaucauugaaagcgagcuggcgaaaguuacagaaacuuaaccuguccuugccuaaagcucucccauuagcauuacugauucugcaguccauucccaccaguaaaugucagcucuccccuuuugaaauuguuacugguuggucugugcacuuagaccaggaaauauuuucuccugccaaaugacaggagggaacuuuaggcuuauugccaggggcuuguuaaagcuauaaagaucagucacugcaaguuguagaaucuuuuuacagcuucccaacaggccauaaacuccaguauuaccaccuccagcuuggugaugacaaguaguggaagagacaucaguuaaaauacuucauccagccuacuggaugggugcuauuaauuaauccuugugcugcuaaguuauagagauugacuccuggucgcacaugucucaucugaaaacaacaacccuugcugaaucuuggaaguuggugccagucucuacacgagacuucaguuaaccagagccucaucuuuagacccagaaaaaggcaauagucaacauaaacugcuuucaugagacccagggccaggacuguauucaaagacacugggucucauuuaauaauuugccucuaucuaaacuaauagaauuuguuccaugccuuucugcuagauaacuucgauguuuagcuaccugugugcuuccucuucuugucuuuaucagaacugagcagggcuuaugacccccacuccugaggacaucauugcuuuguuccuguagugagauguucucuuacuuaaggacagucccuuaaguuugucagauaauccccuuggauuuguaugggauuuaugguuuuucccuugguucaguuuucugaauuguuaaauggcuguucccuccauuccuuuuacucauaccugcacugucaccuuucccucucuuugcaauugucccucugucuugucucaaugcagagaauggcaugauaacacuuuaguuaagcugucccacauguugcuaguagaaggaaaccuauuggauugcuggauuugccaacaacuuccuugauccauucauaauagauaugugccauugguaauaucugucacugacugcucagaugucccuaaugucaccacuuacccagaccaaccccuuucccuguugauuuuccagguccaauuccuucaaagcccagauauugucaccccuuguuuugauguguccuguguuuuuaacauuggaaacccauucuuuaccaugggaccuucuuuguuguuguuguucuuuggguuuuuuaugguuuuuuuuugagacugagucuuggccuguuacccaggcuggagugcaguggugagaucucagcucacuauaaccuccgccucccggguucaagcgauucuccugccucagcaucccaagagcugggauuacaggcaccugccaccaugcccaacuaauuuuuguauuuuuaguagagacuggauuucacuguguuggccaggcuggucuuaaacuccugaccucaaguaauccaccugccuuggccucccagagugcugggauuacagacaugagccacugcacccggccuaccaugggaccuucuugaccuaugaacuacuggauagacaagugucaucuacaucagauaaauaaaguuaaaaauauaucccuacagugcccacaauauuuacauuuaaaauaagugaguggauucuggaaagcuugcaagagaaauggcccauaguuuaguuuggugaugucagcacuccgcaugaauacaucugcuaauuaagacauccucaggaguaucacuugugccccccauucaggcuguguguuuguauguggcauaaggucugauccaccugcacagcuuugggcacacuguugccucggcagccuacaguuagaagguucaugcuugcugagauauuuuguaaccccccguauccuuacacaaacuuacagaaggacccccuuucucuccauuauuaaacuaaaaggucuguguuggcagggugugaaggugauacagaucaaagcauccugggaauauuaauuccgaguguugggauuuaugucaauaaggauaugauuugaaaagucuuugccacuauuagucacauuguugcgggauuuaggaguaugagagaccucggguugaaacaggagaaucuuuuauugagugcacucaggcccagcagacucagguccaaagacugagcccgaaacaaagacagcacuugacuuuuauacacacuucacaaaagggugugggcuagcuugaagcaagcuuacaguggugugaaagcagggauacagaggcaggacagacucaggauugcucaugaccauugccaagcaacccagguguccguuaucuagguuugccuaggcacgggcuuaucccauaaccuucacuguggggcccaggcagcuguaguucaggccuacucaggcuucucgugaccuuuguuguacuucuuagauaaaacagaauacuugaaguuacuaguuacagagaacaagaaucuauaaacucauaccauaaagcaaaggaaaauuuguuuuucuucuccuuauguugagggagugcugggagagucuccacagcacauuagauaccauuaucaagacuuuuccugggucuggguugugccuguugccgccucugggacaagucagucuaauacaggaaaacuuauuucucuaucuuuuuaauuuuauuuuucuuuaauuucccaccucaagauagcugcagacacugcaaaaagccuuguagcucaacaaaagucucuaaacuccuuggcucaaguaguacuagauaauaaaguugccguagauuuucuccuagccaaacaaggaguuguuuggcccauaccuccuguuacauaaguacuucaggugaaauagaaacuguuagaggccgggcgcaguggcucaccccugugaucccagcacucugggaggccgaggcgggaggaucacaaggucaggagaucgagaccauccuggcuaacauggugaaaccccgucucuacuaaaaauacaaaaaauuagccggguguggcggcaggcgccuguagucucagcuacuugggaggccgaggcaggggaauggcgugaaccugggagguggagcuugcagugagccgagauggcaccacuguacuccagccugggugacagagcgagacuccaucucaaaaaaaaaagacacuguuagagaaagacuauccaaacaaccuuaaaugguuacaagagcuaugaacuacuaauccucucaaugaucuauuuaguuggcuuccaacuggccugggaaaucccuuucaaacugcuaaguguuugucauauucauagucuccaucauacuuucuuucuuaacauuuaaauuacuuauaauaggacugcaagaaguccccuguuaaaaccagaauuaugauggcucagugcguagaacuuacaggcaaguuaauuuuguagccauuccuuuuggcucuuauaucucuuauaccuuacggguuagugagggccugccaucucucuauuccugguugaucuaggauguccaauuggcuaucguagggauggaucugggacagauagccacaccacccuggcaaugacaugggacaaaauaaagauuuggcuauuggugcugcuugcagcagaucguggcuaaaauggggaaacaugaaauaaaaguaaauuucuaagcaccccccugccccacccgacugacugaauggacacuaccuuggccaaggagaccccagaaaaacucugaaagcuaaguuuuccagccaugauuagaugagaguuuggucacaccucaguacacccccuuccucacuaaccgauaccagacuuuuuuuguaagcguuaaauagaaaccagcccuggaacagaaacaagacucacuccucugcugacuucagccaaccaccugacaccacagccagacuccccuccuuuuuugugguuuugacaugacagcugaccaguuucaccgcgcauuccuuccugacaagugaccaccagucacagacuaguucuggcugguuuacucaggcugugcaccuuuugacauauaaagcuuaauuuuacugcauuuuaauguuaagucuccaccccaaagugaacaugggguuuguguaacauguauguuugcuuaucauacacgcaugaauccaccuuucaugaauauacauagcuccuccuauaaccuguuaaauauguacguuagccagcccauuuaguguaaaacuccuguuccccacuucuuccuuugaaaugguugcuuuuguucucagccaaaggcucugcuucccagccugcagguugcacgucaauaaaagaaauaaaguucuucccuaauguauagaucucgugauuuuaagucaacacccuacagaaagucugucuccuggcuuugucuguuugcuaaauaguagugucauugagcuuguucucuaaucccccguauuugcuauaaacucgggguuauaucuaaagacuagcaauaucuaaaaaacaaauugugccuuauuugcugucccuuuguauuccuagaucauaggugacagugaugugacacgauucagugagcccaauaacugaggcuucaacuuaagaguugugguuuucuccugguuacaaacagugccguuuucuacucuuacuuuguuuugaaaacgaaaagucaauauuugaagaacucuuaaauaauaaaguaggugcugcuuuucaagccagcuauuugaagaaaauuaaugaaaaagaaacauuacugaucuauauagggugacaugcuacugaauguaugaauccuucaguuuucuccccuaaugagaaguagcaauuuuccacuuugccuuguuuuuguuccuaucauucccucccacccguaucucuuacuuucuuagcuuuucaagcuacuuacuaucuuuagcuggaucuggcuagacauugguuuucauacaguauuugucuaguuuguuugaguuuacaugccaauaggcuuaugucuaauagagacuuuuaauuuaaaagauacuauugucaaccucaaauaaccaaaaaggucagaaucuaguuuacagaguuuauucaagcacaacaguugaggacugcagcccaggacacacuuccaaguugccuuggggagugcuccagagaacaaaagagaggcucaaauuuuuaaaggacaaaucaaaagguggggcgcgguuacaaaaaugguuaaucagggauucucauugguuuacagaaauaacauugguuagugauuggcuauguauuguugaacuauaggguguauggcauuuuagggccacuuggcgucagucuagagcccacauagcaagcggcuucaagaaguaauuauguagcucaaaggggagugagcuuggacugcugugaacauuuuaaaugccuuucugggccugaucauuuaaaggugcuugcauuucucagauccaagguuuuuguuucucacuaucccuuaacauagauaagaacauuuugaacaaauuaaauaaauaggauuuugaguggcuuuguuuucaugauuacaucaugagucuuaauguucaaaacauauugacucacauuuggcuauuugauaaugcauucuuggaucgggagccuuaaccacuuaaggugguaugacaguauggcuaaagcugauucaaauuccauuuguuguuggcauguuacaguguuuguaauaacaguguucccaauaauuacaugcuaauaagacuuuuaauuugcaaaaugcuuucauauuuguuuuugguuuugagccacauuuuguugcuggaaggagaaaguuuauguccacccuacuagugagaaaacugaggcucagaaagacucacuuauuuguugcgggugagcugugacuaucugggccagcagugcgaggguacaagaauuuacuaagacuggcugggcguggugccucaugccuguaaucccagcauuuugggaggccaagguggguggagcuccugaggucaggaguucgagaccagccuguccaacauggcaaaacccugucucuacuaaaaauacaaaaaauuagcugggugugguggugggcgccuauaaucccagcuacuugggaggcugagacaggagaauugcuugaacccgggagguggagguugcagugagcugagauugugccacugcacuguagccugggcgauagggugagacucugucuuaaaaagaaaaauaaaaaaaagauuaggaugaugcuaaaguguggaaggaugguggguggucagcugugauuaccacugucuacaucugcauggccuuuaagugcuucucacugcacuugggucaagggacuuuugaaggagucuuccugcauuucugucugcccagauaaacccagagacuauacugggacguaggaccugcuuuccucaucagccaggaccuauagaccuuucucaucccucauuucccccaucccagaucucaaauccucaagcagaauauccugacacucuggccugccuucagcaaaaauccaucaaguugaguaaacccagaaucuucccucaccuuugauguuuccucuuaguaauuuuucaucuguugauccccauucuacuugguggcaauaaauccucacuuguccuuguauucaaaauugagcccagucccucccccuucugcaaaaccuucccuucugucaguagucucucuugaauaaaggcuuccucagagucuuugacaaguguuaugaauaauuguuugcuuaacacugcacaaaggggaaauggucuagaagagauacagaccauuucuguuuuccuaaugaucagugaugaucggugacccuagacuaaaccucucugaaggauuauuuuaggcagaaaggccucuccccucuucccuggguuuccuuucucagucugccccauuuaucuaauuuccuguacuuacuuauaaagaaacuagauaguaauucuuuggauugggccauuccaccaaacuucuauauuguauguauaguauuagaugauguuuauauguuaauagcccuuuuaaaggguaccacaucccacccaucuuuguugacauguuagugcccaaauaucuuuguaguuuucugcauuuuacuuuuuccccuauuguuucaaaugccuggaauacucucuucacugucucuuaaauuuucuaaacucccauucacuuucaaggugugucuuauugguggagcagacacuccuggggaccaacuuggcagaaauuagaaugagaacauaccaagaagcugaaacuuggcagaaauaauguagggagucuguugguaaucagcugccuaccaccaccgcaaauuuugagauucuccuccugcuaaaagcuaaauuauguguauuuucaauaagggaggcauuuuuuuuucuugccugugaccagucacagucugacuucauaucuuguuguuccccauguucccuuauauucuacagcagaacagagcuuucuguugcauccaguauuuuaaaaacaagugucuguaccauaacugagucuggugucuucugaccucucccuuccuuacacugucuucccucaguaucggcaggagacugguuccagaaccuccugcagauaccaaaacccuuacauaaaauggcuugguguuugccuguaaccugugcauauccucauguaugcuuuaaaucaugucuagauuacuuaaaauaccuaauuugauguaaaugcuauguaaaugguuuuuauaccuuacugugcuuuuauuuauauuauuuuuuauuguuguguuguuauuuuuauuuucuaauauuuucaaucgaccugugguuggcugaaucugcagauccagaucccagagauacagagggccaauuguucuucucuccagcagccagaacagccuguagcucuuuacaagcacugugcucuuucccaucuugaaggcuuugcucccgcugcuuccucuuugugcaguuaccucucuuccacuggauaacagucacucauccuuuaagauucaguucaaugaugacuucuuucuggaagccucuucugagccagccaccagacuagguuggguguuccucuucugugucccauaguaccaguguuuacuucuaauauuucauaauugucugauaauggaucugccuuaccaguucugcggugaguuucuugaaagcaggaauuauauccuauucaucuuuguaucccauguuucuagcacaguaguugacaagugguaggcacuuggauauuguuugaguagaugagugugugaacaaaaaguuuaguaacagaagcuuuuuauuuaaguacaaguuucauguagagacucaauaauuaaucagugacuuuugcuuucuacagauauugguaucaacuugacugacccuauguucagaggaauuuauagggggguucaaaagcaucaagguaaauauuuccuuuauuaaggcgaauaguuuccuaugaagacaaauuuucugccucaggagaucuugaaaagcauaauucaagcugagucuuguggcucacaccuguaaucucagcacuuugggagucugaggcaggaggauugccugagcucaggaguucaagagcagccugggcaacauaauccgcucuuaaaauugaaauaauaaagaacuccuggcugggcgcaguggcucaugccuguaaucccagcacuuugggaggcugaggcaaguggaucaccugaggucaggaguucgagaccagccuggccaacauggugaaaccccaucucuacuaaaaauacaauaaaauuagcugggcauggugacaugcaccuguaaucccagcuacuugggaggcuaaggcacgagaaucacuugaacccaggagguggaaguugcagugagccgagaccacaccauugcacuccagccugggcaacaagaacgaaacuccgucucaaaaaaaaagaacucauuaugcauuuuggauaaaccuguaaacaaagugaaacacauuuauugauaaaccaugaucaugaacauuuauaauaaaguuuaauuaaggucuucuuaccuguagaaguuuauaauuucaaauauaaaacuucaaauagccauuugcacagaagcuaaaaaaaaaagucaaauuuuugucugccagguuuucauaauacagaguuuaucuuuuacagaugacuuacaggauguaauagggagagcugucgagauugguguuaaaaagguaacauccauuuuguuauuuuugagauuuuuaaaauucauuuuuuaacuaaauuuuaguuaaaauuuugcagaauagaaaggaacaaaccaaugccacaguugggguacauauugucuacuugugauauuagaaaguuaauugaaacaaaauaucaaaauacucuguucauagcaauuuaaguuacacaaaucucauguauuguuuuuauauaugauaaauggcaaaagcuccuugaaaaaaaauuuuuuaaaccuaugugaauuaccaggcuuaagaggcaacuuuuaaucaauuuuauaauauaauuuagcauuugucagaauuaagcaauaaucaaaaauacauguaccugacaccaaguguagcuauuuauaguuugggcauaccauuuaaauaauggaguaaaacuuucauuuuuacaguaauaaaaugccuacggcuuuuuagagaguucuacuaagcaaaugaauagauauuucuuuaaauuagcuuuaaaacagagagcuagcccacacauacacuaagaaauaagguuaaauuccauacuaugcuaccaggacacuugguagcugcuaccuccaagaugaauaacuuguuuuggaaagugacacugcugacuaaaugaguuugcagacuccaacucuaaacuuuuauuuguuauuauucacaaauaauaugaaaagauaaaaguuacauuaauuucucauuauagucacucugcuugguaaaucacuuuaaacaaugcuuuucugcagacucugaaauacuaggcuccuaaauuuucauguguuagccaugaguaaucuuaauguuuauucacacacacacacuuaggaaugacagaacugaagugauuuuuacuuggacaugguuccaaacugaaauuuaauucaauaccuugcauuuauaguguaguaguuaaaagcauaguuagggcauaacaaacgugguauccagccccuacuucauuuuucauagcuuuauaaccuggagucuuuuaucucacuagacuucaguuuucucaucuguaaaaugagaaugauaauaguacuuaauuaauagaguuguuaugaaggcuaaauaaaauauugaguguaaagcauuugguauuauaccuggcauaaacaaccuucauuauguguaugauggaagccaccaccaugagaucaucaucaucguuaucuuuuuuuuuuuuuuuuuuuuuugagacggagucucgcucugucacccagacuggagugcaguggcaugaucucggcucacugcaagcucugccucccggguucacgccauucuccugccucagccucccgaguagcugggacuacaggcgcccgccaccacacccggcuaauuuuuuuguauuuuuaguagagacgggguuucaccacguuggccaggauggucucgaucuccugacuucgugaucugccagccuuggcuucccaaagugcugggauuacaggcuugagccaccgcgccaggcccaucaucguuauuuuauacacugggagaggagaugaugcccucuugucuugccguuuuuuucaacuauuuaguaaaguuguagguaaaauaaaaaguauacuugguuaguauuuuacguaauuuaaauacuggauguaggcaucuguucuaguauuaaaguuuuagguauguuaguaacaagaaaguuuucccaauauuuuuauuagucuuuuuuuuuuuuucuggaggcgagucucgcucugucccccaggcuggagugcaguggcacgaucucggcucacugcaaccucugccucccggguucaagugauucuccugccucagccucccaaguagcugggacuacaggggccugccaccacgccuggcuaauuuuuguauuuucaguagagacgggguuucgccauguuggccaggauggucucaaacuccugaccacgggugauccaucugccucagccucccaaagugcugggauuauaggcgugagccacugcgcccugccuuacaucuucugcuuuacagauagucaaggauuuaauuauggcuauguuuccggaauggauaugcaauagcuaaucauauuaaagauuuaaauagcuauaugaaaauaucuauuuaucauuugcaauucuaccuucguuuuguguuuucucccuaaguuguaccuagaaugaauucauuuuagugagacuuuugaaguaugcuuuacaaaaauauacaucauuauacuugaaucacgucuucagaagaaggcgccccuuacgcagcacugcuucagugcucucacuaucaacacauaacucuuuagugacauuuucauuuuaacagauuaggaaagauggcauucuaauuacugagcggacucuaaugggucuaugcagaaguaugcuuauuugccaaaagccauacguuuuccuacagagaauucauuagcaugcauuaacucacugauucucaaaccuuuugcucucaaaaccacuucacauucuuuauuauugaggacccccaaagagcuuuuguuugugugagucuuaccuacugauacauacuauauuaaaaauuaaaacaaaauauuuuaaauauuccuuuuaaaauaagaaacuacuggauaacauaaauagcauauuuuuaugaaaaauaaguauauuccagaacaaaaaaauuagcaacaugaguacaguuguauguuuuuucaaaucucuaaugacuguguuacuagaagccugcugaauuuucauaucuuuuucuguagucagucucugguggugucaaacaucguguagcuucuugaauaccuuguggacacuugcaguagagugagagugaaaaagacagaaagugucuuauuauuguuaggaaaauaguuuugacuucacauaccuacugggaguuaccagacuacaccuggagaacuguugaaucaaucaacacuauugaaucauugauuucguuauucacgcuuucauaacaccugaucucuguccucaaggaaugcauugucuaauaggaaagguggguauauaaauacauuuuaacagagucuagugaugaauucugcaccucuacaugcacacacacauacauacaucccugagguguagucaggcacuacucugcauaggagguaaucucccagcugaauuuuaaaggguagguguguggcagucacagaggaaagagcauucuggaauaaggaagugguaggaaggcauguuuaggaaacuguuauugcugcccuauuaaagucagcuuauuuuauuuucuuucuauuucaguuuaugauuacagguggaaaucuacaagacaguaaagaugcacugcauuuggcacaaacaaaugguauccucauauuucuuuuaccaaaaaaaaaaugaauuaaguaauuuugaagaagucuuucugaaaacugcuucagguacaauacaauggaucaugacuggaaacaauaggaaaauggacugauuuaaaugggacaugauuaagaugacaaaauucaaaguacucauugguauaucagauguuuauaaaacuguuucauacugcucaaugaagauuauuuuaagauuucagcuaaugagaauaaaguucuccagguacacaguuuaaccucagguguguuuuuuuuuuuuuuuugagacggagucucacucuguuacccaggcugaagugcaguggugcgaucucggcucacugcaaacuccaccucccagguucacaccauucuccugccucagccucccggguagcugggacuacaggcgcccgccaccacgccaggcuaauuuuuuguauuuuuaguagagacgggguuucaccauguuagccaggauggucucgaucuccugaccucgugauccacccgccucagccucccaaagugcugggauuacaggcgugagccacugcacccggccuuuuuuuuuuuuuuuuuuuuuuuuuuuuuuugagauagagucucacucugucgcccaggcuagagugcaguggcgcaaucucggcucacugcgcgcgccaccucccugguucaugccauucuccugccucagccucccauguagcugggacuacaggugccugccaccaugcccagcuaauuuuuuguauuuuuaguagagaagggguuucacuguguuagccaagaugggucuugaucuccugaccucgugauccgccugccucggccucccaaagcgcugggauuacaggcgugagccaccgugcccagccaaccucagguguuuuugauguggaauucauguguguguuuuaacguguuuaagauacgaguugcuuuuuauuuacucuuuuuuaacuuaagcugugaagggccauuuuauuaaauuuuuacuagauggaccagauacugugcaagguaccaggaaugcaaauaauaacacuauauaaucucucauauccuugcuuuauguucauacauuuugcauuuguuuaaaaucuuaaaaguuuuaagacugauuauuaaaggaauccuaguuagguaaaaccucauuuaucuggcauucacgaauuucacuuuuuuuugcauuaucuuacgugcuagacacugaggaauuaaacauuccacauaauuuuuaaauuuuguauuuuaaaauacugauguguuuccuuuauguaugaaaacuuacuaaaagcuauauuuuuauggaaaucucucuaaaauccacacuugucuuuuaggauccauucacacuuuuucuuuuuuuuuuuuuuuuugagacagucuuguucuaucacccaggcuggagugcaauggcacgaucucggcucacggcaaccucugccuccuggguacaagugauucuccugccucagccuccugaguagcugggauuacaggcgugugccaccacacccagcuaauuuuuguaucuuuaguagagacgggguuucaccauguuggucaggcuggucuugaacuccugaccucgugaucugcccggcuugcccucccaaagugcugggauuacaggcguaagccaccucacccaccccauugacacuuuuuguuagugauuaaagauagacuaucuuccagggaguuuuugaaauauauaagaacauuuuauccuuacuuuucauccccaaacagcuaugcuuuuuaaaguucucccaccuccauuaccagcccucuuccacuccucuccauguaacuucuguucuuacagcuuuaaaagugcugcuuccuuuuuuucuaaacaucuacaugagagccugaggaaagcuugauaccuuucccaugguucgggcucagcuaagccauucaaaaaguguuuuugacuucucauuuguauucuaugcaagucaagcugucagagucuccuccgaauaagugaaccucauuuacuugcuagaaaaacaaaucccccuuuccaccacuuuaaaucgcccccacuauuaaccuguuuaagggaauacauuuuuauugcuauauuaaauacaugaaucaauaauggaggaauagguguuaaacaaacaaaaauauaccaaucaagauagucacaugaauggugaauauaaaagauaaaaucagugcuggucaugguggcucaggccuguaaucccagcacuuugggaggccaggcagguggaucgcuugagcucaggaguucgagaccagccugggcaacguagcgaaacccugucucuaccaaaaaaaaaaaaauuaaaaauuagccaggugugguggcaugcguauguagccccaguuacgugggaggcugaggugggaggaucgcuugagcccaggaggucaaggcugcaguaagcugugauagcaccacugcacuccagccugggugacacaguggcacccugucucaaaaaaaaaaaaaaauuucacuuugcauucuacagcccuaaaugccaagcuuuagaaaaaguugaauuauuuuauuaauacauuaaagcaauuuucauauucaucuccuacuuuguuuagguauucuaaaaauugucauaugauuaacauaaugcaguucuuauaauuugaguaauuuauugccauuguugaaaaccaguugaaauuacuugauauccucuaaauaucauaauaaauauaaauaugagaaaauacuuugaaaauaauccuaagacauuauuuucuguuagguauguuuuucaguacaguuggaugucauccuacaagauguggugaauuugaaaagaauaacccugaucuuuacuuaaaggaguugcuaaaucuugcugaaaacaauaaagggaaaguuguggcaauaggagaaugcggacuuggugagugccagccucgccucuuagagugacauuguuugaaaauaaguaauuuguucuguauaaguuaggaguaauuauucuucuuuaucuuuuuaaagauuuugaccgacugcaguuuugucccaaagauacucaacucaaguaaggaaauuuguuggcuuuacaaauuauuguaaaaucaugagugauuuuuaaaauaucuuguaucaggugagaguauaguuggauuaagcaugaggauauuuuuguuuuucccuuuguauaucaaaaguaagugaaacaaauuccaugcauacuugcauguaauucauaagggauggaagcacauaguucccugguugauuaaccauuuaauuuuauuguaaugguagaaauuagggaugaguuuuacaugauagagauuuuacauuuucuguuugcuuguuuaacagacgcauucauacgugaacaguuccaauggaaugaauuaaauuauuuuggggaaugugauuguuuuguuuuguuuuuugagacagagucucucugucgcccaggcuggagugcagaggcgugaucucagcucaccgcaaccuccaccuccuggguucaaaugagucuccugccucagccucccgaguagcugggauuacaggcaugugccaccaugcccggcuaauuuuuauguuuuuaguaaaaauuggguuucaccauauuggucaagcuggucucaaacuccugaccucaaaugauccacccgccucggccucccaaauugggagauauaauuuaagagcaaaggauauuaaaaguguauuacaagccaggcacagcagccugcgucuguagucgcagcuguuugagaggcagaggcaggagaauugcuugagcucaagaguuccagaccagccugagcaacauaaggagacuccgucucuaaaaaaaaccagcaagaaaaaacccacaaaaguauuauaggaucaaucaccaaagcuagaaaagcuuauuuuacucuugcugggcauugaauauugcuaguuuggaacugugagauuccuuuaauaggagccauguugaaugguggcuucugagaaaacuccaaagcucacgacccugcaggacuuccuguaacccauugccuggagcuaaauuuggagcuccugucaucauacuggugggugaguguuauagauugaaaagaaaauuuaggucacagucugaauuuaaaacguaagcauuuuguugaauuucaaaaacaucuuaauuaugaaaaugauaaaacauuagacugagcuucuaaaggggguuaauuuauucauccauugaacaaauauuuauggaguacugugugccagccacugcugagagcucauaguaugcagaaauaugaauaagguagaauaucugucccuagagaccuuuaagaauaaacaauccucuguccuccuuaguuucuuauacacaaagaagaauuaggaucagauucucucuuaagauaccauccagcuauaucauaauguuuaacaauuaauaauuuugucauauggugauaugaucauaugauuaagccagugacuugauggccugaagggauuuuuuuaaauuacgcaugaggaaaguguacuuccucccgcuucccucccugcuccccacaaaugggauucugauauguacccccugguugaaaaucacuuuggggaggagcagaucugcuaguggagucugucauacccuagaccucaagcuccaaaguucugaagugugaagaucuauaaccaaguagaauaggauggguuaacguaaugcucuguggauaccuacucucucuuuuaggucgcucauuuguacaucccuuguagaacuguuuaguuugugguauauuauuugcugauuugcugugccuuucagggacauucaugugguuacuagcaggguuacugaagcccuauaccucugucgaauauuauguaggccagcucacuuaaccuuaaaaguucucguguucacauugaaauagaaaaacaguucucuuuaauaguucuuuagguuaagcccagauaucauauuccucaacuuucaugucugguuuuggucaggauaagccuuguaagucuaauagacuguguuaugacaagcaagggcaauggcagaguccccguguuuuuuugcccauaugacuuuucauccaaaaugaguuagaacugauucuaaaaugcaaccucaauacuuuaaacucacuuuugggauuaaucgaaaacauugacaguaucaguuuaauuuaacuguucugaagauucuucaccaucaucagaauagcgucugaucuuagaauaugcauaucacagcuugugcuugaacucacaugccaagcguuaauugcuaauagagagguucaaacuacauucaguaaaugauuaccaagugccuccucagcaugauacaaagaagaauaagacuuuuuccaagagaggacauaaauaauuaaaauagguuggaagugcuuacuaaaguaugugaacagcagagggaaggacugacuuucugggggaugcucuaaggugacagcauaugacacuggcuucuuccagaguggauaagcuaaugacaaaguaggaggaaauuuugauaagauaggcaguucuacuugagauuuuuaaaauuuuaauaauaaaacaucaaaugacuugguuaaaaaaacagccgggugcggugguucaugccuauaauuccagcacuuugggaggccaaggcaggccgaucaccugagaucaggaguucaagaccagccuuaccaacauggugaaaccccgucucuacuaaaaacaaaaacuagccaggcgugguggcgagcaccuguaaucccagcuacuugggaggcugaggcaggagaauugcuugaacuggggaggaggagguugcagugagccaagaucgugacauuggacuccagcccgggcaacagagaaagauuccgcucaaaagaaaaaaaaaagacacacuaguaacaaucacauuuugauuauuguuaaggaaacaaauacccacauucucugccccucacuccuuuuccccucgcauauacucacagcaugcaaucuguuuuguauacacagcacucuacuuguuucagcacuuaccauguuguacagaaauggguuuucauuaucccuuccuccccgcaacagacaggugucuuugaguuccucaaaggcacacaccaagucuuacucaugugacaguuccauagcacuuagcacaguacucucagcacaugguaggcacuuaguaaaugucuguugaauauuuaauacagagggaagguucuuuucuuuuuuauucccuuugagcagcauggauaaaaagccuauaauucagcuuucacuauuggguuuauuuuuggaagacuucagauuuuggucugcacuuuucuaccaucuggaacaaccaguguaugauuguguuuguuuguuuguuuguuuguuuuuugagauggagucucacucugucccccaggcuggagugcaguggugcaaucucagaucacugcaaccuccaccucccagguucaagcaauucuccugccucagccucccaaguagcugggauuacaggugcccaucagcaugccuggcuaauuuuuuuguauuuuuaguagagacagaguuucaccauguuggccaggcugguuucgaacuccagaccucaagugauccgcccaccacggccucccaaagugcuaggguuacaggcaugagccacugcacccggccaugauuuguuuuuaaguaaauauguagucaggaaaaaggagauguaugagaaaagaaaaauagaaaauuagggggcaagacagaaaaauuaauauacaauagauguagugucugaaaaauaaugguaagugaaggcgguguaugaccauguuaaaaggaugagcuuuggaaucagcagaucuuugggugagauuuacaacugccuuuggugucacuucaucccuuugugcauccccuuuaaaauggggagauugcugccuaccuuucuuaacauaaggcacauaaagcccauagugacaugagucaugcagaguaugugcacaaucauggcuguuguuacauuccucauacuagaaauaauuaccacccuaaaggaagaugcuagcuauuguuuuuguuuggaacuuuuaaaaguuuuuuuuuuuaauacuuuuuucuuguuuuaguaccuagaccuuuucuggaaaaaguauuuuuuaaagacuaagaaagagaagcaaagagugaaaacaaggaaaggccugaucuacuuauggaaaguuuauccuuuaagccauacccuguauuuucaauuuccuggccuuaugcuacacuccuuuccuuguugcaauuuagagcucuguucucuuggguaggaggaauuugcuuugggcauuuuucuuggggcuuuaaaauguuaacacugugcaggucuuaaaaacuacaacaagaagauuuuaaaacaauccuuuggggauuuaggggacccuagagaugagcaauugaggccauguugccaucaagcagcuuacagaggagggauuacuacuuguguugagguauacccaugaaacucacugggcuuuuuggauuugccuugauccuaauuaauaacaacugcuccugaagcugaacuuuuccagcucuugucguuagauaguuaaaccucaacuguaagaagcaguaauaaaaucagaagcuucacuaagaugagcaaauaacucaaguggaaaauuauuuucauuuaugaacuuuaaaaaaauaauaagugaguaaaacaggcagagaagucucuuaauagaugccaauuccuacccuguaacuuauacaguuauuucuaguuaccauggcggguuuuucuucucuaaagauaauagucguuugauguucaguacuaguuauccucaauuuguaucauuaggaauaauuuuuuuuaccacauggcuucuuuaugauacguagcuagcaugacuucagggaccuuucuuuucuugaauuauguaaaauucugugggcccauugcuugggcuucuguuauuuucuuuuucuuuuuucuuugagacagggucucacucugucauccaagcuggagugcaguggugugaucauggcucaccgcagccuugaccucgccaggcucaagcaauccucccaccucagccucccaagaacugagacuguaggcauaugcuaccacaccuggcuaauucuuguauuuuuuguagagaugggguuucaccauguugcccagguuggucucgaacuccugagcucaagcaauccacccaccucagccucccaaagugcugggauuacaggccugaaccacacacccagcuggccucuguuauuuucauaaacuguacuuuugccuacauuccuauaggaagcuaauuuuccauccgaccauuagauacugugaauuuguagcuuggucaugugguuugguccauggaauuguguguggaaaaaauaaccaguacagcguggagcagugcacacaaugaagaguaccgccugcuguguguagucagagccaaauauauuaguaaaguugacauaaugacuagugcacacuuaacugcugacauuugguuuacuuuagagguuauggaaauagugacugguuauauuaucaaaaucucuuuuuguccaaguugucguuaauauuuccuacacugcaaaauuucagcacuuuguuaaugaaaggaaaauauuuuugcuuauucuaacccagcagaaucugaaaaggagauuuuaaaacccaaacauuugguaauacagacauagacgaccuauuuuaggaagacuauuucuauuuuuuuaauuuuuaauuuuuuuuuuuuuuuuugagacagaauguugcucucucacccaggcuggagugcagugguacaaucucagcucacugcaaccucugacccuggguucaagagauucucaugccugccgaauagcugggauuacaggcaugugccaacaugccggcuaauuuuuguauauuuaguagagacgagguuucaccaugcuggccaggcuggucuugaacuccugcccuugagugauccacccgccuuggccucccaaagugcuggcauuacaggugugagccaccacgcccggccugaagacugcuucuuaagaaguacauuucuauuucuaauuuuaaaauuuagcauuuucaagagagcaaaggggguaaaauaguccugcacaucaggaaauaugauauagaaaaauauagcaagagaggcuuaaguuaaacagagaaauuguuuccccaaauuaaagugcuuagaagagguaagcacauuuaagaaaauaauaagccaccuguuauccugauucaguugaaccuaccauuugugagaacaagggggagcacuguguugaagugaaaagacaaacagaaugaacauucguuguauccucugaauauugucauuauacuccgggaccagaaggaagcuucuugaaaacguaacagguuuuugucguuuaggcugggacuuggaauuagagcagugaaguucuguuccaaguuggccaugccagguauuguuaucuuggacaaaguacuacaccucucugacaccagcuuuuauacucagguuauuuugaggaucaaaugagacaaugguaucugguacuuggaaaaaccuucuuaucaaguacucuuuaagauauucagggcuaccacuuuaucauguaauuuucuuuuuuuaauagcauaauugaguuauuugcuguuuagcaaauacuuagauuucauuuuugagggaaaccuuguucauuuugcccaguggcaauaacuucuuuuauaacagcacauaaaaaacugguugcaaaauggaauagauuagcaugcaguaugaagcucuccugggcuucucgcuuggugaguugacucccacugauggugcucccaguggcaaggggccagugguguuacuuucugaaaauuaaagggcccagauaauuuuguaagcccagaaaaugaaguauuucuuuccagaaguuguaaguuauaaaagcccuuugauaagccugaugugcuuuaaauauucaugauuuuuguccuguaauuucuagagaauuaaauaccuuuaauuuaaaagcucuuuugacaucauuaccuuccucaugcuaaaauacaauuuguaaugagaauuuuuuuuuuuugcauuaugcagauauuuugaaaaacaguuugaacugucagaacaaacaaaauuaccaauguuucuucauugucgaaacucacaugcugaauuuuugggugaguuaaaaccaaagucucauucagaacuuaagaauuuuguagaaaucaagcuauuugcuaaaaguucuuuguuuuuaauucacagacauaaugaaaagaaauagagaucgguguguagggggagugguaaguauaaaauagucauuuuuaauacagguugaacaucucuaauccaaaaauccaaaauacucccaaguacaaaaugcuccaaaaucugaaccuuuuuaagcacuggcaugagauaaugacaccuuugcuuucugauuauucauuguacacaaauuuuguuucacgcacaaaauuauuuaaaauauuuaccuucagggugugguauaagguguaugugaaacauaaaugaauuucauguuuagacuugagucccuucccaaagauuucuuuuuauguauaugcagauauuccaaaaucugaaaaaaucugaaauaugaaacacuuuuggucccacacacuugggauaagggauacuuaacauuuaugugacacacaaagcaucuugguuauuaaggauggccccuaauucagaugucaacauuuaaauuuuuuuuaaaaaggaauaacaaagaaaaacauaggaauuagauagaauucaauagaauuaggagcuucuuuucccauccuuugaaagacauguaaauuuacuguugaauuuauggaccagguguggcauaaacacaaaucaguuuuaauuacaguuccuuuguucaaaguacaagaaugcguacagaauuccauucacaagaaaacccugugaaauuuuuuuuguuuuuuguguguguuuuuuguuuuuuuuuuuuuuugguuauuaagaaagggucuggcucugucauccaggcugaagugcaguggcacaaucucagcucacugcaaccucugcuuccccgggaucaagccauccucagccucccaaguagcugggacuacaggcaugugccaccauggccagcuaauuuuuuuguauauuuuguagagaugaaguuuuacuauguugccuaggcugaucucgaacuccuaaacucaagcaaucugcccacccuggcuucccaaaguguugggauuacaggugugagccacugugccuggcccuugaauucuacacauccuaaugcugugcaugauauucuucgucucuucugucagcuguucuuuaauguucuuccauccaaauuuugagcaaauauaaacuaauuuuuauguuuugaaauauuuuaccauuuguuuuagguuugccuuucucauuucuuguccgcuguauucaccuacuauucugaucuagagagucauucuccuuucuguaauuugcauucugcacuaaacacuucucugauauagccauuuuagucauuauucuggagacauuucccauaaauacuaucugcuaaccacauaccuccgauaucuauggcagugauuuuuuuuuuuuugagauggagucucgcucugucaccaggcuggaguggaguggcacaaucucagcucacugcaaccuccgucaccuggguucaagcaauucuccugccucagccucccaaguaccugggacuacaggugcacaccaccacguccagcuaauuuuuguauuuuuaguagagacgggguuucaccauguuggccaggauggucucgaucucuugaccucaugauccuccccccaucagccucccaaagugcuaggauuacaggcaugagccaccuugcccagccaugauuuuuagucucuucgaucauggacuccuuuggaaaccugccuuagaaaaaugcucagauauacauauauucauaugcaauuucaggagagugacucagugagugacugugucuagcaaaagaacuguaauccagguagauuaaaucacaguuacacuaugccugcuaaggaaagaggaaauagcaccaagcacuugcauucccaugcggccugacguugacaguuuuaugcguauucucuaaguucaaccucugccucaucuauacuacuaguaauauguaugcauccugcauugcuguaauguuaauauuacugugcacuuuuuuccuguuuguacuaacucuguaauuuuuuccuguuuuuacuuacucuguaauuuauccuguaggaacuguacuuaagaauugagagggguuuuaguuuuaacuaaugccguugggauuauuagugguauuuauccuaaccuucagacucuaccucucagcccauuugcuuuauuucuuuucuuuuuuucuuuuucuuuuuuuuuuuuuuuuuuuuuugagacagagccuugcucugucacccaggcuggagugcaauagcacgaucuuggcucaccacaacuucugucuuccaaguucaagcaauucuuuugccucagccucccgaguagcuggggcuacaggcacgcaccaccacgccuggcuaauuuuuguauuuucaguagagacaggguuucaucauguuggccaggugggucuugaacuccugaccucaagcgauccaccugccucggccucccaaagugcugggauuacagaugggagccacugugcccagccuauuucuaaauaagaauuuacuuggguucuauuaauaguuuuuaaaauuaacaaaagcaacaacaaauccaaccuaaauguuugacuuuuaccaaaaaagaaauugccaaauaauuaauaacuaguuuucugaaaugguuuaugaggagucacuuuuaaaaugauuucgauauuaauggagggcaucuuuucuagucagcuggaaauggugaaggaaagaauaaugcaggcagcuguguaaugcaggcuucuuuauuguugagaaauauguuauccauaguguauucaggcucucuggacucaguaguaaugugaugucacuuguuuaggugaaccuacuuuuuaaaggagggcuguuguuauauguuguuuuugauuauauaaauacauccaaacuaugaaaacuaugucuugaccccuauaucuuugaaggagagaaauagcaucucaaucccuucugcuugcuaagcugauauuauugauuauauaaugguuuaugcuuuuuuuuuuuuuuuugagacaguuucgcugaucuccugaccuugugaucugccuaccucggccucccaaauugcugagauuacaguuuaugcuuuuuaagcaacagucucacccauuuauaagaauuucuucagccuugucucuuuuuuuguuuuguuuuuguuuuugagacagaguuuuacucuuguugcccaggcuggaguguaaugaugugaucucagcucaacgcaaccuccgccuuccagguucaagcaauucuccugccucagccucccgaguaguugggauuacaagcaugcgccaccaugcccagcuaauuuuguguuuuuaguagagauggguuuucuccacauuggucaggcuggucucgaacucccaaccucaggugauccaccagccucagccucccaaagugcugggguuacaggcgugagccauugcgccuggcccagccuugccucuuaaaaguaauuucucuuccacaaaaaaguauccucggccaggcgcgguggcucaccucuguaaucccagcauuuugggaggccgaggcgggcgaaucaccugaggucgggaguucaagaccagccugaccaacauggagaaaccccaucucuacuaaaaaaaaaaaaaauacaaaauuagccaggcgugguggcgcaugcuuguaaucccagcuacucaggaggcugaggcaggagaaucucuugaagcagggagguggagguugcagugagccaagaucgcgccauugcaccccagccugggcaacaagagcaaaacuccaucucaaaaaaaaaaaaaaaaguauccucuaacagaaaauucaucaguauuuuaaaaauucuuuuaaauagugccauaaaauuacuaagcuuuccucauguuuuugccuaagaauauaucuauuccuaaaccccuuccuggagcuucugcacuaaugcuagugcagagacagcaacacugccacucuaaagagagaaauucucggcagcuaacguuuugcaucaugucacuggagaugaugacagguuguaauugugaaaaauaauaugaaaauaaaaauuauagcgacuaccaccuuugaaacccugagguccaaaaacuuacagggaucuauauuuuugccuacaaagucuuauuaaugucacuuagaauuuuaaagaguaauuauuauaauaauaaacuuauaccuguauguccccaggugcauucauuugaugguaccaaggaagcagcagcugcuuugauugacuuggaucuuuauauaggauuuaaugguugguacguucuuagguugcuuugguuuuuaacuuuuauuuaagcagauuucuuaaauugucuuacagugaauugcugaugaagauuuauuuucauuaaaguuuguguguguuugcauugaucuuugcugggaauuucaguaauuauuuauuaagaaauuaaacaguacauuacuauuaaaaguuaaagcucgaaaguuauagacuacuacauuauguucuaauaauggaaaacaauuuuguguugagaucugcagcuggcuuucucugguaauccaauuuauucucaggucauuugaucccuugaaaacauguguucacagcauuauguauacauauacacgucauaucugacuauggacgaacgguuuauucugugacagucauacaucucugcagucaaagaaaccgaggcucaaagaaauuaggaaacagguauagaguuucuccaaguaugagaacccauguccucuggcuucucacucugugaucuuucugcuguuguaccacacuaaacuucacacacucaguacagucagcuagcacagcuaggucucuggguugguuuugucacauauguaagagcuucuaccagugacuuuucacaggaugucaguguagccuauuaaaucaguugcaaaauaguauaggaguuucuguccuucuucauugucucauacccuuaaaauuauuauguuuccaauugcauuauuuuugacuaaaaucuagggaaauagaaucauggaauuauguauuugcucuagaguucagaguuuaaaugucuaagaugcuuucauauuuaaauuaaugguuuaauuaacuuuaaaauuaauuaauaugcaagggaauauaugcauagagauuaaaaagucaaguaguacuaacagauaugaacaaauaucagaguccccccagcaugaccuuaccccaagucagcuuuuguagcagcaauaauuuugcuauuugucaccauauuucuaaauaauauccauauacuauugucucuugauucauccccuuugucuauucucauugggguauaugagcacauuaguucuuauaucccguacuaauccccuaccuccauucucugcauaucacucucaaugucguuauuucagaauuuuugguuauaugcauacucaauguuuucauuauuaugucuauauaaauguuguuuccuuauuaugccuauauaaauauauaauuucacagugcuaugccaaguaugagaggguuucaaguuuuuuguuuuuugguuucuuuuuaaagauagggacuugcuugcucuguagcccaagcuggaaugcaguggcgugaucacaacucugcagccuugaccucccaggcucaagcaacccucccaccucagccuccugaguagcugguauuacuggugcaugccaccacaccuggcuauuuuuuaaauuuuuaguugagacagggucuugcuaugugcccaggcugggcuucaaguuuaagaaagccaaguaaauaaaaauaugagggagguuaauccaggaaaacaaaaaguaguacaagaaaagaaauguuaagcacaguauaccacaugagcaaaccuauguagauaaucuaauaguuccgucaguugcagacccuuccauguguuucaauuuggacuaguuccuauuuuuagaucccauguauuccuugcguguuuguuuuaguggaacacauucuauaacauccucugaggauguuuucaugggaauuaaguuucuuuuaaauacaagccaguauuucuauuuaauaagguuucccauuuagugaugagcaacuacacgauucugaagucaaguuugaaauacaucuucccauuuugaaaaugaauuuuuuuucugcucuuccucuuacaaguuagccuggauaguuaaugaaaggggagagaaccccacuuuuuuuuuuuuuuuuuugagagggacucucacucagucgcccaggcuggagugcaguggcgcgaucuuggcucacugcaggcuccgccucccggguucacgccauucuccugccucagcuucccgaguagcugggauuacaggugcccgccacuacaccuggcuauuuuuuuuguuuuuguauuuuuaguagagacagggauucacuguguuagccgggauggucucgaccuccugaccucgugaucugcccgucucggccucccaaagugcugggauuacaggugugagccaccacacccagccccccacuuucaauggauaguucucuugaauaaaauucaagaucagaaaucauuuucauugagaauuuauacugucccaucaguagguuccaguguugaugaaaaguugcuacucugauuccuaauccuuuaccugugaccuaguuuucuucucuugugaaagguuuuaguuuuucaucucugaugugaaauuucacgaagguguguguugaugguuuucaucacgccugguguugcuuuuucauuagcccuuccaguggggggcacaucuuuacccguccuuggaauuugauuuuucucuucuguucuuuucuugggcauacuagacugauaacucguauucuuuuuauucuauuuccauuguuucccuccuuccaaaaaaagugcuauauuuuguaacccuuuuuaugaaauuuacuucaacuuuuguuuucaauuucugaauacucuauuuuuauacugcagugucuucucaucucucuaaagacaugaauuauaguuuaaaguuacuuucugcuugucuuccugcauuuguuuccucacagucaccuuuucuucuuuccuuuggucucugugaugauggaaacuuucuucaaaugucaggcaguccuucacugucuauuuaaaaaaagaaaaaaaaaagccauuuggaagcucucuagaaggcauuccagcaacuggcaggcucagauggccaacugacuuuuugcuagggauucccaaaugucaguuuguagagaucuuuuucuggguugguucaguuucuccagaaagggauccuguguucucugcuggaaaaguggggaacaguggagggaagggguuuguaaaugucccugacaguauuuuggagcaggauggguuagaggaucucacuguuuagugggcugccccagucuccaugcucaggccugugccugacgccuguacuccucugugcuuguuguucuccagcuguuucugauguggauugucuugagacccagcaccucuuucucugcaccaagucacagauacauaaccuaggaaccccaucuucucuuggaguuuucucaaagaaucuccauuucagucccugccuuacuccacuuucuagggacuguaucuacuucuagguuuguuugucuuucuuuccaggcacauagcauuuaaguuacuuggcacuuaaacacuggucuuuuaucauuucucuguccacuuucagcuauauguugugauuugggguaacauaugucuccuaguuucauuuaaaaaaauccugguuuucucccuguaaguuugguuuuguuuuuuuuuuuuuaagagaaggggguagaagaucuuuauuuuaccaacuuaaaaccauaauucuuaguuguuguuuuuuuuuuuugagacagggucucacucugccucucaggcuggacgacuuacuguagccccgaccuccugggcucaggcgauccucccaaguauaauagcugagaccacaagcuccuaucaccaugcuuggcuaaugucuguacuuuuuguagagaugggguuucaccauguugcccaggcuggucucaaacuucugagcucaagcuauccaccugccucugccucccagagugcuuggauuacaggcaugagccaccguaccuggcuccugucuuagauauuucuaaaugaucuugaguucauuaggauguuaguuuaagcuaaucacaaaagauucuuuucuccuacauuaauauuagcuucagaauuaauagguuagucauuuauuaaaguggauguuuauauucuuauuuucaaaucuaauucauuaucaucuuaaucugagucucugaggaaugauaacuuaauccacuuauaguagcauauuacauaaagucuuugguuccuaaaaguuaaauuagaauuuuucccccaagaaaaugggaagauggccaggcauuguggcucacgccuguaaucccagcacuuugggaggcuaaggugggugguucacaaggucaggaguucaagaccagccuggccaauauggugaaaccccaucucuacuaaaaauacaaaaauuagcugggcaugguggugggcaccuguagucccagcuacucgggaggcugaggcaggagaaucguuugaacccaggaggcggagguuucagugagccgaaaucaugccacugcacuccagccugggcaacagaccagacugugucucaaaaaaaaaaagaacaugggggccgggcgcagugacucacaccuguaaucccagcacuuugggaggcugaggugggcggaucacaaugucaagagaucgagaccauccuggcugacaaagugaaacccugucucuacuaaaaauacaaaaaaauuagccgggugugguggcgggcgccuguagucccagcuacucgggaggcugaggcaggagaauggcgugaacccgggaggcggagcuugcagagagccgagaucacccacugaacuccagccugggcgacagagugagacuccaucucaaaaaaaaagaaaaugggaagauguauuucaaacuugacuucagaaucguguaguugcucaucacuaaaugggaagccuuauuaaauagaaauacuggcuuguauuuaaaauguuuauuaguauauauauuugggcaaauuuuacagucauagaauagacacagaagaauauuaaguuaaucagacaugauuuagugagaucaaaaauacaaauaaucugaaaauuuagugaaaaguucuaaauauacuauccauaccaagcacaucaauauauuuuagaaaauaacuguauugaccaagcuggcugaaaauaagaauuuuguuuuucuagagagcacuaauugcuacuuaaugucaaacuaaugacaucucacccaccccuccuaaaauccuacuaaaauaaaauuauagauacugaaaaaggaaagaaucuguaauagcaaagaaaaagggccagaguuuugcuaagaaauguucuguaguugggugagcucaggaguucaagugaugguccugccacagcauccucaguagcuagagcuauaggcguaaccagucugggcaacauaaugagacccccaucucuuaaauuaaaaaaaaaaaaaaaaaaagaggccaggcgcaguggcucaugccuguaauccuagcacuucaggaggcugaggcaggcagaugacgaggucaggaguucgagaccagucuggccaacauagugaagcccugucucuacuaaaaauaaaaaaaauuagcugggugugguggugugcgccuguaaucucagcuacuugggaggcugaggcaggagaauugugugaacccgggaggcagaggaugcagugagccgagauugcaccauugcacuccagcccaggugauagugagagacuccgucuguucuguagauuucugaagacaggugaaacugaaagagaaagcuuagauuauaccacuaaggggccucagaagagaugggagcaagucuagcaaaauccaauaggggggcuuugggccuagaauuagugugaaaucggacuagaaaugaugauuaauugagggccuauauagagaaaagaucucacucccauauccacuccugugcauagaggacaaaagcaguaaacauuuacacaggggccggggguggggguuuucuuaagaaaauugaaaaaacuguauggugaggacuagggcuuggagugcuuacaucaauccccaaagaaaagcauuuagagaaccaugagccuaacaauuagcucccuauacucuuaccuuuaaaugaaguuucauaauauacccacucccacaagaaggucccacuaagaauccccacuaggagaagagaacuggcaguaaaacaggccugcuuucacaaaagcaaaggaaacgcaacacuagcaaccucccaaaauauaaauggauauccaaggaccaccagacgaaugaggugaaccagaagcaugaaagaaaaaaggccaagauaaauagaaaaacuaaccccagugcgacccaacauagugggauuugagauguuacagacaugaaauaugaacagaaugcuaaaagaacauaaaagaauaagagcuccuuaaagauuauaaauaaauggugauguuaaaguaauagcaccauuggacgaagcuagggaaucaacacuugacagaaagauacauauuuuuuuuauacaaacuacauauauuugagcaaucaaguaguagacauagagaauuuucuuuuuauggaaguacucuaauaaguaaagggcugauagaauuauaucagcauuuucuagcuccuggugaauuaugcauugggcauccauggcugccuuagaucacaaaaauaccaccagauauaugccuguggaugaaagaucacaccaccaccugugaaauagucuuccccacaaaaaauccaacccaaauccuauccagccuguagaugguacucgagaucuucuauaagaaauaaagagagcaggcuggucacgguggauugugccuguaaucccagcacuuugggaggccaaggcagguggaucgccugagguaagaaguucgagaccagccuggccaacauggugaaaccccccucucuacuaaaaauacaaaaaugagccgggcgugguggcaggcaccuguagucccagcuacuugggaggcugaggcaggagaaucgcuugaaccugggagguggauguugcagcucgccgggauuuugccaacgcacuccagccugggcaacagagugagacuccaucucaaaaaaaaaaaaaaagaagaagaaagaaggaaauacagagggcagaggaaccuguuaaacugcaacgcagaugaaaucagcaaaaucaagacuagggcacuccacagcgugaacagcuugguuucuucaacagauaaauuugaagggggaaaagaugcaggagauuuuaauaaguugagacuucagaagacaaugaccaauugcaaugugugggccucucauuuguguccuaauuuaaucaaacuuagaauguaugccacugagacaacuggaaauuugaauacuagaagauuuggguuuuucuuaaacaagaauccuuaugcucagagauacauguugaaacauccugaauuaaaugcugaaauaaauauuaaaacuguccaucuggaauuuccuuuuaagauaauacaggagaggaauagggguaaguggauggaacuggauuggccauguguugauugauggggcugggugauaacuauaugagagguccauauuaccuaauuuaauguguaucuuaaauucuuuguaauaacaaaugcugaaauuaaaaaugcuacauaaggaagcaaccaagauguuccucaguaggugaauggauaaacugugguauguccaguggaauauuauucagugccaaaagaaaugaacuaucaagcaugaaaaacaugggauuuuaauguguauuugcaagugaaagaaggcagccugaaaaagacuacauacuguguaauucaaacuaugugacagucuggaaaaggcaaaacuauggagacugucaaaagauaagggguuagagggaaggagggaugaauaggcggaccauagauuuuuaagaccgugaaacuauucaguaugauaccacaaugguagauacgugucauugcauauuuguccagacccacagaacacaugaaaccaagugaacccugauguaaacuguggguuuugggugacaguuuugugucaagguagguucaucaaugauaaacguaccuaccacuaugguguagaauuuugagagugggagcauaugguuggggaaucucuguacuuuuuauugcuguaaaccuaaaacugcucuaaaaaguaauuuaaaauaaauuugugauuagagaaauuguguuuuuaaaguaauauaagaacaguauuaguugucaucacauuauaugcuacaccaucccaaaccucacugccacauuacaggaagcauuuauguuugcauucauggaucuuugagucagcuggguuuuggcugauagaggcugccacaggcagccauagcaagucuugaggccaacgccagauucaaggaauagaguucauccuacaaagaaaccauggcaagggugcagauacauaauucugcuaaaguagagugaagaaucugucuugggcuaaaaauggaaaauucaggaaaugaacguuuacagccuuagaagcaccucuaaguuacgcaaauuacucagaagcagaugaauucuuuuaaaaaguuaaauuuuacuuagacugauauagaacgcuauuggaaaccaacuaauaagcauggaaaauugcauccccggaaggcagauuggguuaaaauagauguuaaucuggauuguugaaguauggaggugugcaaauacuuuccaaaguauacugaaaacaaaguguuauaggguuuuggguugguuuuguagcauuuuagacaaguugugauacgaaaaaagguauucguuaauugcugccuuuuaaaauaaauauacacuuuuuuuuaagcucacugaaaacugaagcuaauuuggaaguuuugaagucaauuccuagugaaaaauuaaugauugagacagguaaguuuguuuucagaacuuuguuucauauuaaaccauaccaaacaaaaaggaaagcuggagaaagaaauuugacuucaaacuuuaagugaacaaguauuuuaaaacagcaugcucaaccucaacaauuauguuuuccagaagaucuuuggggguuauuaauggaaaaacauaugcaaaugauuuuuuucaauuuagaaguuugcuaugucuaagcacuuagaaaaugagaugccagaauauaacucaggagguuguaguuacgaguacuuagcuaaacaaggggucuugacuaagcacaucacacuuccaaguuucaaaaucuguucagaauuuuguuuacacagugucuuuauaauggcuuaauucuacagcacuuuguacagugcaacaauuuauauugguuuaguauaagaauuuuagaauccguugccucuuaaaacaaggugaggccgggcgcgguggcucacgccuguauucccagcacuuugggaggccgaggugggcggaucaccugaggucagaaguucaagaccaaccugaccaacauggagaaaccacaucucuacuaaaaauacaaaguuaucugggcaugguggcacaugccuguaauccuagcuacuuaggaggcuguggcaggagaauugcuugaacccaggaggcagagguugcugugagccaagaucacgccauugcacuccagccugggcaacaagggcgaaacucagucucaaaaaaaaaaaaaaaauacaaaaaauuagcuggguguggugguggcacuugccuguagucccagcuacucaggagccugaggcacgagaauuguuugaacccgggaggcagagguugcagugagccgagauugugcuacuguacuccagccuuggagacagagugagacuccgucucaaaaaaauaauaaggugaaaagcuaaaacuuuuaucuaaacccugucaaggcucuccuuauaccauggacuuuaggaaagucaagacugagccauucuggagaaaucacauucauuuccuugggcagucaggaaaacaaaauauuugauuaaaaguacgauguuugcaaaauguguaauucuuuauuaaaaaauauucaaaaccaguuucacauucaguagagauagaaauuuguuuaacuuaugcaaaccucacuacaugcauagcgaaaaagauuuugaaaacugaaaaaaaaacuguuuaacuuaaauguuuucauguuguuauacaauuguauuuaagguuuaggucuuuuuuuuaaagcaugcugcacaccaacaauguuagcagaaaaaaggaauagaagugagucuuagaagguauuuaagaugcaauucaagauuuuaucuugugcuuuucuuagaacuguuuucuguugaaauaacugugccauuuuggaagcugaaucacgguuuaucauuuagagguuauauauuagauaauggucauaaaaaauuuuuaaaaauguaaaccccuuacgagacacuuucuuugcuuaacuagaugcaccuugguguggagucaaaaguacacaugcuggaucaaaauauauaagaacugcauuuccuaccaaaaagaagugggaaagugggcacugcuuaaaagacagaaaugaacccugccauauaaugugaguauuuugcuuucauggucuucaaaaucauuaguuaaccaccagaugccacuuauaaaauuaacgcaagggacagaauuaaaauuuugcaaaauccaagugaaguucagguucaagaccaccauauuaaugcagugauuuggaggaauuugcauaccugguuuaaguuccauucucacugcagcuuccugcuacucuuugguaacaagaaagccuuagcagaauauuuuggauuuaaaugauuugacagccucuauaaaucuaagaaauaacacauuucuuuaagccucagaacaaaaggauaagugaucuuaaggacaaaccccuuuuuuccuacccccuuuuuccaaucaaagggggugggacuuuagcacguuuuauuuccuaaaaaagcagcagaucagaaucaucuuuuaaauggugauauauauauagcacaagugaaaagaggggcuauuacccaucugucaaagagcuguaaagguaacaaacaggagaaggugguuauaucauuuuaauggguacauaauccaauuucuuuuguuugcacaaacagauaauuuaaauuaaucuagauuauaucagucuuauaugauuuaccaauucagacaauugggcauacuuauaacacauucacaaaaacuaauugguacugugucuucaugagggguaaaaaagaaaacaaaauagguuguugcuuuuaagacuauucauugcauaugcaccaucuuuuuuuucaguaguuuuuaacaggaaaagaguauuagaagauaagccagauaagaacagugaagaauuauucuauaaaaauauguuugaaagguucuuuuccuuuauuaacaugcuugagcugacaaagucuuuaaaacugaagcagccaggcaugguggccugcgccuguauuccagcuacuugggaagacugcuugagcucaggaguucaagaucagcucaggcaacauagggagaccccugucucuaaagaaauaaagaaaauuuuaaaaaauaaagaaauguaaguacuugcaaauucagugaugagacaguauuucuaaaucuuuuuuuuuuuuuuuuuuuuugagaccaucuugcucuguugcccaggcuggagugcaguggagugaucuuggcucacugcaaucuccgccuccuggguucaagcaauucuccugccucagccucccaaguagcuggaacuauaggcacaugccaccacacucaguuaauuuuuguauuuuuaguagagaugggguuuugccauguuggccaggcuggucucaaacuccugaccucagccucccaaagugcuaggauuacaggcgugagcuaccacacccagccaauuuuuuggggaacuaaaaggacacuagagaaaagaaacugguauuuugacagcagccagcuuacaggaaguaguugccaacaguguauccaaguaaguuuuuuauauuuccuuaaucuuauguaagauuauagcuguugacuuuagcuauauauuugcaagacaaaauuucaagguguuuuuaaauguagacuguuuaagaacuauaaaggcuggccaggcaugguggcucacaucuguaaucccagcacuuugggaggccaaggcaggcggaucaccugaggucaggugcucgagaccagccuggccaacauggugaaauccugucucuacuaaaaauacaaaaauuagccaggcgucauggcggaugcccguaaugccagcuacucaggaggcugaggcaggagaaucgcuugaaccugggaggcggagguugcagugagcagagaccacaccauugcacucuagccuggaagacaaaagugaaaauacaucucaaaaaaaaaaaaaaaagaacugugaaggcuucaucaauacuuguucuucaguuaguugcagagcuuaggaaaaucuagcaucugcaagcugaaaagauuuaaaccacauuuaaaaaauacacaauccucuaaucuacugcuaauuaugaguuggcaaguuaauugcuacuugcaaagucauuuucucaaccuccauucuguuaacaguuuuacauucuaauuauuuuuauagaggucuuuuagauauacauuguuugcaacagauguuuuggagccccugccaugucaggaaagguacaaguuacuaaggcuacacaggaagaaccaagacagucccugucuuuauccauccaccagaugaauagguacacugugccuggcacuuuagauaaggcauucagugagucaggcgaggaccccugcccuccuggagcacauaagcagacagaguccaagauaguagugcuguuauacaaguaggaaucuaugaccaggaccauagggcacaucaacugucugcuuugaggggaaacaggagagaguuauaccaaggugacauuucaguuguuuacccaugacugggaguuaggccagagaaagacaaacaaacaccuuaagcaaaggcagacugcagaagggccuggcuaauccagaggaacaaguguggcagaaaguaggaugcacaguguaagcagaagucaagucugggaagguagagugagcccagauugugagggcucuuauaugccagcauuuugcuuagauuuuaucacuacccaaaggauuuuaagcaggagaguggcaauuauuuuuuuuaaagcuauaacuuguaucaguauggggaagggcuggaaaggagauaggguaggaaucauguagaucuugcaagacuuuaaaaaccuuugccuggcugggcacaguggcucacaccuguaauccuaccauuuugggaggccgaggcaggcagaucaguugaggucaggaguucaaaaccagccuggccaacguggagaaacccugucucuacuaaaaauacaaaaaaauagccgggcaugguggugggcgccuguaaucccagcuacuugggaggcugaggcaggagaaucacuugaaucugagaggcagagguuguagugagccaagaucacaccacugugugaucacacacagugagccaagaucacaccacugcacuccagcuugggccacaguguaagacucucucaaaaaaaaaaaacaaaaaccugugcuuacuguaaaagugccacauuaaacaaaagccacuaaauucucagggacauuaaacaacuuuauauucauuuuggaauaacugcagcuuugaccacugaagauguauggaaauagcauggcuuggcuacagaaggguuauucgaagaaagauuuccauaaacugcauuaucaaacaguaaaauaggauguccuaagcuccaauagauuuuuuuuucuuuuuucuuuuuuuuggagagagagucucgcucuguugcccaggcuggagcgcaguggcacaaucucagcucacugcaaccuccaccucccagguucaagcaauucuccugccucagccucccgaguagcugggacuacaggcguccaccaccaugccuggcuaauuuuuuuuguuuuacuagaaauaggguuucaccauauugcccacacuggucucgaacucuugaguucaaucugccugccucagccucccaaagugcugugauuacaggcaugagccacugggcccagcccaauagauuucuuauaagcgauuucaauaaaaugaauuugcuaugcaauauaaucuuagcaaagcugcugugaccuucaaaacugugucaucagcagcauuaaucaagaguuccaauucugagaagugcauacagagggacauucaguaguuuccuaagaaaaauggauuuucacugucuuaauuuaaauguuaauagauuugcuuuuaguguaucuugacugucagauaaaauuuuaguguaguguuugcuuaguauaaacaucaagcaaggcuuuugugucacauuacaaaacaauuuuuuaaauucccauuaaucuuagaucuccauccuuaauuccuuuagguguuaacauuuaagauacuaagggaacaaaaagcuuaggcaaagaauauuuaaauguucaauuuggacuuuggaacuuucuaauucauguauuaaaaaucuuccacuuauauauaauaaguauggagacacuacggaucaucauuacuguaagcacagaaacugaaagaugcggccaggcgcgguggcucacaccuguaaucccagcacuuugggaggcccaggugggguggaucacaaggucaggaguucaagaccacggccagccaacauagugaaaccccgucucuacuaaaaauacaaaaauuagcugggugugauggcaggugccuguaaucccagcuacucaggaggcugaggcaggagaaucacuugaacccaggcggcagagguugcagugagccgagaucgugccacugcacuccagccugagcaacagaguaagacgccgucucaaaaaagaaagaaaaaagaaaaaaaaaagaaaggaaagaaaaagaaaggaaaggaagggagggaagggaaggaagagagagacagagaaagaaagaaacugaaggauggacaccugggcuuauuucucucgcaaggguagagguacagaaagcccucgcccucaauaaccacacauuuuuccaaguaaauauuacuuuugcagcaaccuaauaccuucauuugcugucucucaaggacuaguucucuagcaguagauuuccaacuguggcugcugucccacaguacaaauuacguugugacuuaggacacacauacauaauaaaaccuaacaaaaaauggaacaguacuuacccuuauugaguacaauguacuugucaauguuuaaaaugcucaucaugacccacuaaugaacaugcuaugacucacaauugaaaaggacucuucauuuccacucaguuaaugcuauaauuggugaacauaauacagauggcugcuuuaauaauuuacuugaaccugguucuuagcucuaguuauaugcaagacaguccauaaaucuguuuccaguuacuggcaguaaguuuuucuauugauauugcugaaaaacuuaauaacuguuaagcuuuauuauauuaaaggugugccaauauuuuccuuuguguggaaaaauauuauauagcuuuagaacuaaauguauacuuggagauuuaaccauuuuuguuuuuguuuuguuuuagucaaauauuggagauaaugucagcagugagagaugaggauccacuggaauuagccaauacacuauauaacaauacuauuaaaguauuuuuuccuggaauauaauugguauaugucuuccacuuuccaucauguauguaaaauuucauaguaaaacuuccugauaguuucaauaaagaaauuaucugcaaguugucuaaagaaauacuauauaucgguacacaccauuccccaccauuccccuucuuuuucucguaaaaucagaucaggauguuuuuauaucauugaguaucuuaguuuaaaacaauuuaaaaaaaacuauuuuuguuuuguaauaucuucaaaagaaugaaaggacaauuuuaugacaauacugcagacacagaauggcuaacaaauauacaauuuuacauaaaaaacauuuagcacauucugguuuauaucaaaguuuaguugauacaguuuauuugucaacccucagucucucucugaaucaggacuuucaaacucagcucaauuacacugcuacucaaguuucaaaaaagguccucaguugcuucuggcagcuaauuuuuucuuuaguuuuaaaauacucucucauguccuuuauccucuggucaaauuauuuuauuuccuugacuuuaaugugguuuccugauuugcauuuucauucucccacccauuucuaaagaaaaacugagguccaaaguuacauuauauaauuucauugaagaauauuuggcacaggugacgcaccauaugaucauuacaucuauuaaaaagcuauuuguucaaauuuugucauaaaaaugugaaaacauuuuauucuauguacaauaauguacacaaauuuaaacaggucaccaaagagaccagaaguaauuaaagagguauauuuacaguagcacaucacaguaaacggaaaaccauucacagauucaacauugauacuguuuuugugcuugguuacacacugaaggugaaggauauuacuccauuuuggaugaacugaauuuuaaacaaauaccucaaucauuaauaaaugcuauuuucaucagucaguaucaucauuaaauucuucagcugcugcgccugugugcugaaucacuccauuucuuucucuuugaacaucaucaucacaaucuguacugucaucuucguucaauucccugucagauucagcagcagcuucucuuacagcuuccucuggaguuucauuggguggaauaaauccauuguuguuagauacauuugaauuauccuugauaucaucuucgauguauacuuucugauggcacauuggacaaguaucuugaauguacagccauuuccgaaggcaaagugcauggaaauaaugauuacacgguguaauacgagcagauguuguaaacucaugauagcagauugcacauacaucauuuauuucuuguaagcggcucccuuuuauuucaggaagugaauuaauuuucuucacagcaguccuacgauucauaaaugucuuccagccauuuuuggcuuguaaguagauguuaaaauaugcauguaggcacaucauaaaagcccgaauuuuacuucccgacucaaacaucauaguguaagccccauuuccaaacauuacaacuccaaauauaaauucaauaauacugccuguugaacgaacguaguagacauaaucgucaagcuuuucccagaggacauuauaguagccaucaaucaugaauaacguauaaacagugagagaaacaauuacuuuuaagcacaguuccacacaaaaugcuguaacugcaaacaaccauguauuuagugcauagugaugccaaagaacauaacugaguaagacaggaagaauaaacaggcaagcagagacaaacagcacaggaaaaugucuacgaaaagaugacacaugagaggcacugagagacauuaauacagggucugucauuccauggauaaaaugcaggacugcaguuaauaaaaggcacauguuucuacuuaagcgaauaagucucucuucuggucuuagcccacuuaacccagucugaagagccaaaauaaaaaauaaaacaggugcaacaaagccaagacgccugucaucuuccucaguugauccaauaaaggccaauauuccaagccccaaauaaugggcuacugaggaaauuacagcacucaugcccaguacaguuaguguagaaucgcacccacuaauuauaagauugcaaaugaggucccaaaaaucaucccaagaaauaaagaaggaaucaguuucauuugccauccuuaagauguacauuaacacuguagccugagcuguaacucuuguuagccaaaagacucguaguaugucugggaaacgaauccucuuccauguguccuccaucaauaacuguaauccguaaauucgauacaugugccucaccaaaagauaaacauaucguguggaauaauaaaaccacuucaguuucacugccaggacaaacacuguauuuaaugugagaaucaaggaagaaguaaacaguaaagucucucugauguguaaugguagcucugugauuaagccuauuacaggaaccaagagauccaaaauaauuaauugugaauagauggaaugaaucuggaguaguguaacguauccaauuccaaauguuagcuguagaacgauaagugccauccacagcgagggaccuuuucgaggaagcagcucaauuccaaaagcugacguguuguaggcaccauagaagucaaugugcaaagaagcauaauaauucaccaacacugaaguugcagcuaacagaaaggcugagcuguacguguaaaacuugaaaagugaucguugugacaagaucagaacaauacuggaugcaaauacaccuaaaagaaagaaagaaaaagucauuugaaugaaguauuuguaagaauguuuccccacuaagaguuaugauauucuuccuuuaauuaggaaauaugaauauuuucaguuaugaacauuaagccucaagacaacuaaggcuuaaaggguaauaaagguuuuguaaagucagaguucaggagaacagaccaaacauacuaaauuauucuuuaaaauuucauuccuuacuuucuaauuuccaaaguauuucaaguaacacuguagcuguccaaggcaccaaauuacuaaauuauuuucaagaugaauuuguagugguacauacauuuuaacaaguuuuaaaacucaaaagaauaugucuuuuaucauuucauaaucauuaaaauuaauuuuaaaaauuggguuaaaaauaacccaaauggaaaacauuuauuccuauuaaguuuuagauucauuuauuauugacugacugagacaagagucucacucuguugcccaggauggagugcacuggugcaaucucagcucacugcaaauucugccucccaggcucaagcaauucuccugccccagccucccaaguaacugggauuacaggcaccugccaccaugcccagcuaauuuuuguauuuuuaguagagacgggguuucaccauguuggccagacuggucucuaacuccugacgucaagugauccgcccgccuugccucccaaagugcugggauuacaggcgugagccaccgcacccagccaaguuuuagauuuuuuuuuaaaggauucuuuaggaaaucaaguucaaguuuuauacuuccacuuaauuccuccuuuucuucaaacugugaacucaugccagcucuuauuuccuacuccuuaacucugagcauucuccaaaggguccaaaauuccauuuuuuuuccuccuaguuuccuucggacuuagaaacaucuuccaaguucccuuuuuccuguauaaugcugaaucuguuucuuaaaauagucaacucuuuuuauuguucuucacauuacaaaaguaacacucagaaaaccaagacauguuuuuagaaaaugguaauucuccuucccccacuccauagacaccaucuuucuuuguacucugacagaaaugcauauuuuaaguaggauuacaauaaacacauuauuauccaagguuucaacaaugggaaugacaucugaauacucaccuacuuucacuccuacaacugcaaaucuccaaaguucugaaacucgacuugccuuaaacuagaaucagcuuuuccuugugauuugcuauuucaguugaagguaccauuauuguucuuuuagagauacucccaacccagccccacaugcucaaacuuugccaauuaguugccaaauucuucuaacaccucuaucucccuuuucugugacaccaaucaaucagucugucucaaaaaacccucaucuuguccaaauccauuuacaagccaucaccaaauugccuuucuucauucccugcucaaaauacuucagcggcucugaaauuacuaucaacuaaaaucuacauucuugcuccuggcauucaagaacccaauuugcuuuacaguaauauuccuccuaacacacacacaucagugcuccagacuuggauuccccaaacacauuccuuucuccacuauagcuacagcaguguuuacauucuuuuugcuuggaaugauguccccaaccucccaaucccugacuauucaaauccuaccuauccuagaaaccuacuuucuuugauagaaacuguucuuucagcauaccugcagaacuuagugaaacauuuaacacucauauaucaccugauauuguagucugcaguuaucuaaguauaaucuacccuauuacacauguaucuauaacagaaagcaaagauccuacccuguccaucuauggauucuacaauauuuuguacaaaauaaguacaauuaguauucauuaggaaaugucugucacaucuggauguuuuuaaaggcaaccacaaaauauagccugcuugaaaaauaaaaucuauguuucagacaaugagaaaccauacccuggaguacagaaaaagugacaaacuccaaauuaaaaauccaucuuggcugggugugguggcucacaaugguaaucccagcacuuugggaggcugaggcggguggaucacuugaggccaggaguucaagaccaugucaacauggugaaacccugucucuaccaaaaauauaaaaauaugccagggugguagcacgugccuguacucccagcuacucaggggguugaggugggagaaucgcuugaacccgggaggcauugcaguuagcugagaucgcaccacugcaugccagccugggugacagugagacccugucucaaaauacauaaauaaauaaauauuaaauaaaauaaaaauccaucuauccaccuuauuucagcagguaaucaagacauugcauauuauuacaguagacgcauuucacaauccacugcacauauaagcaagggcuaguucauuuaagugaugacucuguccagggauuuaaaauguauucugugccaaaaugucaagucaucugugaaaaggaaaacaaaaggacacaauaaaguagaagacauauaaaccucuaaauacaaaccaccugauuccccaagaaaaugggccacuaauaaucccccaaagaguugugagcucagaacaggcucuuuuaaauauauauauuuuuaauauauauauuuuuaaauauauauauauuuaaauaauauauauauauuuuuaauagauauauuuuuaaauauauauauauuuaaauauauauauauauuuuuaauauauauauuuuuaaauauauauauauuuaaauaauauauauauauuauauauauauauauuuuuuuuuauauuuuuuuuaauggaguuucgcuccuguugcccaggcuggagugcaauggcgugaucuuggcucacugcaaccucugccucccagguucaagcgauucuucugcuucagccucccaagaagcugggauuacagguauguaccaccacucccagcuaauuuugcauuuucaguagagacaggguuuuuccacguuggucaggcuggucucaaacuccugaccucaggugauccacccgcuucggccucccaaacuacugcgauuauaggcgugagccacugcgcucggcccugaaaagauuuuuuuauuagaaacuucuuccauggaagguaacaagaaaauggaauuaauucagccuaccagaugccauauguaaucuuacauucucuacauggaaaaccaccuuauuuuccugagacaaaacuucagaaacuuuaaaacaaaucuucuaaguugggucaaaaccaaaacaaaauaacucuaguucuacuuuaugccacuuagaggggagaaagucaagcaggaacuguaaauuauuuuugucaacuugcuauucacaaaguaguaaauuaaucuucaguaacuauucaugagcuuugccauaauuuuauaacuaauuuuuaaaauucuaauaacuuuuuuccugaagcuuguuuuuacuacacacaaaugaagaaauuauuuggguuuuagaaacauuucuagugaaaaagugccauuuugcuuuaugcaaauguaucaaagaaaaaaaggggaaggcaucagauagacaaauaauguaguaagacuacaaccucaaaauuuggauguaucccagcaaguaacaaucugacaauacucuauccugauuaaaaucacaccccccaagauguaauagugaguuaacauuucaagaauaguauauguuuguuuuaauuccuacccaaaguuuguagguauaugggguucauagauuuuccuuuuauagucacguuccuaccuauggaauuugggaagaaucugcucucauuuuaaaaaccaauauccuaaguaacaagucuccaaaguaaucaucuuucucauggccuuugcagaauaauaucaaaguuucacugcauuuuuacauuagacaugaaagccuuucuugguauuuaaacuguaggucuaagaaaauauaaaaguccagagacaguuucucauuaggauuuggaagugacuugcacaaguaaucaagacuguauauaaaugcugcuuuauaaaaaauuuugagaacagaauuuacugaaaucacaacucagagaucucaguccaauucuccagugauuaagagaguucacuagaguuuucaagguagccaaaaagaggcagguauccaaaucaauucaggaacuuugaaacuauauaugaacucaacucaugaaagaguucaggccuuuucaauuuggauuaccaaaaacaggcaaauaaaaacaaaagaaaaaauaaaaacuuacuauacauguuacauaacaaaguguuucacucuuuuauguguaaagucuauucauacccuuacccucuuuuggaaacuuaugacuaaaaaucaggguacaaaacauaauauuuacaauucuccaaguacccgaaauaccucuaaaacaaaaagcaaccuguggaaaaacauuucaauaccugacagaauaaauauggaaaagcacagaaauaaauguuacuacuaccuuacucccaagggagccuuccgcaaugaaguuuacaacaaagugucuugaaauguuguuaaucuguugguauacuugauaaauuauaaagaaaacauuucuauuggauucucauuuuagguugaaaaaaaaccugguauucuaaguauuaacacaaaauuaaacuuuugcuuuuaaacuaaacuuauaauaaguaugcuuuuaucaaaaauauaugaacauggauuuuaaaaagccaaacccuacagagagguguuaaaugaagaguuaaagcaaguuuuucuaguuugucuuucccaucugugauaucauaaaaaaaauauuaauauuuggucuuugucccauuuucugacauagcuucuaaaauccuuggaaucucuggagugaugacuguuuuguacaauaaucagaugacuggugccugggggccccuagauagcuucaggaugggggcuagguagccaggggaaucagcccagugauuaaggguuauaacuuugauuccuacccccagccgccacuucugggaagaaagaagcugaaacuugaguccauaaaccaaugacuagugaucuaaucaaucuugccuauuuaaugaacuuccauagaagcccaaaaggacugaguucugugagcucucagauagcugaacacugaagcuccacgccccuucuccucuucucuccuucuuugucucaccuuguacaucuccuuccaucggguuaauucaucuguguccuuuguaauugccuuuauaauaaauggguaaauguaaguacaguaguucccccuuacccaagauuugacuuccuuuuuuuuuuuuuuuuuuuuuuagugauggagucucgcucuguugcccaggcuggagugcaguggugcgaucuuuugauuaacauagguuuuuaaccucaauaucauucgguuuaucaaucuucauuauguauuugcuuuuauauauuuuuaaggauuucuuccuuaaucuaagauuggaaaaauaaaauauuccauauuuuuuucuaaaaauuuaaaguucugcauuucauauuuacauauacaucuagguaagaauacacuuagaaaugacuauuuuuuuuuuuuaagagacagggucuugcucugucacccagccaggcuggagugcaguuaugcaaucauagcucacuugcagccuugaacuccuaggcccaagcgaucuucucaccccagccuccugaguaagauaggacuacaggcacccaccaccaaguauggcuauuauuuuaaauauuuauuuuugcagagacagggucucacuacacugcucaaccuagaagugacugucuauauauugacauaagguagacaucuaguauaauuuauuuccaaagguguaacaaaaugaucauuaauucaacaguccauauuuaccucaauguacuucaauucuaucucugaaacacauuauuucuauauauacauuggugucuguuucugggcuauguaauuauaaauaaggcuaaguacuaaucuauuugucuaucccaaugguucucaaccaugauuuggcaauauccagggacaguuuuggcugucacacuggggugugggggugcaaggugcuacuggcaucuaaugggcaggggauagugaugcugcuaaaaaucuuacagugcacaggagagcucccauccgcaaacaaagaauuauccuguccaaaaugucaauacugccacuguugagaaaucucugucuauuccucugccagugauaauuacuucggcuuuguuuuuucacuucagagguuuucugaagucuuuuucggcaccaaaaauagcuaucucauuucuuucaagaacuuuauugcauggcuagaccuaauacaaugaacagauuuguaucaauacauauuuagauuaaguuuguugcuuuguuauuuccaguaaugcuugcccauaguccuuaagcaaacuaucucucuaggccaauucccuagaauugaaauugugagucaaaaguuguacgagccaggcaucccagcuacuugggaggcugaggcaggagaaucgcuugaaccugggagguggagguugcagugugcugagaucacgccacugcacuccagccuuggugacagagugagacugucucaaaaacaaaacaaaacacugagaagucaguuguaaaugacaguugauacugccaaaugguuuuacacugaaauuaagagucuuccgggccaggcacgguggcucacgccuguaaucccagcacucugggaggacgaugugggcagaucaccugaggucgggaguuggagaacagccugaccaacauggagaaaaccugucucuacuaaaaauagaaaaaaauuugccgggggugguggcgcuugccuguaaucauccuagcuacucgggaggcugaggccggagaaucgcccgaaccugggagguggaaguuguggugagccgagaucacgccauugcacuccggccugggcaacaagagcaaacuccgucucaaaaaaaaaaaaaagucuuccaaaauuguauaaauuuaccuauuucaaaaagguaaauaccuuugcaaaacuaauaaaacuuugaacucuucaccaaucugauaaauuuuuuuugacuuuuuuuuuuuuuuugagacagucucgcucuaucgcccaggcuggagugcaguggcgcgaucuuggcucacugcaaccuccaccuccccgauucgagagauucucgugccucagccuccacaguagcugggacuaugggcaggagucacugcacccggcuaauuuuuugguagacacggguugugccauuuggccaagcuggugucaaacuccuggccucaagcaaucugccugccucagccucccaaagugcugggauuauaggcgugagccaccguaagcggucuugacaguauuuaauuauaaacaaggcuagguacuuuuuuuuuucccccauaaaaucaagcuacugcaggaagggcuaaauacuuuuucucuugcuuauugaacaucugcauuuuguuuauugugaauugcuugucuuaggcauuuuccuaagggaguauaaguuuuuucuuguuuuguuuuguuuuuuuuuuuagacagagucucacucuauccccaggcuggagugcaguggagcgaucucggcucacugcaaccugcaacucccugguucaagcgauucuccugccucagcuucccuggcaggguaaaacucuuacuggaacgugaaucacuuaugauagaaguauuuuaucucaguuugucauuuaaggauucuuuuuuaagcuuugccauaaaaaagcuuuuuauuuuuauguacugaaauuuuucagauuuuuccuuggaacuucugggucuucuguuauguuuaaagccuuuucccaccucaaugaauuaucaccauauuaguaauacuauuaaaacaaacuccuaggcuugcauuuucugccuuggauuuaaauuugcuaacucagcauuaugcugcucuggguugaguuucguuuaguauuuaacaucccuuaaaacacagcuuuauguucuucaauauuccauauauugucauagaauuuuauuuggaucuccaaaaugaguugcuuuauuuucuaaccgguugaaaucucaaauuaguuugauaucaaaugaagguacaguuguagcaccauuuuguagguagaggggaguaaauacuucuaccaccacacauaaaacugguaaugcuuuuuacuuagagauuuccauuuuuacacauuaauuuuaaagaaaaaagugagguugacaagugguaagacuuauacacaguaguacugagaagucuacaacuacaaaaaaacuaacaaggcagaacgauuaauuucaacuauccauuggcauauuuacacacaaaccugugucuuuuaguaacauaauuuuuuagcaccgaaaucaguuuuuuucauucuuaucauccuuacaaaugugaaaaauuagcauaauuacaugacacaguaagaagagucggaugauagauuugaagaguauuucguauuucucaaagucugauccagagauuccagggaucaaaauuuucaaauaaacaacaccaauauuuugccgaugauuucaaaagaccaaaauaucuaacaaaauaugguauuaaaugaagcauuaaaauagauuuauugucuuuaacacccuaugaaacagauaaccucacucuccaucuuuuaaaagguaaaaauaagaaaccaaagcacugagcaguugccuuaagucauguuguucuuugucaaacacaaacuuccaagauuuauuacaaaagaaacaugccuaguacaaggaaaauaucagauugcuuuguucaauguucuuacacuacaaauuauuuaauuaaagaaaauacuucuuuuccuugaagcugccuaaccugaagcucaacagacuacugcauuaaagcaccaggucccaaagggauucucacagaaucugcaguuaucaugcuguaagaauauucaaagcagucacuacacuguuucugggaugaacaugcagaauccucucaaacagagcccaguuuuuaacacaaauuaugguggugguauacguuagcaguggcaaguaggaaaggcuggaauuagguagcagguggguuacugaagcagcuugggcugaacaucacguuuacaucuuuaguuuuaagaucuagcauaugaucauuacuacugcauucuguaucuggauugcagcuguuagggaggaaaguaaaccauauuuaaugucaaaagauuuuuaagcucaggcucuggcaaccacuuagcggcagccuaccaagagcaaaacacuuaaccucuaugacccuguuuccugguuuguaaaaugacaauaccaccacccaccucugggggauguuugaagguuagguuagauaauaccuaccagugaaaaugcuuugcaaaaggaaaauaccagauaaauguaaaauauggcuauuuauugcuaagaacaaaauucggccuuuauugccacuccucuuuugaaggaauaaagcaacagauggcuuguaauucagaaaggcuugguaaagaccucaccaucagucugcccucagcaacacuucaaaagcacuagccuacuuaagaccgaucaccagaauuaccucaucaacaaaauuugccaaguuacaauuacuuaaaaaauuauuuuacgcauaaaugcaucucccucugaugauguaagugaagauggaaaggaagaaaugaaauauaagauacuuuuaacacuccauccauacgaaacaaagacaaugauuuucagaagucucuuuggcaaaugucucaucacuuuuuacagucacuuucaauaccuucucguuuauucauggaaaauuuuaggacucgauuuaagcaucgccgcuuucaugagaauuuuugguaaugguuucaaggucugacauucaaaacccugucuccuucgcuuggaugucauuuacugcagacacuucacgauccuguggacccucgggugcagcagaagugacaacauacaaguacucggcauuugguaauaaagggaaacugaggcccacgccuuggcagaaguccaaggucacacacgacgagacugggauagcagaguuguuuuucgaaggcugucgcauaggacgcgguaagccaguacucauuucccaaggcaaacgggcaaagagcugcaugcucacacauccuuacuuucuccccaccucacucagguacaacacugaauccucgcuagggggacugcuccgcugucaacucagacaaguaucaucuccuucccccucccaacccguaaagacgacccuuugagggaugaaacuguaguucccaaagacacauacucgacccauggccucugcgcgccugcccgcuccccggggaacgucucggcccgcauagccgucccgggacguacgguacccuguucccuuaccaaagagccggaggaagaucuggagcacgaugcagaaccggcuuuggcuggaauccggguaggaguugaagauggcgucgaugauguaaaggcagggcacccggagcgccacuucgagcgccgcccagaccugcugaugggccauccgcaccugcugcugcgggggccccacggccgccaugagccgcugccacaccagggcucggugggccgggcagggccgcgcggggcagggcccggggccgcggccgggggcgggggcuaaggcgggcaacuccgccccugcccuccuuccucuccugucucucucacggccagccccgccgcccgcucgcgucccucgagguggagcaggcggcggaggcagcgauggccgagagggcggcggcggcggcuccccaggaggucucuggguuucgguguuuccggcuggcuaaggucugacuccuccucccuccacugccucccccgcccgcggagccaccaucuugaccucgcccgcuggccucugccguugcugcuguggcu

SEQ ID NO: 17779 - RNA, 63110 nt, Homo sapiens
cacuuccgcuuccgcuggggagguccuccaugcgcagucaugagucgcuucaaguuuaucgguaagaggagcguuuuccacgcccuugggucuuucugacuugucccgggcgucggucaccaaggucacaggacccaggaauugcgcccuccggcauuguaaggguugaaagggccgcucaguggaggagggcgcggggagguuucugggugcugguaaugcucugguucuugaucuagguucuggauucacgaggguguauuuauuuguaaaaauuaacaagccguacaguuaugauuuuugugcuguuuucaacaucuguaauguauucaguuuuuuaagaagaaaacuccaaaaaggccaaucacuauguuuccauucaucccacgugcaccucccggcccuuccccucugccuuggcggagaggcugaccgcuucuggggaccaauucacucaagcauucauucguucauaucauaguuagugagcgccucaagugggccuggcacuggccuaggaacacagggcacaaagcucccaguuguacugucaucaccaucugguggagaaacuagaaaacacaaguaauggggagaaaaacaaacuguacuuggcaaguacaaugauccagucggcaucaguagaacgagagggagaaugcugcgggauuuaaaugggcaugauccucguuuugugggguuuccagcuaccugaaggugggaaaugacagugaucacaccucugcuuuagcaagguaauccugauagcuauuauguagguuuugugggaaauagggagagguagggaagcauuucaagagcuuaaacuaggguaauggaaaagagagagaaauggaagagaugugugcagcauuuagcagcugaguguucauggccgguaguagagagugaacaaagaugacucaggguuuggaaaaguacuuaaauaugaaauggaagcaugacuaguuuggcggugaagagagguacccagguccauuuggauuagguuaaguuugagauaauuauaggacauccagguagagauaucugggcaauugggaauguggucuggcaaucaagagauuaggauuauacauuuagaucugagaguuauuuaagcaguauuuuuuuuuuucaaagacguugugcuaaguccuguggaacuguaaaaucuaguggugcaguuuucagacuggagaccuaagaccuauguacuguacagucaaaagcaaaugcaggggagaauauguuaagugccaggaaaaagguuuugaaauugcugugggaaagccuggaguagggguuuggggagggguugucaaauaagacauugccgugucuuagccuuuccauccuaaccuuugauauaauugaugagggagauggaauaaagagccaugaaguacuccguaaagaaaggccacauaacuuuuuaaaaguguguuuauguuauacaaccaaauuccugccucaaguuaaugucuuaaauccauccuccauguagacuccauuuugguguaucuaaaaaucaaaucagcuaaauguuucuuuugcuucaaaucuuucauuuacgcuccucaggauagccuaaaugcuuacacaccauacaaagcccuucugugguccaguccugcccacuuuucuagcccaucccugggcugcucuauaaacacuugugcaugcuguuuguuaccucugacaagguuuuagaguggcaguuuggggccaaaauauuccucugccuaccaacuacccuguugccugucugccuacucacuccuuaaaacuuauaccacauuauuuauaauuaaauaugaguaugccuuucccacuagaucaaacucuuaaggcagauacugguaugguauuuauauuuuuuuccuaggggcguaguacaaugacuguuugggaaaguaugaaugaguggcuuuagugcuaaggugauaagaaaauuaguaaagggauuagcaucagauaaaauaagcaagaaaagacuucuuaaagaaggugacuuuauuggaauaaauaauugaaauaaauuuuuuucuguaugguuuccuuuagccccacucuccuaaaguaaccauauuaaaaguuugaaguauagccuucccuaauuuuuuaauagauuguuauacagauucauaaaaauacaacauaucaagguuuuuuuuuuuccuuuugaaacagaaaugagaucauauuaugcauucuauccuugguauaugacuuacucugauauuuaaucuuucaguuugugucauuuaaaaaauucugcccaugaaucgcuagacuaauuucuuagccuaauaaugaguucugaacaauauuuugaaaaacaucauauuaaaucccuggaacaagcuucacaugggacaauugcaugaaaaauugaacccauuuuaugaaaauuaccuuagauuuugguuuaagacagcugaccauuguaauucuuucuacauuucucucuuuucuacuugcauaacaaguggcugccccuuagaacuauaccccaacaguggggguuuuuguuuguuuugagacagggucuugcucugucaccuaggcuggaguacaguggcuuagaucauggcuccagcauugaccuccuaggcucaagugaucuuccugccucauccucccaaguagcugagacuagaggugcucaccaccauaccaggcuaauuuuuuuuuguagaccacuguguccugcuauguugcucaggcuggucuugaauugcuggccuuaagcaguccuuccaccuccgccucccaaaguucugggauuacacguggagccacuggccagcaugagaauuucuuuagcccagcuuauacucucuuuucugucuccacaaguggaauucuauucccuggguguuauuuacaaacucuuccacucucaaaaauacuucuaccuguaacuauuauaugccagaaucucuacugcauugaucuuagacuacauaguacaccaaaaaaugagaaauaucugugcaagaagaaaaugcaaaauacaaacaacagugaaaauaaaaacaucauauuccauuccugauauaguuuagauauuuguccccuccaaaucucauguuaaaauuugcucuccaauguugaggugguccagugggagguguuugggucacuucccaacauccaucucauggggguggaucccucaugaaaggcuugauggccucccugugguaaugaguucacacuggcuccccuucccuuuccaccaggauuggaagcuuacugagauccucccaaaagcagauguuggugucaugcaucuuguacaaccugcagaaccaugagccaaauacaccucuuuucuuuauaaaucacccagucucagguauuccuuuauagcaaugcaaaagcagauuaauacaguuccuccaaaucacacauaacaccaccaugucuaucuuuccagaucuucuguaggcauaccaaacaaaauaagaucauacugaggcuacucuuuugugcucugcuuuuuucaaucacagucuccaccuuuccauuucaggaaauguucaucuuaacuaguaccaaaaucauacucaaauuuuuccuguuguuccaaaaaugucccuugguggucauguccaaaaugguaucccauuuagagccacacauuugguuguuccuuaaauuuuugaaucaagugcagagguuugcaaacuuuuuccuuaaagggccauauaguaaauauuuuagacuuugagggccacgugaucucuauugcagcuauucaacucugcccuuuuguguacugugauguaauaguaaauacguguguguucucugcucccauuucuuugugcacaacuccugaaacccuuggaaucuccuaagugcuaagugucuuuuuguaugcugcuaagaugacugauggcugggggcuccuggauagccucaggauggggguuugccuaggaaaacccaucaugugauuagagaguuggaaguuucagucccucccacccacucccacuucuggggaaggggagagaaacugaagguugaguuguucacuaauggccagugauuuaaucaaucauaccuacauggugaagccucuauaaaaacccauacaugucucuaugugucucuuccaccuggccguuuuugaauggcaucuuuuuacaaugaauggguaauaaguaaagugcuuuccugaguuccgugagcugcucuagcaaaugaucaaaccugagaaggggguugugggaaccucuuauuguagccaaguuagacaaguuguggguaaccugggaaccuacugcuuguaauugguaucugaaauggggagagucuugugggacugagcccuugaccucugcggucugauguuauauccagguagauagugugagaauugaguuaaauuauaggucacccagcuggugucagagaauugguuguugggagaggaaaccccacacauaccugacgucagaagugaauccucacgccuguaauccaagcacuuugggaggccaaggugggaggacugcuugagcccgggaguucaagaccagccugggcaacaaagugagaccccaucucuacuuaaaacaaacaaacaaaaaauucagaguauugugaguaugagaauacuguaggagaaagcaguuugcauuuuuuccuaucucacaccuugucauucaaaagcaggugauagacaguauguaaauagguguggcuauguuccaguaaaacuuacggucacugaaacuugaaguucuuauaauuuugaugugucacaaaauauucuuuugauuuucuucaacuauuuaaaaauguaaagucauucuuagcuuagaggcaaacaaaaguaggcaguggcuugugggccuuaguuuaccaaucccuugcucuagcgcauuucuuuuuuuuuuuuuuuuuuuuuuuuuuuuuuuuuugagacggagucucgcucuguugcccaggcuggaguguaguggugcagucugggcucacugcaagcuccgccucccagguucacgccauucuccugccucagccucccgaguagcugggacuacaggcgcccacuaccacgcccggcuaauuuuuuguauuuuuaguagagacgggguuucacuguguuagccaggauggucucgaucuccugaccucgugauccuccugccucagccucccaaagugcugggauuauaggcgugagccaucgcgcccugccacacauuucuuuuuuuaaugucacugacuuaccaaagcagcugugcugguugugccugugaaauaaaaauaaaauucuaagcccccuaaacuggcugaacagaaccccccucgaccaaguagaccccagaaaaacaugaaaaacuaagauucccaaacaugacaagaugagggguugguccuggucuccuuccuuacuaaccaauaccagacuuuuuuccuacaaguugaacagaaaccagcccuggaaaaacaaagauuggaagacuugcuccucugcugacuucagccaacugccugacauugggaccagcuccccuccuuuuuugcaguuucaccaugacagcugaccaguuucacaaggcauuccuuccuguacugagggcaguugccacccccucaggccucaucaaggcuaccaaaaaauuacuccugggauccccucucguuguauauguuucucauucaauuuaggcccuuugcaccuguccccucacucagcaucuuuaagccaguugauugaccuccuaugagauacuuuucuccucuucuaaccuaaccauaauuuacuguaaccuccuuaauguagcuaccauuuugcguuuuuuuuuuuugagacagagucucacucugucgcccaggcuguagugcaguggcgccaucuuggcucacugcaagcuccaccucccggauucacaccauucuccugccucagccuccugaguagcugggacuacaggcgccugccaccacgcccggcuaauguuuuguauuuuuaguagagacgggguuuuaccguguuagccaggacggucucgaucuccugaccucgucaucugcccaccucggccuccuaaagugcugggauuacaggcaugagccacuacaccuggccccguuuugccuuuaauaagagauuaacgcacccaaagacuguguugucuuuacagacacuuuucucucaccucauauagacuuaagggagacccccuuacccacuaauggauccuuucucaaaaauucugcuggcuuccauuaugcagccuaugugguggucucugugaugggaaucauugaaucaggcccccagccaacugcccgaucugcccaacgagcagaauuagcauccccucacuugggccugccuacuggccuggggugaaacgguuaauauuuaugcagacagcacguaugucuuuggaguugcccaugauuuuggcaugcucuagaaacaaagaggauuuuuuacuuccucuggacaaccuauuaagaacaaagacuaggccaggugcaguggcucacgccuguaauccuagcacuuugggaagccgaggcagguggaucacuugaggucaggaguuugagaccagccugaccaacauggugaaaccucgucucuauaaaaaacacaaaaauuagccagacgugguggcaugcaccuguaaucccagcuaugugggaggcugaggcaggagaaucacuugagccugggagguggaggcugcagugagcugagauugcaccacugcacuccagcccgggcgacagagugagacucugucucagaaaaaaacaaaaacaaagacuguuuuguuucucuuagaugccauucaggcucauugagcccuagccguuaucauagucgaaggacauuucucugacaagacagaagacagcgaaggcaaccaccuaguggaugcagcagcuaaagcugccacccagcauguggcuccuucccgaguuguacucaacccacuccuccuccuccuccuccuccucccccccuugcucuuccuucuuccuugcuccccuccccaucugaagaccuuuccagacuuauuuucacaaaagacagucuuggagucuggaagagggaaauggaugaaacaaaauugcgcuugcaauccccagacaaaauuacaggaagguccaaauggacauccaguccuacccagcacccugcaaagacaaacaaccuucauacauaaucuaacccauuagaauccagacaaaaugauucagugggguagacaguacuacuguaugguggcucucuccagcucuugccccaccgcuauguaaacuuugcaauaucuacccucaguauaacccaggugaacuccugaagcucccuccaggacaauuuccucuccccuagggucccuuaaccaugugacaacuugauuucauuuaguuaccaccaucccacagauuaaauuuuguucuucuaaugguugacgauguauucucauugagguaggucuuucaccuguaaacaagcaacagcuauggugguggccaaaaugcugcuugagaaaaaccauuccuaucuaggguguucccacugaauuccacagcgacagaggcacucauuuuaccugccaaauacuagaacaaguuuuuuaaaucugcccuuuuacagcacuuucacugugccuauuacccccaguccucugggcuaguugaacagucuaaugggaucauugaaagcgagcuggcgaaaguuacagaaacuuaaccuguccuugccuaaagcucucccauuagcauuacugauucugcaguccauucccaccaguaaaugucagcucuccccuuuugaaauuguuacugguuggucugugcacuuagaccaggaaauauuuucuccugccaaaugacaggagggaacuuuaggcuuauugccaggggcuuguuaaagcuauaaagaucagucacugcaaguuguagaaucuuuuuacagcuucccaacaggccauaaacuccaguauuaccaccuccagcuuggugaugacaaguaguggaagagacaucaguuaaaauacuucauccagccuacuggaugggugcuauuaauuaauccuugugcugcuaaguuauagagauugacuccuggucgcacaugucucaucugaaaacaacaacccuugcugaaucuuggaaguuggugccagucucuacacgagacuucaguuaaccagagccucaucuuuagacccagaaaaaggcaauagucaacauaaacugcuuucaugagacccagggccaggacuguauucaaagacacugggucucauuuaauaauuugccucuaucuaaacuaauagaauuuguuccaugccuuucugcuagauaacuucgauguuuagcuaccugugugcuuccucuucuugucuuuaucagaacugagcagggcuuaugacccccacuccugaggacaucauugcuuuguuccuguagugagauguucucuuacuuaaggacagucccuuaaguuugucagauaauccccuuggauuuguaugggauuuaugguuuuucccuugguucaguuuucugaauuguuaaauggcuguucccuccauuccuuuuacucauaccugcacugucaccuuucccucucuuugcaauugucccucugucuugucucaaugcagagaauggcaugauaacacuuuaguuaagcugucccacauguugcuaguagaaggaaaccuauuggauugcuggauuugccaacaacuuccuugauccauucauaauagauaugugccauugguaauaucugucacugacugcucagaugucccuaaugucaccacuuacccagaccaaccccuuucccuguugauuuuccagguccaauuccuucaaagcccagauauugucaccccuuguuuugauguguccuguguuuuuaacauuggaaacccauucuuuaccaugggaccuucuuuguuguuguuguucuuuggguuuuuuaugguuuuuuuuugagacugagucuuggccuguuacccaggcuggagugcaguggugagaucucagcucacuauaaccuccgccucccggguucaagcgauucuccugccucagcaucccaagagcugggauuacaggcaccugccaccaugcccaacuaauuuuuguauuuuuaguagagacuggauuucacuguguuggccaggcuggucuuaaacuccugaccucaaguaauccaccugccuuggccucccagagugcugggauuacagacaugagccacugcacccggccuaccaugggaccuucuugaccuaugaacuacuggauagacaagugucaucuacaucagauaaauaaaguuaaaaauauaucccuacagugcccacaauauuuacauuuaaaauaagugaguggauucuggaaagcuugcaagagaaauggcccauaguuuaguuuggugaugucagcacuccgcaugaauacaucugcuaauuaagacauccucaggaguaucacuugugccccccauucaggcuguguguuuguauguggcauaaggucugauccaccugcacagcuuugggcacacuguugccucggcagccuacaguuagaagguucaugcuugcugagauauuuuguaaccccccguauccuuacacaaacuuacagaaggacccccuuucucuccauuauuaaacuaaaaggucuguguuggcagggugugaaggugauacagaucaaagcauccugggaauauuaauuccgaguguugggauuuaugucaauaaggauaugauuugaaaagucuuugccacuauuagucacauuguugcgggauuuaggaguaugagagaccucggguugaaacaggagaaucuuuuauugagugcacucaggcccagcagacucagguccaaagacugagcccgaaacaaagacagcacuugacuuuuauacacacuucacaaaagggugugggcuagcuugaagcaagcuuacaguggugugaaagcagggauacagaggcaggacagacucaggauugcucaugaccauugccaagcaacccagguguccguuaucuagguuugccuaggcacgggcuuaucccauaaccuucacuguggggcccaggcagcuguaguucaggccuacucaggcuucucgugaccuuuguuguacuucuuagauaaaacagaauacuugaaguuacuaguuacagagaacaagaaucuauaaacucauaccauaaagcaaaggaaaauuuguuuuucuucuccuuauguugagggagugcugggagagucuccacagcacauuagauaccauuaucaagacuuuuccugggucuggguugugccuguugccgccucugggacaagucagucuaauacaggaaaacuuauuucucuaucuuuuuaauuuuauuuuucuuuaauuucccaccucaagauagcugcagacacugcaaaaagccuuguagcucaacaaaagucucuaaacuccuuggcucaaguaguacuagauaauaaaguugccguagauuuucuccuagccaaacaaggaguuguuuggcccauaccuccuguuacauaaguacuucaggugaaauagaaacuguuagaggccgggcgcaguggcucaccccugugaucccagcacucugggaggccgaggcgggaggaucacaaggucaggagaucgagaccauccuggcuaacauggugaaaccccgucucuacuaaaaauacaaaaaauuagccggguguggcggcaggcgccuguagucucagcuacuugggaggccgaggcaggggaauggcgugaaccugggagguggagcuugcagugagccgagauggcaccacuguacuccagccugggugacagagcgagacuccaucucaaaaaaaaaagacacuguuagagaaagacuauccaaacaaccuuaaaugguuacaagagcuaugaacuacuaauccucucaaugaucuauuuaguuggcuuccaacuggccugggaaaucccuuucaaacugcuaaguguuugucauauucauagucuccaucauacuuucuuucuuaacauuuaaauuacuuauaauaggacugcaagaaguccccuguuaaaaccagaauuaugauggcucagugcguagaacuuacaggcaaguuaauuuuguagccauuccuuuuggcucuuauaucucuuauaccuuacggguuagugagggccugccaucucucuauuccugguugaucuaggauguccaauuggcuaucguagggauggaucugggacagauagccacaccacccuggcaaugacaugggacaaaauaaagauuuggcuauuggugcugcuugcagcagaucguggcuaaaauggggaaacaugaaauaaaaguaaauuucuaagcaccccccugccccacccgacugacugaauggacacuaccuuggccaaggagaccccagaaaaacucugaaagcuaaguuuuccagccaugauuagaugagaguuuggucacaccucaguacacccccuuccucacuaaccgauaccagacuuuuuuuguaagcguuaaauagaaaccagcccuggaacagaaacaagacucacuccucugcugacuucagccaaccaccugacaccacagccagacuccccuccuuuuuugugguuuugacaugacagcugaccaguuucaccgcgcauuccuuccugacaagugaccaccagucacagacuaguucuggcugguuuacucaggcugugcaccuuuugacauauaaagcuuaauuuuacugcauuuuaauguuaagucuccaccccaaagugaacaugggguuuguguaacauguauguuugcuuaucauacacgcaugaauccaccuuucaugaauauacauagcuccuccuauaaccuguuaaauauguacguuagccagcccauuuaguguaaaacuccuguuccccacuucuuccuuugaaaugguugcuuuuguucucagccaaaggcucugcuucccagccugcagguugcacgucaauaaaagaaauaaaguucuucccuaauguauagaucucgugauuuuaagucaacacccuacagaaagucugucuccuggcuuugucuguuugcuaaauaguagugucauugagcuuguucucuaaucccccguauuugcuauaaacucgggguuauaucuaaagacuagcaauaucuaaaaaacaaauugugccuuauuugcugucccuuuguauuccuagaucauaggugacagugaugugacacgauucagugagcccaauaacugaggcuucaacuuaagaguugugguuuucuccugguuacaaacagugccguuuucuacucuuacuuuguuuugaaaacgaaaagucaauauuugaagaacucuuaaauaauaaaguaggugcugcuuuucaagccagcuauuugaagaaaauuaaugaaaaagaaacauuacugaucuauauagggugacaugcuacugaauguaugaauccuucaguuuucuccccuaaugagaaguagcaauuuuccacuuugccuuguuuuuguuccuaucauucccucccacccguaucucuuacuuucuuagcuuuucaagcuacuuacuaucuuuagcuggaucuggcuagacauugguuuucauacaguauuugucuaguuuguuugaguuuacaugccaauaggcuuaugucuaauagagacuuuuaauuuaaaagauacuauugucaaccucaaauaaccaaaaaggucagaaucuaguuuacagaguuuauucaagcacaacaguugaggacugcagcccaggacacacuuccaaguugccuuggggagugcuccagagaacaaaagagaggcucaaauuuuuaaaggacaaaucaaaagguggggcgcgguuacaaaaaugguuaaucagggauucucauugguuuacagaaauaacauugguuagugauuggcuauguauuguugaacuauaggguguauggcauuuuagggccacuuggcgucagucuagagcccacauagcaagcggcuucaagaaguaauuauguagcucaaaggggagugagcuuggacugcugugaacauuuuaaaugccuuucugggccugaucauuuaaaggugcuugcauuucucagauccaagguuuuuguuucucacuaucccuuaacauagauaagaacauuuugaacaaauuaaauaaauaggauuuugaguggcuuuguuuucaugauuacaucaugagucuuaauguucaaaacauauugacucacauuuggcuauuugauaaugcauucuuggaucgggagccuuaaccacuuaaggugguaugacaguauggcuaaagcugauucaaauuccauuuguuguuggcauguuacaguguuuguaauaacaguguucccaauaauuacaugcuaauaagacuuuuaauuugcaaaaugcuuucauauuuguuuuugguuuugagccacauuuuguugcuggaaggagaaaguuuauguccacccuacuagugagaaaacugaggcucagaaagacucacuuauuuguugcgggugagcugugacuaucugggccagcagugcgaggguacaagaauuuacuaagacuggcugggcguggugccucaugccuguaaucccagcauuuugggaggccaagguggguggagcuccugaggucaggaguucgagaccagccuguccaacauggcaaaacccugucucuacuaaaaauacaaaaaauuagcugggugugguggugggcgccuauaaucccagcuacuugggaggcugagacaggagaauugcuugaacccgggagguggagguugcagugagcugagauugugccacugcacuguagccugggcgauagggugagacucugucuuaaaaagaaaaauaaaaaaaagauuaggaugaugcuaaaguguggaaggaugguggguggucagcugugauuaccacugucuacaucugcauggccuuuaagugcuucucacugcacuugggucaagggacuuuugaaggagucuuccugcauuucugucugcccagauaaacccagagacuauacugggacguaggaccugcuuuccucaucagccaggaccuauagaccuuucucaucccucauuucccccaucccagaucucaaauccucaagcagaauauccugacacucuggccugccuucagcaaaaauccaucaaguugaguaaacccagaaucuucccucaccuuugauguuuccucuuaguaauuuuucaucuguugauccccauucuacuugguggcaauaaauccucacuuguccuuguauucaaaauugagcccagucccucccccuucugcaaaaccuucccuucugucaguagucucucuugaauaaaggcuuccucagagucuuugacaaguguuaugaauaauuguuugcuuaacacugcacaaaggggaaauggucuagaagagauacagaccauuucuguuuuccuaaugaucagugaugaucggugacccuagacuaaaccucucugaaggauuauuuuaggcagaaaggccucuccccucuucccuggguuuccuuucucagucugccccauuuaucuaauuuccuguacuuacuuauaaagaaacuagauaguaauucuuuggauugggccauuccaccaaacuucuauauuguauguauaguauuagaugauguuuauauguuaauagcccuuuuaaaggguaccacaucccacccaucuuuguugacauguuagugcccaaauaucuuuguaguuuucugcauuuuacuuuuuccccuauuguuucaaaugccuggaauacucucuucacugucucuuaaauuuucuaaacucccauucacuuucaaggugugucuuauugguggagcagacacuccuggggaccaacuuggcagaaauuagaaugagaacauaccaagaagcugaaacuuggcagaaauaauguagggagucuguugguaaucagcugccuaccaccaccgcaaauuuugagauucuccuccugcuaaaagcuaaauuauguguauuuucaauaagggaggcauuuuuuuuucuugccugugaccagucacagucugacuucauaucuuguuguuccccauguucccuuauauucuacagcagaacagagcuuucuguugcauccaguauuuuaaaaacaagugucuguaccauaacugagucuggugucuucugaccucucccuuccuuacacugucuucccucaguaucggcaggagacugguuccagaaccuccugcagauaccaaaacccuuacauaaaauggcuugguguuugccuguaaccugugcauauccucauguaugcuuuaaaucaugucuagauuacuuaaaauaccuaauuugauguaaaugcuauguaaaugguuuuuauaccuuacugugcuuuuauuuauauuauuuuuuauuguuguguuguuauuuuuauuuucuaauauuuucaaucgaccugugguuggcugaaucugcagauccagaucccagagauacagagggccaauuguucuucucuccagcagccagaacagccuguagcucuuuacaagcacugugcucuuucccaucuugaaggcuuugcucccgcugcuuccucuuugugcaguuaccucucuuccacuggauaacagucacucauccuuuaagauucaguucaaugaugacuucuuucuggaagccucuucugagccagccaccagacuagguuggguguuccucuucugugucccauaguaccaguguuuacuucuaauauuucauaauugucugauaauggaucugccuuaccaguucugcggugaguuucuugaaagcaggaauuauauccuauucaucuuuguaucccauguuucuagcacaguaguugacaagugguaggcacuuggauauuguuugaguagaugagugugugaacaaaaaguuuaguaacagaagcuuuuuauuuaaguacaaguuucauguagagacucaauaauuaaucagugacuuuugcuuucuacagauauugguaucaacuugacugacccuauguucagaggaauuuauagggggguucaaaagcaucaagguaaauauuuccuuuauuaaggcgaauaguuuccuaugaagacaaauuuucugccucaggagaucuugaaaagcauaauucaagcugagucuuguggcucacaccuguaaucucagcacuuugggagucugaggcaggaggauugccugagcucaggaguucaagagcagccugggcaacauaauccgcucuuaaaauugaaauaauaaagaacuccuggcugggcgcaguggcucaugccuguaaucccagcacuuugggaggcugaggcaaguggaucaccugaggucaggaguucgagaccagccuggccaacauggugaaaccccaucucuacuaaaaauacaauaaaauuagcugggcauggugacaugcaccuguaaucccagcuacuugggaggcuaaggcacgagaaucacuugaacccaggagguggaaguugcagugagccgagaccacaccauugcacuccagccugggcaacaagaacgaaacuccgucucaaaaaaaaagaacucauuaugcauuuuggauaaaccuguaaacaaagugaaacacauuuauugauaaaccaugaucaugaacauuuauaauaaaguuuaauuaaggucuucuuaccuguagaaguuuauaauuucaaauauaaaacuucaaauagccauuugcacagaagcuaaaaaaaaaagucaaauuuuugucugccagguuuucauaauacagaguuuaucuuuuacagaugacuuacaggauguaauagggagagcugucgagauugguguuaaaaagguaacauccauuuuguuauuuuugagauuuuuaaaauucauuuuuuaacuaaauuuuaguuaaaauuuugcagaauagaaaggaacaaaccaaugccacaguugggguacauauugucuacuugugauauuagaaaguuaauugaaacaaaauaucaaaauacucuguucauagcaauuuaaguuacacaaaucucauguauuguuuuuauauaugauaaauggcaaaagcuccuugaaaaaaaauuuuuuaaaccuaugugaauuaccaggcuuaagaggcaacuuuuaaucaauuuuauaauauaauuuagcauuugucagaauuaagcaauaaucaaaaauacauguaccugacaccaaguguagcuauuuauaguuugggcauaccauuuaaauaauggaguaaaacuuucauuuuuacaguaauaaaaugccuacggcuuuuuagagaguucuacuaagcaaaugaauagauauuucuuuaaauuagcuuuaaaacagagagcuagcccacacauacacuaagaaauaagguuaaauuccauacuaugcuaccaggacacuugguagcugcuaccuccaagaugaauaacuuguuuuggaaagugacacugcugacuaaaugaguuugcagacuccaacucuaaacuuuuauuuguuauuauucacaaauaauaugaaaagauaaaaguuacauuaauuucucauuauagucacucugcuugguaaaucacuuuaaacaaugcuuuucugcagacucugaaauacuaggcuccuaaauuuucauguguuagccaugaguaaucuuaauguuuauucacacacacacacuuaggaaugacagaacugaagugauuuuuacuuggacaugguuccaaacugaaauuuaauucaauaccuugcauuuauaguguaguaguuaaaagcauaguuagggcauaacaaacgugguauccagccccuacuucauuuuucauagcuuuauaaccuggagucuuuuaucucacuagacuucaguuuucucaucuguaaaaugagaaugauaauaguacuuaauuaauagaguuguuaugaaggcuaaauaaaauauugaguguaaagcauuugguauuauaccuggcauaaacaaccuucauuauguguaugauggaagccaccaccaugagaucaucaucaucguuaucuuuuuuuuuuuuuuuuuuuuuugagacggagucucgcucugucacccagacuggagugcaguggcaugaucucggcucacugcaagcucugccucccggguucacgccauucuccugccucagccucccgaguagcugggacuacaggcgcccgccaccacacccggcuaauuuuuuuguauuuuuaguagagacgggguuucaccacguuggccaggauggucucgaucuccugacuucgugaucugccagccuuggcuucccaaagugcugggauuacaggcuugagccaccgcgccaggcccaucaucguuauuuuauacacugggagaggagaugaugcccucuugucuugccguuuuuuucaacuauuuaguaaaguuguagguaaaauaaaaaguauacuugguuaguauuuuacguaauuuaaauacuggauguaggcaucuguucuaguauuaaaguuuuagguauguuaguaacaagaaaguuuucccaauauuuuuauuagucuuuuuuuuuuuuucuggaggcgagucucgcucugucccccaggcuggagugcaguggcacgaucucggcucacugcaaccucugccucccggguucaagugauucuccugccucagccucccaaguagcugggacuacaggggccugccaccacgccuggcuaauuuuuguauuuucaguagagacgggguuucgccauguuggccaggauggucucaaacuccugaccacgggugauccaucugccucagccucccaaagugcugggauuauaggcgugagccacugcgcccugccuuacaucuucugcuuuacagauagucaaggauuuaauuauggcuauguuuccggaauggauaugcaauagcuaaucauauuaaagauuuaaauagcuauaugaaaauaucuauuuaucauuugcaauucuaccuucguuuuguguuuucucccuaaguuguaccuagaaugaauucauuuuagugagacuuuugaaguaugcuuuacaaaaauauacaucauuauacuugaaucacgucuucagaagaaggcgccccuuacgcagcacugcuucagugcucucacuaucaacacauaacucuuuagugacauuuucauuuuaacagauuaggaaagauggcauucuaauuacugagcggacucuaaugggucuaugcagaaguaugcuuauuugccaaaagccauacguuuuccuacagagaauucauuagcaugcauuaacucacugauucucaaaccuuuugcucucaaaaccacuucacauucuuuauuauugaggacccccaaagagcuuuuguuugugugagucuuaccuacugauacauacuauauuaaaaauuaaaacaaaauauuuuaaauauuccuuuuaaaauaagaaacuacuggauaacauaaauagcauauuuuuaugaaaaauaaguauauuccagaacaaaaaaauuagcaacaugaguacaguuguauguuuuuucaaaucucuaaugacuguguuacuagaagccugcugaauuuucauaucuuuuucuguagucagucucugguggugucaaacaucguguagcuucuugaauaccuuguggacacuugcaguagagugagagugaaaaagacagaaagugucuuauuauuguuaggaaaauaguuuugacuucacauaccuacugggaguuaccagacuacaccuggagaacuguugaaucaaucaacacuauugaaucauugauuucguuauucacgcuuucauaacaccugaucucuguccucaaggaaugcauugucuaauaggaaagguggguauauaaauacauuuuaacagagucuagugaugaauucugcaccucuacaugcacacacacauacauacaucccugagguguagucaggcacuacucugcauaggagguaaucucccagcugaauuuuaaaggguagguguguggcagucacagaggaaagagcauucuggaauaaggaagugguaggaaggcauguuuaggaaacuguuauugcugcccuauuaaagucagcuuauuuuauuuucuuucuauuucaguuuaugauuacagguggaaaucuacaagacaguaaagaugcacugcauuuggcacaaacaaaugguauccucauauuucuuuuaccaaaaaaaaaaugaauuaaguaauuuugaagaagucuuucugaaaacugcuucagguacaauacaauggaucaugacuggaaacaauaggaaaauggacugauuuaaaugggacaugauuaagaugacaaaauucaaaguacucauugguauaucagauguuuauaaaacuguuucauacugcucaaugaagauuauuuuaagauuucagcuaaugagaauaaaguucuccagguacacaguuuaaccucagguguguuuuuuuuuuuuuuuugagacggagucucacucuguuacccaggcugaagugcaguggugcgaucucggcucacugcaaacuccaccucccagguucacaccauucuccugccucagccucccggguagcugggacuacaggcgcccgccaccacgccaggcuaauuuuuuguauuuuuaguagagacgggguuucaccauguuagccaggauggucucgaucuccugaccucgugauccacccgccucagccucccaaagugcugggauuacaggcgugagccacugcacccggccuuuuuuuuuuuuuuuuuuuuuuuuuuuuuuugagauagagucucacucugucgcccaggcuagagugcaguggcgcaaucucggcucacugcgcgcgccaccucccugguucaugccauucuccugccucagccucccauguagcugggacuacaggugccugccaccaugcccagcuaauuuuuuguauuuuuaguagagaagggguuucacuguguuagccaagaugggucuugaucuccugaccucgugauccgccugccucggccucccaaagcgcugggauuacaggcgugagccaccgugcccagccaaccucagguguuuuugauguggaauucauguguguguuuuaacguguuuaagauacgaguugcuuuuuauuuacucuuuuuuaacuuaagcugugaagggccauuuuauuaaauuuuuacuagauggaccagauacugugcaagguaccaggaaugcaaauaauaacacuauauaaucucucauauccuugcuuuauguucauacauuuugcauuuguuuaaaaucuuaaaaguuuuaagacugauuauuaaaggaauccuaguuagguaaaaccucauuuaucuggcauucacgaauuucacuuuuuuuugcauuaucuuacgugcuagacacugaggaauuaaacauuccacauaauuuuuaaauuuuguauuuuaaaauacugauguguuuccuuuauguaugaaaacuuacuaaaagcuauauuuuuauggaaaucucucuaaaauccacacuugucuuuuaggauccauucacacuuuuucuuuuuuuuuuuuuuuuugagacagucuuguucuaucacccaggcuggagugcaauggcacgaucucggcucacggcaaccucugccuccuggguacaagugauucuccugccucagccuccugaguagcugggauuacaggcgugugccaccacacccagcuaauuuuuguaucuuuaguagagacgggguuucaccauguuggucaggcuggucuugaacuccugaccucgugaucugcccggcuugcccucccaaagugcugggauuacaggcguaagccaccucacccaccccauugacacuuuuuguuagugauuaaagauagacuaucuuccagggaguuuuugaaauauauaagaacauuuuauccuuacuuuucauccccaaacagcuaugcuuuuuaaaguucucccaccuccauuaccagcccucuuccacuccucuccauguaacuucuguucuuacagcuuuaaaagugcugcuuccuuuuuuucuaaacaucuacaugagagccugaggaaagcuugauaccuuucccaugguucgggcucagcuaagccauucaaaaaguguuuuugacuucucauuuguauucuaugcaagucaagcugucagagucuccuccgaauaagugaaccucauuuacuugcuagaaaaacaaaucccccuuuccaccacuuuaaaucgcccccacuauuaaccuguuuaagggaauacauuuuuauugcuauauuaaauacaugaaucaauaauggaggaauagguguuaaacaaacaaaaauauaccaaucaagauagucacaugaauggugaauauaaaagauaaaaucagugcuggucaugguggcucaggccuguaaucccagcacuuugggaggccaggcagguggaucgcuugagcucaggaguucgagaccagccugggcaacguagcgaaacccugucucuaccaaaaaaaaaaaaauuaaaaauuagccaggugugguggcaugcguauguagccccaguuacgugggaggcugaggugggaggaucgcuugagcccaggaggucaaggcugcaguaagcugugauagcaccacugcacuccagccugggugacacaguggcacccugucucaaaaaaaaaaaaaaauuucacuuugcauucuacagcccuaaaugccaagcuuuagaaaaaguugaauuauuuuauuaauacauuaaagcaauuuucauauucaucuccuacuuuguuuagguauucuaaaaauugucauaugauuaacauaaugcaguucuuauaauuugaguaauuuauugccauuguugaaaaccaguugaaauuacuugauauccucuaaauaucauaauaaauauaaauaugagaaaauacuuugaaaauaauccuaagacauuauuuucuguuagguauguuuuucaguacaguuggaugucauccuacaagauguggugaauuugaaaagaauaacccugaucuuuacuuaaaggaguugcuaaaucuugcugaaaacaauaaagggaaaguuguggcaauaggagaaugcggacuuggugagugccagccucgccucuuagagugacauuguuugaaaauaaguaauuuguucuguauaaguuaggaguaauuauucuucuuuaucuuuuuaaagauuuugaccgacugcaguuuugucccaaagauacucaacucaaguaaggaaauuuguuggcuuuacaaauuauuguaaaaucaugagugauuuuuaaaauaucuuguaucaggugagaguauaguuggauuaagcaugaggauauuuuuguuuuucccuuuguauaucaaaaguaagugaaacaaauuccaugcauacuugcauguaauucauaagggauggaagcacauaguucccugguugauuaaccauuuaauuuuauuguaaugguagaaauuagggaugaguuuuacaugauagagauuuuacauuuucuguuugcuuguuuaacagacgcauucauacgugaacaguuccaauggaaugaauuaaauuauuuuggggaaugugauuguuuuguuuuguuuuuugagacagagucucucugucgcccaggcuggagugcagaggcgugaucucagcucaccgcaaccuccaccuccuggguucaaaugagucuccugccucagccucccgaguagcugggauuacaggcaugugccaccaugcccggcuaauuuuuauguuuuuaguaaaaauuggguuucaccauauuggucaagcuggucucaaacuccugaccucaaaugauccacccgccucggccucccaaauugggagauauaauuuaagagcaaaggauauuaaaaguguauuacaagccaggcacagcagccugcgucuguagucgcagcuguuugagaggcagaggcaggagaauugcuugagcucaagaguuccagaccagccugagcaacauaaggagacuccgucucuaaaaaaaaccagcaagaaaaaacccacaaaaguauuauaggaucaaucaccaaagcuagaaaagcuuauuuuacucuugcugggcauugaauauugcuaguuuggaacugugagauuccuuuaauaggagccauguugaaugguggcuucugagaaaacuccaaagcucacgacccugcaggacuuccuguaacccauugccuggagcuaaauuuggagcuccugucaucauacuggugggugaguguuauagauugaaaagaaaauuuaggucacagucugaauuuaaaacguaagcauuuuguugaauuucaaaaacaucuuaauuaugaaaaugauaaaacauuagacugagcuucuaaaggggguuaauuuauucauccauugaacaaauauuuauggaguacugugugccagccacugcugagagcucauaguaugcagaaauaugaauaagguagaauaucugucccuagagaccuuuaagaauaaacaauccucuguccuccuuaguuucuuauacacaaagaagaauuaggaucagauucucucuuaagauaccauccagcuauaucauaauguuuaacaauuaauaauuuugucauauggugauaugaucauaugauuaagccagugacuugauggccugaagggauuuuuuuaaauuacgcaugaggaaaguguacuuccucccgcuucccucccugcuccccacaaaugggauucugauauguacccccugguugaaaaucacuuuggggaggagcagaucugcuaguggagucugucauacccuagaccucaagcuccaaaguucugaagugugaagaucuauaaccaaguagaauaggauggguuaacguaaugcucuguggauaccuacucucucuuuuaggucgcucauuuguacaucccuuguagaacuguuuaguuugugguauauuauuugcugauuugcugugccuuucagggacauucaugugguuacuagcaggguuacugaagcccuauaccucugucgaauauuauguaggccagcucacuuaaccuuaaaaguucucguguucacauugaaauagaaaaacaguucucuuuaauaguucuuuagguuaagcccagauaucauauuccucaacuuucaugucugguuuuggucaggauaagccuuguaagucuaauagacuguguuaugacaagcaagggcaauggcagaguccccguguuuuuuugcccauaugacuuuucauccaaaaugaguuagaacugauucuaaaaugcaaccucaauacuuuaaacucacuuuugggauuaaucgaaaacauugacaguaucaguuuaauuuaacuguucugaagauucuucaccaucaucagaauagcgucugaucuuagaauaugcauaucacagcuugugcuugaacucacaugccaagcguuaauugcuaauagagagguucaaacuacauucaguaaaugauuaccaagugccuccucagcaugauacaaagaagaauaagacuuuuuccaagagaggacauaaauaauuaaaauagguuggaagugcuuacuaaaguaugugaacagcagagggaaggacugacuuucugggggaugcucuaaggugacagcauaugacacuggcuucuuccagaguggauaagcuaaugacaaaguaggaggaaauuuugauaagauaggcaguucuacuugagauuuuuaaaauuuuaauaauaaaacaucaaaugacuugguuaaaaaaacagccgggugcggugguucaugccuauaauuccagcacuuugggaggccaaggcaggccgaucaccugagaucaggaguucaagaccagccuuaccaacauggugaaaccccgucucuacuaaaaacaaaaacuagccaggcgugguggcgagcaccuguaaucccagcuacuugggaggcugaggcaggagaauugcuugaacuggggaggaggagguugcagugagccaagaucgugacauuggacuccagcccgggcaacagagaaagauuccgcucaaaagaaaaaaaaaagacacacuaguaacaaucacauuuugauuauuguuaaggaaacaaauacccacauucucugccccucacuccuuuuccccucgcauauacucacagcaugcaaucuguuuuguauacacagcacucuacuuguuucagcacuuaccauguuguacagaaauggguuuucauuaucccuuccuccccgcaacagacaggugucuuugaguuccucaaaggcacacaccaagucuuacucaugugacaguuccauagcacuuagcacaguacucucagcacaugguaggcacuuaguaaaugucuguugaauauuuaauacagagggaagguucuuuucuuuuuuauucccuuugagcagcauggauaaaaagccuauaauucagcuuucacuauuggguuuauuuuuggaagacuucagauuuuggucugcacuuuucuaccaucuggaacaaccaguguaugauuguguuuguuuguuuguuuguuuguuuuuugagauggagucucacucugucccccaggcuggagugcaguggugcaaucucagaucacugcaaccuccaccucccagguucaagcaauucuccugccucagccucccaaguagcugggauuacaggugcccaucagcaugccuggcuaauuuuuuuguauuuuuaguagagacagaguuucaccauguuggccaggcugguuucgaacuccagaccucaagugauccgcccaccacggccucccaaagugcuaggguuacaggcaugagccacugcacccggccaugauuuguuuuuaaguaaauauguagucaggaaaaaggagauguaugagaaaagaaaaauagaaaauuagggggcaagacagaaaaauuaauauacaauagauguagugucugaaaaauaaugguaagugaaggcgguguaugaccauguuaaaaggaugagcuuuggaaucagcagaucuuugggugagauuuacaacugccuuuggugucacuucaucccuuugugcauccccuuuaaaauggggagauugcugccuaccuuucuuaacauaaggcacauaaagcccauagugacaugagucaugcagaguaugugcacaaucauggcuguuguuacauuccucauacuagaaauaauuaccacccuaaaggaagaugcuagcuauuguuuuuguuuggaacuuuuaaaaguuuuuuuuuuuaauacuuuuuucuuguuuuaguaccuagaccuuuucuggaaaaaguauuuuuuaaagacuaagaaagagaagcaaagagugaaaacaaggaaaggccugaucuacuuauggaaaguuuauccuuuaagccauacccuguauuuucaauuuccuggccuuaugcuacacuccuuuccuuguugcaauuuagagcucuguucucuuggguaggaggaauuugcuuugggcauuuuucuuggggcuuuaaaauguuaacacugugcaggucuuaaaaacuacaacaagaagauuuuaaaacaauccuuuggggauuuaggggacccuagagaugagcaauugaggccauguugccaucaagcagcuuacagaggagggauuacuacuuguguugagguauacccaugaaacucacugggcuuuuuggauuugccuugauccuaauuaauaacaacugcuccugaagcugaacuuuuccagcucuugucguuagauaguuaaaccucaacuguaagaagcaguaauaaaaucagaagcuucacuaagaugagcaaauaacucaaguggaaaauuauuuucauuuaugaacuuuaaaaaaauaauaagugaguaaaacaggcagagaagucucuuaauagaugccaauuccuacccuguaacuuauacaguuauuucuaguuaccauggcggguuuuucuucucuaaagauaauagucguuugauguucaguacuaguuauccucaauuuguaucauuaggaauaauuuuuuuuaccacauggcuucuuuaugauacguagcuagcaugacuucagggaccuuucuuuucuugaauuauguaaaauucugugggcccauugcuugggcuucuguuauuuucuuuuucuuuuuucuuugagacagggucucacucugucauccaagcuggagugcaguggugugaucauggcucaccgcagccuugaccucgccaggcucaagcaauccucccaccucagccucccaagaacugagacuguaggcauaugcuaccacaccuggcuaauucuuguauuuuuuguagagaugggguuucaccauguugcccagguuggucucgaacuccugagcucaagcaauccacccaccucagccucccaaagugcugggauuacaggccugaaccacacacccagcuggccucuguuauuuucauaaacuguacuuuugccuacauuccuauaggaagcuaauuuuccauccgaccauuagauacugugaauuuguagcuuggucaugugguuugguccauggaauuguguguggaaaaaauaaccaguacagcguggagcagugcacacaaugaagaguaccgccugcuguguguagucagagccaaauauauuaguaaaguugacauaaugacuagugcacacuuaacugcugacauuugguuuacuuuagagguuauggaaauagugacugguuauauuaucaaaaucucuuuuuguccaaguugucguuaauauuuccuacacugcaaaauuucagcacuuuguuaaugaaaggaaaauauuuuugcuuauucuaacccagcagaaucugaaaaggagauuuuaaaacccaaacauuugguaauacagacauagacgaccuauuuuaggaagacuauuucuauuuuuuuaauuuuuaauuuuuuuuuuuuuuuuugagacagaauguugcucucucacccaggcuggagugcagugguacaaucucagcucacugcaaccucugacccuggguucaagagauucucaugccugccgaauagcugggauuacaggcaugugccaacaugccggcuaauuuuuguauauuuaguagagacgagguuucaccaugcuggccaggcuggucuugaacuccugcccuugagugauccacccgccuuggccucccaaagugcuggcauuacaggugugagccaccacgcccggccugaagacugcuucuuaagaaguacauuucuauuucuaauuuuaaaauuuagcauuuucaagagagcaaaggggguaaaauaguccugcacaucaggaaauaugauauagaaaaauauagcaagagaggcuuaaguuaaacagagaaauuguuuccccaaauuaaagugcuuagaagagguaagcacauuuaagaaaauaauaagccaccuguuauccugauucaguugaaccuaccauuugugagaacaagggggagcacuguguugaagugaaaagacaaacagaaugaacauucguuguauccucugaauauugucauuauacuccgggaccagaaggaagcuucuugaaaacguaacagguuuuugucguuuaggcugggacuuggaauuagagcagugaaguucuguuccaaguuggccaugccagguauuguuaucuuggacaaaguacuacaccucucugacaccagcuuuuauacucagguuauuuugaggaucaaaugagacaaugguaucugguacuuggaaaaaccuucuuaucaaguacucuuuaagauauucagggcuaccacuuuaucauguaauuuucuuuuuuuaauagcauaauugaguuauuugcuguuuagcaaauacuuagauuucauuuuugagggaaaccuuguucauuuugcccaguggcaauaacuucuuuuauaacagcacauaaaaaacugguugcaaaauggaauagauuagcaugcaguaugaagcucuccugggcuucucgcuuggugaguugacucccacugauggugcucccaguggcaaggggccagugguguuacuuucugaaaauuaaagggcccagauaauuuuguaagcccagaaaaugaaguauuucuuuccagaaguuguaaguuauaaaagcccuuugauaagccugaugugcuuuaaauauucaugauuuuuguccuguaauuucuagagaauuaaauaccuuuaauuuaaaagcucuuuugacaucauuaccuuccucaugcuaaaauacaauuuguaaugagaauuuuuuuuuuuugcauuaugcagauauuuugaaaaacaguuugaacugucagaacaaacaaaauuaccaauguuucuucauugucgaaacucacaugcugaauuuuugggugaguuaaaaccaaagucucauucagaacuuaagaauuuuguagaaaucaagcuauuugcuaaaaguucuuuguuuuuaauucacagacauaaugaaaagaaauagagaucgguguguagggggagugguaaguauaaaauagucauuuuuaauacagguugaacaucucuaauccaaaaauccaaaauacucccaaguacaaaaugcuccaaaaucugaaccuuuuuaagcacuggcaugagauaaugacaccuuugcuuucugauuauucauuguacacaaauuuuguuucacgcacaaaauuauuuaaaauauuuaccuucagggugugguauaagguguaugugaaacauaaaugaauuucauguuuagacuugagucccuucccaaagauuucuuuuuauguauaugcagauauuccaaaaucugaaaaaaucugaaauaugaaacacuuuuggucccacacacuugggauaagggauacuuaacauuuaugugacacacaaagcaucuugguuauuaaggauggccccuaauucagaugucaacauuuaaauuuuuuuuaaaaaggaauaacaaagaaaaacauaggaauuagauagaauucaauagaauuaggagcuucuuuucccauccuuugaaagacauguaaauuuacuguugaauuuauggaccagguguggcauaaacacaaaucaguuuuaauuacaguuccuuuguucaaaguacaagaaugcguacagaauuccauucacaagaaaacccugugaaauuuuuuuuguuuuuuguguguguuuuuuguuuuuuuuuuuuuuugguuauuaagaaagggucuggcucugucauccaggcugaagugcaguggcacaaucucagcucacugcaaccucugcuuccccgggaucaagccauccucagccucccaaguagcugggacuacaggcaugugccaccauggccagcuaauuuuuuuguauauuuuguagagaugaaguuuuacuauguugccuaggcugaucucgaacuccuaaacucaagcaaucugcccacccuggcuucccaaaguguugggauuacaggugugagccacugugccuggcccuugaauucuacacauccuaaugcugugcaugauauucuucgucucuucugucagcuguucuuuaauguucuuccauccaaauuuugagcaaauauaaacuaauuuuuauguuuugaaauauuuuaccauuuguuuuagguuugccuuucucauuucuuguccgcuguauucaccuacuauucugaucuagagagucauucuccuuucuguaauuugcauucugcacuaaacacuucucugauauagccauuuuagucauuauucuggagacauuucccauaaauacuaucugcuaaccacauaccuccgauaucuauggcagugauuuuuuuuuuuuugagauggagucucgcucugucaccaggcuggaguggaguggcacaaucucagcucacugcaaccuccgucaccuggguucaagcaauucuccugccucagccucccaaguaccugggacuacaggugcacaccaccacguccagcuaauuuuuguauuuuuaguagagacgggguuucaccauguuggccaggauggucucgaucucuugaccucaugauccuccccccaucagccucccaaagugcuaggauuacaggcaugagccaccuugcccagccaugauuuuuagucucuucgaucauggacuccuuuggaaaccugccuuagaaaaaugcucagauauacauauauucauaugcaauuucaggagagugacucagugagugacugugucuagcaaaagaacuguaauccagguagauuaaaucacaguuacacuaugccugcuaaggaaagaggaaauagcaccaagcacuugcauucccaugcggccugacguugacaguuuuaugcguauucucuaaguucaaccucugccucaucuauacuacuaguaauauguaugcauccugcauugcuguaauguuaauauuacugugcacuuuuuuccuguuuguacuaacucuguaauuuuuuccuguuuuuacuuacucuguaauuuauccuguaggaacuguacuuaagaauugagagggguuuuaguuuuaacuaaugccguugggauuauuagugguauuuauccuaaccuucagacucuaccucucagcccauuugcuuuauuucuuuucuuuuuuucuuuuucuuuuuuuuuuuuuuuuuuuuuugagacagagccuugcucugucacccaggcuggagugcaauagcacgaucuuggcucaccacaacuucugucuuccaaguucaagcaauucuuuugccucagccucccgaguagcuggggcuacaggcacgcaccaccacgccuggcuaauuuuuguauuuucaguagagacaggguuucaucauguuggccaggugggucuugaacuccugaccucaagcgauccaccugccucggccucccaaagugcugggauuacagaugggagccacugugcccagccuauuucuaaauaagaauuuacuuggguucuauuaauaguuuuuaaaauuaacaaaagcaacaacaaauccaaccuaaauguuugacuuuuaccaaaaaagaaauugccaaauaauuaauaacuaguuuucugaaaugguuuaugaggagucacuuuuaaaaugauuucgauauuaauggagggcaucuuuucuagucagcuggaaauggugaaggaaagaauaaugcaggcagcuguguaaugcaggcuucuuuauuguugagaaauauguuauccauaguguauucaggcucucuggacucaguaguaaugugaugucacuuguuuaggugaaccuacuuuuuaaaggagggcuguuguuauauguuguuuuugauuauauaaauacauccaaacuaugaaaacuaugucuugaccccuauaucuuugaaggagagaaauagcaucucaaucccuucugcuugcuaagcugauauuauugauuauauaaugguuuaugcuuuuuuuuuuuuuuuugagacaguuucgcugaucuccugaccuugugaucugccuaccucggccucccaaauugcugagauuacaguuuaugcuuuuuaagcaacagucucacccauuuauaagaauuucuucagccuugucucuuuuuuuguuuuguuuuuguuuuugagacagaguuuuacucuuguugcccaggcuggaguguaaugaugugaucucagcucaacgcaaccuccgccuuccagguucaagcaauucuccugccucagccucccgaguaguugggauuacaagcaugcgccaccaugcccagcuaauuuuguguuuuuaguagagauggguuuucuccacauuggucaggcuggucucgaacucccaaccucaggugauccaccagccucagccucccaaagugcugggguuacaggcgugagccauugcgccuggcccagccuugccucuuaaaaguaauuucucuuccacaaaaaaguauccucggccaggcgcgguggcucaccucuguaaucccagcauuuugggaggccgaggcgggcgaaucaccugaggucgggaguucaagaccagccugaccaacauggagaaaccccaucucuacuaaaaaaaaaaaaaauacaaaauuagccaggcgugguggcgcaugcuuguaaucccagcuacucaggaggcugaggcaggagaaucucuugaagcagggagguggagguugcagugagccaagaucgcgccauugcaccccagccugggcaacaagagcaaaacuccaucucaaaaaaaaaaaaaaaaguauccucuaacagaaaauucaucaguauuuuaaaaauucuuuuaaauagugccauaaaauuacuaagcuuuccucauguuuuugccuaagaauauaucuauuccuaaaccccuuccuggagcuucugcacuaaugcuagugcagagacagcaacacugccacucuaaagagagaaauucucggcagcuaacguuuugcaucaugucacuggagaugaugacagguuguaauugugaaaaauaauaugaaaauaaaaauuauagcgacuaccaccuuugaaacccugagguccaaaaacuuacagggaucuauauuuuugccuacaaagucuuauuaaugucacuuagaauuuuaaagaguaauuauuauaauaauaaacuuauaccuguauguccccaggugcauucauuugaugguaccaaggaagcagcagcugcuuugauugacuuggaucuuuauauaggauuuaaugguugguacguucuuagguugcuuugguuuuuaacuuuuauuuaagcagauuucuuaaauugucuuacagugaauugcugaugaagauuuauuuucauuaaaguuuguguguguuugcauugaucuuugcugggaauuucaguaauuauuuauuaagaaauuaaacaguacauuacuauuaaaaguuaaagcucgaaaguuauagacuacuacauuauguucuaauaauggaaaacaauuuuguguugagaucugcagcuggcuuucucugguaauccaauuuauucucaggucauuugaucccuugaaaacauguguucacagcauuauguauacauauacacgucauaucugacuauggacgaacgguuuauucugugacagucauacaucucugcagucaaagaaaccgaggcucaaagaaauuaggaaacagguauagaguuucuccaaguaugagaacccauguccucuggcuucucacucugugaucuuucugcuguuguaccacacuaaacuucacacacucaguacagucagcuagcacagcuaggucucuggguugguuuugucacauauguaagagcuucuaccagugacuuuucacaggaugucaguguagccuauuaaaucaguugcaaaauaguauaggaguuucuguccuucuucauugucucauacccuuaaaauuauuauguuuccaauugcauuauuuuugacuaaaaucuagggaaauagaaucauggaauuauguauuugcucuagaguucagaguuuaaaugucuaagaugcuuucauauuuaaauuaaugguuuaauuaacuuuaaaauuaauuaauaugcaagggaauauaugcauagagauuaaaaagucaaguaguacuaacagauaugaacaaauaucagaguccccccagcaugaccuuaccccaagucagcuuuuguagcagcaauaauuuugcuauuugucaccauauuucuaaauaauauccauauacuauugucucuugauucauccccuuugucuauucucauugggguauaugagcacauuaguucuuauaucccguacuaauccccuaccuccauucucugcauaucacucucaaugucguuauuucagaauuuuugguuauaugcauacucaauguuuucauuauuaugucuauauaaauguuguuuccuuauuaugccuauauaaauauauaauuucacagugcuaugccaaguaugagaggguuucaaguuuuuuguuuuuugguuucuuuuuaaagauagggacuugcuugcucuguagcccaagcuggaaugcaguggcgugaucacaacucugcagccuugaccucccaggcucaagcaacccucccaccucagccuccugaguagcugguauuacuggugcaugccaccacaccuggcuauuuuuuaaauuuuuaguugagacagggucuugcuaugugcccaggcugggcuucaaguuuaagaaagccaaguaaauaaaaauaugagggagguuaauccaggaaaacaaaaaguaguacaagaaaagaaauguuaagcacaguauaccacaugagcaaaccuauguagauaaucuaauaguuccgucaguugcagacccuuccauguguuucaauuuggacuaguuccuauuuuuagaucccauguauuccuugcguguuuguuuuaguggaacacauucuauaacauccucugaggauguuuucaugggaauuaaguuucuuuuaaauacaagccaguauuucuauuuaauaagguuucccauuuagugaugagcaacuacacgauucugaagucaaguuugaaauacaucuucccauuuugaaaaugaauuuuuuuucugcucuuccucuuacaaguuagccuggauaguuaaugaaaggggagagaaccccacuuuuuuuuuuuuuuuuuugagagggacucucacucagucgcccaggcuggagugcaguggcgcgaucuuggcucacugcaggcuccgccucccggguucacgccauucuccugccucagcuucccgaguagcugggauuacaggugcccgccacuacaccuggcuauuuuuuuuguuuuuguauuuuuaguagagacagggauucacuguguuagccgggauggucucgaccuccugaccucgugaucugcccgucucggccucccaaagugcugggauuacaggugugagccaccacacccagccccccacuuucaauggauaguucucuugaauaaaauucaagaucagaaaucauuuucauugagaauuuauacugucccaucaguagguuccaguguugaugaaaaguugcuacucugauuccuaauccuuuaccugugaccuaguuuucuucucuugugaaagguuuuaguuuuucaucucugaugugaaauuucacgaagguguguguugaugguuuucaucacgccugguguugcuuuuucauuagcccuuccaguggggggcacaucuuuacccguccuuggaauuugauuuuucucuucuguucuuuucuugggcauacuagacugauaacucguauucuuuuuauucuauuuccauuguuucccuccuuccaaaaaaagugcuauauuuuguaacccuuuuuaugaaauuuacuucaacuuuuguuuucaauuucugaauacucuauuuuuauacugcagugucuucucaucucucuaaagacaugaauuauaguuuaaaguuacuuucugcuugucuuccugcauuuguuuccucacagucaccuuuucuucuuuccuuuggucucugugaugauggaaacuuucuucaaaugucaggcaguccuucacugucuauuuaaaaaaagaaaaaaaaaagccauuuggaagcucucuagaaggcauuccagcaacuggcaggcucagauggccaacugacuuuuugcuagggauucccaaaugucaguuuguagagaucuuuuucuggguugguucaguuucuccagaaagggauccuguguucucugcuggaaaaguggggaacaguggagggaagggguuuguaaaugucccugacaguauuuuggagcaggauggguuagaggaucucacuguuuagugggcugccccagucuccaugcucaggccugugccugacgccuguacuccucugugcuuguuguucuccagcuguuucugauguggauugucuugagacccagcaccucuuucucugcaccaagucacagauacauaaccuaggaaccccaucuucucuuggaguuuucucaaagaaucuccauuucagucccugccuuacuccacuuucuagggacuguaucuacuucuagguuuguuugucuuucuuuccaggcacauagcauuuaaguuacuuggcacuuaaacacuggucuuuuaucauuucucuguccacuuucagcuauauguugugauuugggguaacauaugucuccuaguuucauuuaaaaaaauccugguuuucucccuguaaguuugguuuuguuuuuuuuuuuuuaagagaaggggguagaagaucuuuauuuuaccaacuuaaaaccauaauucuuaguuguuguuuuuuuuuuuugagacagggucucacucugccucucaggcuggacgacuuacuguagccccgaccuccugggcucaggcgauccucccaaguauaauagcugagaccacaagcuccuaucaccaugcuuggcuaaugucuguacuuuuuguagagaugggguuucaccauguugcccaggcuggucucaaacuucugagcucaagcuauccaccugccucugccucccagagugcuuggauuacaggcaugagccaccguaccuggcuccugucuuagauauuucuaaaugaucuugaguucauuaggauguuaguuuaagcuaaucacaaaagauucuuuucuccuacauuaauauuagcuucagaauuaauagguuagucauuuauuaaaguggauguuuauauucuuauuuucaaaucuaauucauuaucaucuuaaucugagucucugaggaaugauaacuuaauccacuuauaguagcauauuacauaaagucuuugguuccuaaaaguuaaauuagaauuuuucccccaagaaaaugggaagauggccaggcauuguggcucacgccuguaaucccagcacuuugggaggcuaaggugggugguucacaaggucaggaguucaagaccagccuggccaauauggugaaaccccaucucuacuaaaaauacaaaaauuagcugggcaugguggugggcaccuguagucccagcuacucgggaggcugaggcaggagaaucguuugaacccaggaggcggagguuucagugagccgaaaucaugccacugcacuccagccugggcaacagaccagacugugucucaaaaaaaaaaagaacaugggggccgggcgcagugacucacaccuguaaucccagcacuuugggaggcugaggugggcggaucacaaugucaagagaucgagaccauccuggcugacaaagugaaacccugucucuacuaaaaauacaaaaaaauuagccgggugugguggcgggcgccuguagucccagcuacucgggaggcugaggcaggagaauggcgugaacccgggaggcggagcuugcagagagccgagaucacccacugaacuccagccugggcgacagagugagacuccaucucaaaaaaaaagaaaaugggaagauguauuucaaacuugacuucagaaucguguaguugcucaucacuaaaugggaagccuuauuaaauagaaauacuggcuuguauuuaaaauguuuauuaguauauauauuugggcaaauuuuacagucauagaauagacacagaagaauauuaaguuaaucagacaugauuuagugagaucaaaaauacaaauaaucugaaaauuuagugaaaaguucuaaauauacuauccauaccaagcacaucaauauauuuuagaaaauaacuguauugaccaagcuggcugaaaauaagaauuuuguuuuucuagagagcacuaauugcuacuuaaugucaaacuaaugacaucucacccaccccuccuaaaauccuacuaaaauaaaauuauagauacugaaaaaggaaagaaucuguaauagcaaagaaaaagggccagaguuuugcuaagaaauguucuguaguugggugagcucaggaguucaagugaugguccugccacagcauccucaguagcuagagcuauaggcguaaccagucugggcaacauaaugagacccccaucucuuaaauuaaaaaaaaaaaaaaaaaaagaggccaggcgcaguggcucaugccuguaauccuagcacuucaggaggcugaggcaggcagaugacgaggucaggaguucgagaccagucuggccaacauagugaagcccugucucuacuaaaaauaaaaaaaauuagcugggugugguggugugcgccuguaaucucagcuacuugggaggcugaggcaggagaauugugugaacccgggaggcagaggaugcagugagccgagauugcaccauugcacuccagcccaggugauagugagagacuccgucuguucuguagauuucugaagacaggugaaacugaaagagaaagcuuagauuauaccacuaaggggccucagaagagaugggagcaagucuagcaaaauccaauaggggggcuuugggccuagaauuagugugaaaucggacuagaaaugaugauuaauugagggccuauauagagaaaagaucucacucccauauccacuccugugcauagaggacaaaagcaguaaacauuuacacaggggccggggguggggguuuucuuaagaaaauugaaaaaacuguauggugaggacuagggcuuggagugcuuacaucaauccccaaagaaaagcauuuagagaaccaugagccuaacaauuagcucccuauacucuuaccuuuaaaugaaguuucauaauauacccacucccacaagaaggucccacuaagaauccccacuaggagaagagaacuggcaguaaaacaggccugcuuucacaaaagcaaaggaaacgcaacacuagcaaccucccaaaauauaaauggauauccaaggaccaccagacgaaugaggugaaccagaagcaugaaagaaaaaaggccaagauaaauagaaaaacuaaccccagugcgacccaacauagugggauuugagauguuacagacaugaaauaugaacagaaugcuaaaagaacauaaaagaauaagagcuccuuaaagauuauaaauaaauggugauguuaaaguaauagcaccauuggacgaagcuagggaaucaacacuugacagaaagauacauauuuuuuuuauacaaacuacauauauuugagcaaucaaguaguagacauagagaauuuucuuuuuauggaaguacucuaauaaguaaagggcugauagaauuauaucagcauuuucuagcuccuggugaauuaugcauugggcauccauggcugccuuagaucacaaaaauaccaccagauauaugccuguggaugaaagaucacaccaccaccugugaaauagucuuccccacaaaaaauccaacccaaauccuauccagccuguagaugguacucgagaucuucuauaagaaauaaagagagcaggcuggucacgguggauugugccuguaaucccagcacuuugggaggccaaggcagguggaucgccugagguaagaaguucgagaccagccuggccaacauggugaaaccccccucucuacuaaaaauacaaaaaugagccgggcgugguggcaggcaccuguagucccagcuacuugggaggcugaggcaggagaaucgcuugaaccugggagguggauguugcagcucgccgggauuuugccaacgcacuccagccugggcaacagagugagacuccaucucaaaaaaaaaaaaaaagaagaagaaagaaggaaauacagagggcagaggaaccuguuaaacugcaacgcagaugaaaucagcaaaaucaagacuagggcacuccacagcgugaacagcuugguuucuucaacagauaaauuugaagggggaaaagaugcaggagauuuuaauaaguugagacuucagaagacaaugaccaauugcaaugugugggccucucauuuguguccuaauuuaaucaaacuuagaauguaugccacugagacaacuggaaauuugaauacuagaagauuuggguuuuucuuaaacaagaauccuuaugcucagagauacauguugaaacauccugaauuaaaugcugaaauaaauauuaaaacuguccaucuggaauuuccuuuuaagauaauacaggagaggaauagggguaaguggauggaacuggauuggccauguguugauugauggggcugggugauaacuauaugagagguccauauuaccuaauuuaauguguaucuuaaauucuuuguaauaacaaaugcugaaauuaaaaaugcuacauaaggaagcaaccaagauguuccucaguaggugaauggauaaacugugguauguccaguggaauauuauucagugccaaaagaaaugaacuaucaagcaugaaaaacaugggauuuuaauguguauuugcaagugaaagaaggcagccugaaaaagacuacauacuguguaauucaaacuaugugacagucuggaaaaggcaaaacuauggagacugucaaaagauaagggguuagagggaaggagggaugaauaggcggaccauagauuuuuaagaccgugaaacuauucaguaugauaccacaaugguagauacgugucauugcauauuuguccagacccacagaacacaugaaaccaagugaacccugauguaaacuguggguuuugggugacaguuuugugucaagguagguucaucaaugauaaacguaccuaccacuaugguguagaauuuugagagugggagcauaugguuggggaaucucuguacuuuuuauugcuguaaaccuaaaacugcucuaaaaaguaauuuaaaauaaauuugugauuagagaaauuguguuuuuaaaguaauauaagaacaguauuaguugucaucacauuauaugcuacaccaucccaaaccucacugccacauuacaggaagcauuuauguuugcauucauggaucuuugagucagcuggguuuuggcugauagaggcugccacaggcagccauagcaagucuugaggccaacgccagauucaaggaauagaguucauccuacaaagaaaccauggcaagggugcagauacauaauucugcuaaaguagagugaagaaucugucuugggcuaaaaauggaaaauucaggaaaugaacguuuacagccuuagaagcaccucuaaguuacgcaaauuacucagaagcagaugaauucuuuuaaaaaguuaaauuuuacuuagacugauauagaacgcuauuggaaaccaacuaauaagcauggaaaauugcauccccggaaggcagauuggguuaaaauagauguuaaucuggauuguugaaguauggaggugugcaaauacuuuccaaaguauacugaaaacaaaguguuauaggguuuuggguugguuuuguagcauuuuagacaaguugugauacgaaaaaagguauucguuaauugcugccuuuuaaaauaaauauacacuuuuuuuuaagcucacugaaaacugaagcuaauuuggaaguuuugaagucaauuccuagugaaaaauuaaugauugagacagguaaguuuguuuucagaacuuuguuucauauuaaaccauaccaaacaaaaaggaaagcuggagaaagaaauuugacuucaaacuuuaagugaacaaguauuuuaaaacagcaugcucaaccucaacaauuauguuuuccagaagaucuuuggggguuauuaauggaaaaacauaugcaaaugauuuuuuucaauuuagaaguuugcuaugucuaagcacuuagaaaaugagaugccagaauauaacucaggagguuguaguuacgaguacuuagcuaaacaaggggucuugacuaagcacaucacacuuccaaguuucaaaaucuguucagaauuuuguuuacacagugucuuuauaauggcuuaauucuacagcacuuuguacagugcaacaauuuauauugguuuaguauaagaauuuuagaauccguugccucuuaaaacaaggugaggccgggcgcgguggcucacgccuguauucccagcacuuugggaggccgaggugggcggaucaccugaggucagaaguucaagaccaaccugaccaacauggagaaaccacaucucuacuaaaaauacaaaguuaucugggcaugguggcacaugccuguaauccuagcuacuuaggaggcuguggcaggagaauugcuugaacccaggaggcagagguugcugugagccaagaucacgccauugcacuccagccugggcaacaagggcgaaacucagucucaaaaaaaaaaaaaaaauacaaaaaauuagcuggguguggugguggcacuugccuguagucccagcuacucaggagccugaggcacgagaauuguuugaacccgggaggcagagguugcagugagccgagauugugcuacuguacuccagccuuggagacagagugagacuccgucucaaaaaaauaauaaggugaaaagcuaaaacuuuuaucuaaacccugucaaggcucuccuuauaccauggacuuuaggaaagucaagacugagccauucuggagaaaucacauucauuuccuugggcagucaggaaaacaaaauauuugauuaaaaguacgauguuugcaaaauguguaauucuuuauuaaaaaauauucaaaaccaguuucacauucaguagagauagaaauuuguuuaacuuaugcaaaccucacuacaugcauagcgaaaaagauuuugaaaacugaaaaaaaaacuguuuaacuuaaauguuuucauguuguuauacaauuguauuuaagguuuaggucuuuuuuuuaaagcaugcugcacaccaacaauguuagcagaaaaaaggaauagaagugagucuuagaagguauuuaagaugcaauucaagauuuuaucuugugcuuuucuuagaacuguuuucuguugaaauaacugugccauuuuggaagcugaaucacgguuuaucauuuagagguuauauauuagauaauggucauaaaaaauuuuuaaaaauguaaaccccuuacgagacacuuucuuugcuuaacuagaugcaccuugguguggagucaaaaguacacaugcuggaucaaaauauauaagaacugcauuuccuaccaaaaagaagugggaaagugggcacugcuuaaaagacagaaaugaacccugccauauaaugugaguauuuugcuuucauggucuucaaaaucauuaguuaaccaccagaugccacuuauaaaauuaacgcaagggacagaauuaaaauuuugcaaaauccaagugaaguucagguucaagaccaccauauuaaugcagugauuuggaggaauuugcauaccugguuuaaguuccauucucacugcagcuuccugcuacucuuugguaacaagaaagccuuagcagaauauuuuggauuuaaaugauuugacagccucuauaaaucuaagaaauaacacauuucuuuaagccucagaacaaaaggauaagugaucuuaaggacaaaccccuuuuuuccuacccccuuuuuccaaucaaagggggugggacuuuagcacguuuuauuuccuaaaaaagcagcagaucagaaucaucuuuuaaauggugauauauauauagcacaagugaaaagaggggcuauuacccaucugucaaagagcuguaaagguaacaaacaggagaaggugguuauaucauuuuaauggguacauaauccaauuucuuuuguuugcacaaacagauaauuuaaauuaaucuagauuauaucagucuuauaugauuuaccaauucagacaauugggcauacuuauaacacauucacaaaaacuaauugguacugugucuucaugagggguaaaaaagaaaacaaaauagguuguugcuuuuaagacuauucauugcauaugcaccaucuuuuuuuucaguaguuuuuaacaggaaaagaguauuagaagauaagccagauaagaacagugaagaauuauucuauaaaaauauguuugaaagguucuuuuccuuuauuaacaugcuugagcugacaaagucuuuaaaacugaagcagccaggcaugguggccugcgccuguauuccagcuacuugggaagacugcuugagcucaggaguucaagaucagcucaggcaacauagggagaccccugucucuaaagaaauaaagaaaauuuuaaaaaauaaagaaauguaaguacuugcaaauucagugaugagacaguauuucuaaaucuuuuuuuuuuuuuuuuuuuuugagaccaucuugcucuguugcccaggcuggagugcaguggagugaucuuggcucacugcaaucuccgccuccuggguucaagcaauucuccugccucagccucccaaguagcuggaacuauaggcacaugccaccacacucaguuaauuuuuguauuuuuaguagagaugggguuuugccauguuggccaggcuggucucaaacuccugaccucagccucccaaagugcuaggauuacaggcgugagcuaccacacccagccaauuuuuuggggaacuaaaaggacacuagagaaaagaaacugguauuuugacagcagccagcuuacaggaaguaguugccaacaguguauccaaguaaguuuuuuauauuuccuuaaucuuauguaagauuauagcuguugacuuuagcuauauauuugcaagacaaaauuucaagguguuuuuaaauguagacuguuuaagaacuauaaaggcuggccaggcaugguggcucacaucuguaaucccagcacuuugggaggccaaggcaggcggaucaccugaggucaggugcucgagaccagccuggccaacauggugaaauccugucucuacuaaaaauacaaaaauuagccaggcgucauggcggaugcccguaaugccagcuacucaggaggcugaggcaggagaaucgcuugaaccugggaggcggagguugcagugagcagagaccacaccauugcacucuagccuggaagacaaaagugaaaauacaucucaaaaaaaaaaaaaaaagaacugugaaggcuucaucaauacuuguucuucaguuaguugcagagcuuaggaaaaucuagcaucugcaagcugaaaagauuuaaaccacauuuaaaaaauacacaauccucuaaucuacugcuaauuaugaguuggcaaguuaauugcuacuugcaaagucauuuucucaaccuccauucuguuaacaguuuuacauucuaauuauuuuuauagaggucuuuuagauauacauuguuugcaacagauguuuuggagccccugccaugucaggaaagguacaaguuacuaaggcuacacaggaagaaccaagacagucccugucuuuauccauccaccagaugaauagguacacugugccuggcacuuuagauaaggcauucagugagucaggcgaggaccccugcccuccuggagcacauaagcagacagaguccaagauaguagugcuguuauacaaguaggaaucuaugaccaggaccauagggcacaucaacugucugcuuugaggggaaacaggagagaguuauaccaaggugacauuucaguuguuuacccaugacugggaguuaggccagagaaagacaaacaaacaccuuaagcaaaggcagacugcagaagggccuggcuaauccagaggaacaaguguggcagaaaguaggaugcacaguguaagcagaagucaagucugggaagguagagugagcccagauugugagggcucuuauaugccagcauuuugcuuagauuuuaucacuacccaaaggauuuuaagcaggagaguggcaauuauuuuuuuuaaagcuauaacuuguaucaguauggggaagggcuggaaaggagauaggguaggaaucauguagaucuugcaagacuuuaaaaaccuuugccuggcugggcacaguggcucacaccuguaauccuaccauuuugggaggccgaggcaggcagaucaguugaggucaggaguucaaaaccagccuggccaacguggagaaacccugucucuacuaaaaauacaaaaaaauagccgggcaugguggugggcgccuguaaucccagcuacuugggaggcugaggcaggagaaucacuugaaucugagaggcagagguuguagugagccaagaucacaccacugugugaucacacacagugagccaagaucacaccacugcacuccagcuugggccacaguguaagacucucucaaaaaaaaaaaacaaaaaccugugcuuacuguaaaagugccacauuaaacaaaagccacuaaauucucagggacauuaaacaacuuuauauucauuuuggaauaacugcagcuuugaccacugaagauguauggaaauagcauggcuuggcuacagaaggguuauucgaagaaagauuuccauaaacugcauuaucaaacaguaaaauaggauguccuaagcuccaauagauuuuuuuuucuuuuuucuuuuuuuuggagagagagucucgcucuguugcccaggcuggagcgcaguggcacaaucucagcucacugcaaccuccaccucccagguucaagcaauucuccugccucagccucccgaguagcugggacuacaggcguccaccaccaugccuggcuaauuuuuuuuguuuuacuagaaauaggguuucaccauauugcccacacuggucucgaacucuugaguucaaucugccugccucagccucccaaagugcugugauuacaggcaugagccacugggcccagcccaauagauuucuuauaagcgauuucaauaaaaugaauuugcuaugcaauauaaucuuagcaaagcugcugugaccuucaaaacugugucaucagcagcauuaaucaagaguuccaauucugagaagugcauacagagggacauucaguaguuuccuaagaaaaauggauuuucacugucuuaauuuaaauguuaauagauuugcuuuuaguguaucuugacugucagauaaaauuuuaguguaguguuugcuuaguauaaacaucaagcaaggcuuuugugucacauuacaaaacaauuuuuuaaauucccauuaaucuuagaucuccauccuuaauuccuuuagguguuaacauuuaagauacuaagggaacaaaaagcuuaggcaaagaauauuuaaauguucaauuuggacuuuggaacuuucuaauucauguauuaaaaaucuuccacuuauauauaauaaguauggagacacuacggaucaucauuacuguaagcacagaaacugaaagaugcggccaggcgcgguggcucacaccuguaaucccagcacuuugggaggcccaggugggguggaucacaaggucaggaguucaagaccacggccagccaacauagugaaaccccgucucuacuaaaaauacaaaaauuagcugggugugauggcaggugccuguaaucccagcuacucaggaggcugaggcaggagaaucacuugaacccaggcggcagagguugcagugagccgagaucgugccacugcacuccagccugagcaacagaguaagacgccgucucaaaaaagaaagaaaaaagaaaaaaaaaagaaaggaaagaaaaagaaaggaaaggaagggagggaagggaaggaagagagagacagagaaagaaagaaacugaaggauggacaccugggcuuauuucucucgcaaggguagagguacagaaagcccucgcccucaauaaccacacauuuuuccaaguaaauauuacuuuugcagcaaccuaauaccuucauuugcugucucucaaggacuaguucucuagcaguagauuuccaacuguggcugcugucccacaguacaaauuacguugugacuuaggacacacauacauaauaaaaccuaacaaaaaauggaacaguacuuacccuuauugaguacaauguacuugucaauguuuaaaaugcucaucaugacccacuaaugaacaugcuaugacucacaauugaaaaggacucuucauuuccacucaguuaaugcuauaauuggugaacauaauacagauggcugcuuuaauaauuuacuugaaccugguucuuagcucuaguuauaugcaagacaguccauaaaucuguuuccaguuacuggcaguaaguuuuucuauugauauugcugaaaaacuuaauaacuguuaagcuuuauuauauuaaaggugugccaauauuuuccuuuguguggaaaaauauuauauagcuuuagaacuaaauguauacuuggagauuuaaccauuuuuguuuuuguuuuguuuuagucaaauauuggagauaaugucagcagugagagaugaggauccacuggaauuagccaauacacuauauaacaauacuauuaaaguauuuuuuccuggaauauaauugguauaugucuuccacuuuccaucauguauguaaaauuucauaguaaaacuuccugauaguuucaauaaagaaauuaucugcaaguugucuaaagaaauacuauauaucgguacacaccauuccccaccauuccccuucuuuuucucguaaaaucagaucaggauguuuuuauaucauugaguaucuuaguuuaaaacaauuuaaaaaaaacuauuuuuguuuuguaauaucuucaaaagaaugaaaggacaauuuuaugacaauacugcagacacagaauggcuaacaaauauacaauuuuacauaaaaaacauuuagcacauucugguuuauaucaaaguuuaguugauacaguuuauuugucaacccucagucucucucugaaucaggacuuucaaacucagcucaauuacacugcuacucaaguuucaaaaaagguccucaguugcuucuggcagcuaauuuuuucuuuaguuuuaaaauacucucucauguccuuuauccucuggucaaauuauuuuauuuccuugacuuuaaugugguuuccugauuugcauuuucauucucccacccauuucuaaagaaaaacugagguccaaaguuacauuauauaauuucauugaagaauauuuggcacaggugacgcaccauaugaucauuacaucuauuaaaaagcuauuuguucaaauuuugucauaaaaaugugaaaacauuuuauucuauguacaauaauguacacaaauuuaaacaggucaccaaagagaccagaaguaauuaaagagguauauuuacaguagcacaucacaguaaacggaaaaccauucacagauucaacauugauacuguuuuugugcuugguuacacacugaaggugaaggauauuacuccauuuuggaugaacugaauuuuaaacaaauaccucaaucauuaauaaaugcuauuuucaucagucaguaucaucauuaaauucuucagcugcugcgccugugugcugaaucacuccauuucuuucucuuugaacaucaucaucacaaucuguacugucaucuucguucaauucccugucagauucagcagcagcuucucuuacagcuuccucuggaguuucauuggguggaauaaauccauuguuguuagauacauuugaauuauccuugauaucaucuucgauguauacuuucugauggcacauuggacaaguaucuugaauguacagccauuuccgaaggcaaagugcauggaaauaaugauuacacgguguaauacgagcagauguuguaaacucaugauagcagauugcacauacaucauuuauuucuuguaagcggcucccuuuuauuucaggaagugaauuaauuuucuucacagcaguccuacgauucauaaaugucuuccagccauuuuuggcuuguaaguagauguuaaaauaugcauguaggcacaucauaaaagcccgaauuuuacuucccgacucaaacaucauaguguaagccccauuuccaaacauuacaacuccaaauauaaauucaauaauacugccuguugaacgaacguaguagacauaaucgucaagcuuuucccagaggacauuauaguagccaucaaucaugaauaacguauaaacagugagagaaacaauuacuuuuaagcacaguuccacacaaaaugcuguaacugcaaacaaccauguauuuagugcauagugaugccaaagaacauaacugaguaagacaggaagaauaaacaggcaagcagagacaaacagcacaggaaaaugucuacgaaaagaugacacaugagaggcacugagagacauuaauacagggucugucauuccauggauaaaaugcaggacugcaguuaauaaaaggcacauguuucuacuuaagcgaauaagucucucuucuggucuuagcccacuuaacccagucugaagagccaaaauaaaaaauaaaacaggugcaacaaagccaagacgccugucaucuuccucaguugauccaauaaaggccaauauuccaagccccaaauaaugggcuacugaggaaauuacagcacucaugcccaguacaguuaguguagaaucgcacccacuaauuauaagauugcaaaugaggucccaaaaaucaucccaagaaauaaagaaggaaucaguuucauuugccauccuuaagauguacauuaacacuguagccugagcuguaacucuuguuagccaaaagacucguaguaugucugggaaacgaauccucuuccauguguccuccaucaauaacuguaauccguaaauucgauacaugugccucaccaaaagauaaacauaucguguggaauaauaaaaccacuucaguuucacugccaggacaaacacuguauuuaaugugagaaucaaggaagaaguaaacaguaaagucucucugauguguaaugguagcucugugauuaagccuauuacaggaaccaagagauccaaaauaauuaauugugaauagauggaaugaaucuggaguaguguaacguauccaauuccaaauguuagcuguagaacgauaagugccauccacagcgagggaccuuuucgaggaagcagcucaauuccaaaagcugacguguuguaggcaccauagaagucaaugugcaaagaagcauaauaauucaccaacacugaaguugcagcuaacagaaaggcugagcuguacguguaaaacuugaaaagugaucguugugacaagaucagaacaauacuggaugcaaauacaccuaaaagaaagaaagaaaaagucauuugaaugaaguauuuguaagaauguuuccccacuaagaguuaugauauucuuccuuuaauuaggaaauaugaauauuuucaguuaugaacauuaagccucaagacaacuaaggcuuaaaggguaauaaagguuuuguaaagucagaguucaggagaacagaccaaacauacuaaauuauucuuuaaaauuucauuccuuacuuucuaauuuccaaaguauuucaaguaacacuguagcuguccaaggcaccaaauuacuaaauuauuuucaagaugaauuuguagugguacauacauuuuaacaaguuuuaaaacucaaaagaauaugucuuuuaucauuucauaaucauuaaaauuaauuuuaaaaauuggguuaaaaauaacccaaauggaaaacauuuauuccuauuaaguuuuagauucauuuauuauugacugacugagacaagagucucacucuguugcccaggauggagugcacuggugcaaucucagcucacugcaaauucugccucccaggcucaagcaauucuccugccccagccucccaaguaacugggauuacaggcaccugccaccaugcccagcuaauuuuuguauuuuuaguagagacgggguuucaccauguuggccagacuggucucuaacuccugacgucaagugauccgcccgccuugccucccaaagugcugggauuacaggcgugagccaccgcacccagccaaguuuuagauuuuuuuuuaaaggauucuuuaggaaaucaaguucaaguuuuauacuuccacuuaauuccuccuuuucuucaaacugugaacucaugccagcucuuauuuccuacuccuuaacucugagcauucuccaaaggguccaaaauuccauuuuuuuuccuccuaguuuccuucggacuuagaaacaucuuccaaguucccuuuuuccuguauaaugcugaaucuguuucuuaaaauagucaacucuuuuuauuguucuucacauuacaaaaguaacacucagaaaaccaagacauguuuuuagaaaaugguaauucuccuucccccacuccauagacaccaucuuucuuuguacucugacagaaaugcauauuuuaaguaggauuacaauaaacacauuauuauccaagguuucaacaaugggaaugacaucugaauacucaccuacuuucacuccuacaacugcaaaucuccaaaguucugaaacucgacuugccuuaaacuagaaucagcuuuuccuugugauuugcuauuucaguugaagguaccauuauuguucuuuuagagauacucccaacccagccccacaugcucaaacuuugccaauuaguugccaaauucuucuaacaccucuaucucccuuuucugugacaccaaucaaucagucugucucaaaaaacccucaucuuguccaaauccauuuacaagccaucaccaaauugccuuucuucauucccugcucaaaauacuucagcggcucugaaauuacuaucaacuaaaaucuacauucuugcuccuggcauucaagaacccaauuugcuuuacaguaauauuccuccuaacacacacacaucagugcuccagacuuggauuccccaaacacauuccuuucuccacuauagcuacagcaguguuuacauucuuuuugcuuggaaugauguccccaaccucccaaucccugacuauucaaauccuaccuauccuagaaaccuacuuucuuugauagaaacuguucuuucagcauaccugcagaacuuagugaaacauuuaacacucauauaucaccugauauuguagucugcaguuaucuaaguauaaucuacccuauuacacauguaucuauaacagaaagcaaagauccuacccuguccaucuauggauucuacaauauuuuguacaaaauaaguacaauuaguauucauuaggaaaugucugucacaucuggauguuuuuaaaggcaaccacaaaauauagccugcuugaaaaauaaaaucuauguuucagacaaugagaaaccauacccuggaguacagaaaaagugacaaacuccaaauuaaaaauccaucuuggcugggugugguggcucacaaugguaaucccagcacuuugggaggcugaggcggguggaucacuugaggccaggaguucaagaccaugucaacauggugaaacccugucucuaccaaaaauauaaaaauaugccagggugguagcacgugccuguacucccagcuacucaggggguugaggugggagaaucgcuugaacccgggaggcauugcaguuagcugagaucgcaccacugcaugccagccugggugacagugagacccugucucaaaauacauaaauaaauaaauauuaaauaaaauaaaaauccaucuauccaccuuauuucagcagguaaucaagacauugcauauuauuacaguagacgcauuucacaauccacugcacauauaagcaagggcuaguucauuuaagugaugacucuguccagggauuuaaaauguauucugugccaaaaugucaagucaucugugaaaaggaaaacaaaaggacacaauaaaguagaagacauauaaaccucuaaauacaaaccaccugauuccccaagaaaaugggccacuaauaaucccccaaagaguugugagcucagaacaggcucuuuuaaauauauauauuuuuaauauauauauuuuuaaauauauauauauuuaaauaauauauauauauuuuuaauagauauauuuuuaaauauauauauauuuaaauauauauauauauuuuuaauauauauauuuuuaaauauauauauauuuaaauaauauauauauauuauauauauauauauuuuuuuuuauauuuuuuuuaauggaguuucgcuccuguugcccaggcuggagugcaauggcgugaucuuggcucacugcaaccucugccucccagguucaagcgauucuucugcuucagccucccaagaagcugggauuacagguauguaccaccacucccagcuaauuuugcauuuucaguagagacaggguuuuuccacguuggucaggcuggucucaaacuccugaccucaggugauccacccgcuucggccucccaaacuacugcgauuauaggcgugagccacugcgcucggcccugaaaagauuuuuuuauuagaaacuucuuccauggaagguaacaagaaaauggaauuaauucagccuaccagaugccauauguaaucuuacauucucuacauggaaaaccaccuuauuuuccugagacaaaacuucagaaacuuuaaaacaaaucuucuaaguugggucaaaaccaaaacaaaauaacucuaguucuacuuuaugccacuuagaggggagaaagucaagcaggaacuguaaauuauuuuugucaacuugcuauucacaaaguaguaaauuaaucuucaguaacuauucaugagcuuugccauaauuuuauaacuaauuuuuaaaauucuaauaacuuuuuuccugaagcuuguuuuuacuacacacaaaugaagaaauuauuuggguuuuagaaacauuucuagugaaaaagugccauuuugcuuuaugcaaauguaucaaagaaaaaaaggggaaggcaucagauagacaaauaauguaguaagacuacaaccucaaaauuuggauguaucccagcaaguaacaaucugacaauacucuauccugauuaaaaucacaccccccaagauguaauagugaguuaacauuucaagaauaguauauguuuguuuuaauuccuacccaaaguuuguagguauaugggguucauagauuuuccuuuuauagucacguuccuaccuauggaauuugggaagaaucugcucucauuuuaaaaaccaauauccuaaguaacaagucuccaaaguaaucaucuuucucauggccuuugcagaauaauaucaaaguuucacugcauuuuuacauuagacaugaaagccuuucuugguauuuaaacuguaggucuaagaaaauauaaaaguccagagacaguuucucauuaggauuuggaagugacuugcacaaguaaucaagacuguauauaaaugcugcuuuauaaaaaauuuugagaacagaauuuacugaaaucacaacucagagaucucaguccaauucuccagugauuaagagaguucacuagaguuuucaagguagccaaaaagaggcagguauccaaaucaauucaggaacuuugaaacuauauaugaacucaacucaugaaagaguucaggccuuuucaauuuggauuaccaaaaacaggcaaauaaaaacaaaagaaaaaauaaaaacuuacuauacauguuacauaacaaaguguuucacucuuuuauguguaaagucuauucauacccuuacccucuuuuggaaacuuaugacuaaaaaucaggguacaaaacauaauauuuacaauucuccaaguacccgaaauaccucuaaaacaaaaagcaaccuguggaaaaacauuucaauaccugacagaauaaauauggaaaagcacagaaauaaauguuacuacuaccuuacucccaagggagccuuccgcaaugaaguuuacaacaaagugucuugaaauguuguuaaucuguugguauacuugauaaauuauaaagaaaacauuucuauuggauucucauuuuagguugaaaaaaaaccugguauucuaaguauuaacacaaaauuaaacuuuugcuuuuaaacuaaacuuauaauaaguaugcuuuuaucaaaaauauaugaacauggauuuuaaaaagccaaacccuacagagagguguuaaaugaagaguuaaagcaaguuuuucuaguuugucuuucccaucugugauaucauaaaaaaaauauuaauauuuggucuuugucccauuuucugacauagcuucuaaaauccuuggaaucucuggagugaugacuguuuuguacaauaaucagaugacuggugccugggggccccuagauagcuucaggaugggggcuagguagccaggggaaucagcccagugauuaaggguuauaacuuugauuccuacccccagccgccacuucugggaagaaagaagcugaaacuugaguccauaaaccaaugacuagugaucuaaucaaucuugccuauuuaaugaacuuccauagaagcccaaaaggacugaguucugugagcucucagauagcugaacacugaagcuccacgccccuucuccucuucucuccuucuuugucucaccuuguacaucuccuuccaucggguuaauucaucuguguccuuuguaauugccuuuauaauaaauggguaaauguaaguacaguaguucccccuuacccaagauuugacuuccuuuuuuuuuuuuuuuuuuuuuuagugauggagucucgcucuguugcccaggcuggagugcaguggugcgaucuuuugauuaacauagguuuuuaaccucaauaucauucgguuuaucaaucuucauuauguauuugcuuuuauauauuuuuaaggauuucuuccuuaaucuaagauuggaaaaauaaaauauuccauauuuuuuucuaaaaauuuaaaguucugcauuucauauuuacauauacaucuagguaagaauacacuuagaaaugacuauuuuuuuuuuuuaagagacagggucuugcucugucacccagccaggcuggagugcaguuaugcaaucauagcucacuugcagccuugaacuccuaggcccaagcgaucuucucaccccagccuccugaguaagauaggacuacaggcacccaccaccaaguauggcuauuauuuuaaauauuuauuuuugcagagacagggucucacuacacugcucaaccuagaagugacugucuauauauugacauaagguagacaucuaguauaauuuauuuccaaagguguaacaaaaugaucauuaauucaacaguccauauuuaccucaauguacuucaauucuaucucugaaacacauuauuucuauauauacauuggugucuguuucugggcuauguaauuauaaauaaggcuaaguacuaaucuauuugucuaucccaaugguucucaaccaugauuuggcaauauccagggacaguuuuggcugucacacuggggugugggggugcaaggugcuacuggcaucuaaugggcaggggauagugaugcugcuaaaaaucuuacagugcacaggagagcucccauccgcaaacaaagaauuauccuguccaaaaugucaauacugccacuguugagaaaucucugucuauuccucugccagugauaauuacuucggcuuuguuuuuucacuucagagguuuucugaagucuuuuucggcaccaaaaauagcuaucucauuucuuucaagaacuuuauugcauggcuagaccuaauacaaugaacagauuuguaucaauacauauuuagauuaaguuuguugcuuuguuauuuccaguaaugcuugcccauaguccuuaagcaaacuaucucucuaggccaauucccuagaauugaaauugugagucaaaaguuguacgagccaggcaucccagcuacuugggaggcugaggcaggagaaucgcuugaaccugggagguggagguugcagugugcugagaucacgccacugcacuccagccuuggugacagagugagacugucucaaaaacaaaacaaaacacugagaagucaguuguaaaugacaguugauacugccaaaugguuuuacacugaaauuaagagucuuccgggccaggcacgguggcucacgccuguaaucccagcacucugggaggacgaugugggcagaucaccugaggucgggaguuggagaacagccugaccaacauggagaaaaccugucucuacuaaaaauagaaaaaaauuugccgggggugguggcgcuugccuguaaucauccuagcuacucgggaggcugaggccggagaaucgcccgaaccugggagguggaaguuguggugagccgagaucacgccauugcacuccggccugggcaacaagagcaaacuccgucucaaaaaaaaaaaaaagucuuccaaaauuguauaaauuuaccuauuucaaaaagguaaauaccuuugcaaaacuaauaaaacuuugaacucuucaccaaucugauaaauuuuuuuugacuuuuuuuuuuuuuuugagacagucucgcucuaucgcccaggcuggagugcaguggcgcgaucuuggcucacugcaaccuccaccuccccgauucgagagauucucgugccucagccuccacaguagcugggacuaugggcaggagucacugcacccggcuaauuuuuugguagacacggguugugccauuuggccaagcuggugucaaacuccuggccucaagcaaucugccugccucagccucccaaagugcugggauuauaggcgugagccaccguaagcggucuugacaguauuuaauuauaaacaaggcuagguacuuuuuuuuuucccccauaaaaucaagcuacugcaggaagggcuaaauacuuuuucucuugcuuauugaacaucugcauuuuguuuauugugaauugcuugucuuaggcauuuuccuaagggaguauaaguuuuuucuuguuuuguuuuguuuuuuuuuuuagacagagucucacucuauccccaggcuggagugcaguggagcgaucucggcucacugcaaccugcaacucccugguucaagcgauucuccugccucagcuucccuggcaggguaaaacucuuacuggaacgugaaucacuuaugauagaaguauuuuaucucaguuugucauuuaaggauucuuuuuuaagcuuugccauaaaaaagcuuuuuauuuuuauguacugaaauuuuucagauuuuuccuuggaacuucugggucuucuguuauguuuaaagccuuuucccaccucaaugaauuaucaccauauuaguaauacuauuaaaacaaacuccuaggcuugcauuuucugccuuggauuuaaauuugcuaacucagcauuaugcugcucuggguugaguuucguuuaguauuuaacaucccuuaaaacacagcuuuauguucuucaauauuccauauauugucauagaauuuuauuuggaucuccaaaaugaguugcuuuauuuucuaaccgguugaaaucucaaauuaguuugauaucaaaugaagguacaguuguagcaccauuuuguagguagaggggaguaaauacuucuaccaccacacauaaaacugguaaugcuuuuuacuuagagauuuccauuuuuacacauuaauuuuaaagaaaaaagugagguugacaagugguaagacuuauacacaguaguacugagaagucuacaacuacaaaaaaacuaacaaggcagaacgauuaauuucaacuauccauuggcauauuuacacacaaaccugugucuuuuaguaacauaauuuuuuagcaccgaaaucaguuuuuuucauucuuaucauccuuacaaaugugaaaaauuagcauaauuacaugacacaguaagaagagucggaugauagauuugaagaguauuucguauuucucaaagucugauccagagauuccagggaucaaaauuuucaaauaaacaacaccaauauuuugccgaugauuucaaaagaccaaaauaucuaacaaaauaugguauuaaaugaagcauuaaaauagauuuauugucuuuaacacccuaugaaacagauaaccucacucuccaucuuuuaaaagguaaaaauaagaaaccaaagcacugagcaguugccuuaagucauguuguucuuugucaaacacaaacuuccaagauuuauuacaaaagaaacaugccuaguacaaggaaaauaucagauugcuuuguucaauguucuuacacuacaaauuauuuaauuaaagaaaauacuucuuuuccuugaagcugccuaaccugaagcucaacagacuacugcauuaaagcaccaggucccaaagggauucucacagaaucugcaguuaucaugcuguaagaauauucaaagcagucacuacacuguuucugggaugaacaugcagaauccucucaaacagagcccaguuuuuaacacaaauuaugguggugguauacguuagcaguggcaaguaggaaaggcuggaauuagguagcagguggguuacugaagcagcuugggcugaacaucacguuuacaucuuuaguuuuaagaucuagcauaugaucauuacuacugcauucuguaucuggauugcagcuguuagggaggaaaguaaaccauauuuaaugucaaaagauuuuuaagcucaggcucuggcaaccacuuagcggcagccuaccaagagcaaaacacuuaaccucuaugacccuguuuccugguuuguaaaaugacaauaccaccacccaccucugggggauguuugaagguuagguuagauaauaccuaccagugaaaaugcuuugcaaaaggaaaauaccagauaaauguaaaauauggcuauuuauugcuaagaacaaaauucggccuuuauugccacuccucuuuugaaggaauaaagcaacagauggcuuguaauucagaaaggcuugguaaagaccucaccaucagucugcccucagcaacacuucaaaagcacuagccuacuuaagaccgaucaccagaauuaccucaucaacaaaauuugccaaguuacaauuacuuaaaaaauuauuuuacgcauaaaugcaucucccucugaugauguaagugaagauggaaaggaagaaaugaaauauaagauacuuuuaacacucc

SEQ ID NO: 17780 - RNA, 619 nt, Homo sapiens
uuuuuuuuuccuuuuaauuacauuuauuuuaaugcugaauuuacucccgugccauaaguuuuuguuucuucaguuucuucugggauauccuuuucuucugggcaaccuccucuucugguuuaggaacaaucuguuccuuuuccguaaggaucaucucaauguggcagggagagcucauguauggguuaauccgaccaugagcucuguagguccggcggcgcaucuuaggugcuuuguucacuuggauaugcucaaugaccagagaaucuacaucuaaacccuuaaguucagcauuacucucuguguuuuuaagcaugugcagcaaaaauucagcacucuuuuugggccaccgaccuuguguccagccccacugcuuggccugcgcacaccugccaacuccaccauuguaacgucggaaugguacacacuguuucuguaaagugacaucuuucagauacuucguggcuuuucguauaugcauacccuugauggccugagcaguuucacgaguguucuuaaagugaacacgaagauuggaaccucuugauuugcaugauuccgugggguucuccgggucaagugaauagcgaaccauuuucacagauuaccucaggcugcu

SEQ ID NO: 17781 - RNA, 26426 nt, Homo sapiens
cggucccucgucugggccgagcccgcccagcuggcugagacgcguggagccuggcggcgagugggggcgugcgacgguuacucugguuacuggggccgcgccgcgcuggcgagagccgccgcccgcgagggaugcuggugaggaagccgucgggagccgccgccgccaucugagggagguacccuggaaaccaccuuuuaucgguggggaagugcagucgcggugggcggcucugggggccagcgaaacgggaggccucuaaaucuuuagguuggggcugcauugcccuggagccgcacucuugaguccgaggccaucuuuuguuggagaaggcgucggcguuggcguuuucccgagguugggcuguacagugucuccguccgcggaaaaagaagccucugaacccgcgccggcccgcagcccccgugccuuccggccgcugcucgccgucgccagaggcuaggccacguuucccccagugccgagguguuucugugacccucccuccacucccauucccuucugaaagggcaccugcucuuggugagaaaagaaauuauagcacgaagagccaguaucagaagaguauccaucacccgcagcaaccgcucagggaacaccaucaaaaaagaaaaaaagggaauaucuggauuuccugggcgaggaggagcgagucugcucgggagcuguuccagcaggcgauuuuuaaauacugcuuucuacgcccuauacaacuuggcuucacauacuuuuacacuaacuuuauaugauuuuuaaaaacuggucugaucggacuucucguccugggacacuguuuacuggagucuggccggcucuccgugcuccucuugguaccucauuuuggggagaaccuuaaacccacucgagcagauaaucuccgccuugaccggugccaccaaagaagccuuggaaccauguggacuuuucugggcauugccacuuucaccuauuuuuauaagaaguucggggacuucaucacuuuggccaacagggagguccuguugugcgugcugguguuccucucgcugggccuggugcucuccuaccgcugucgccaccgaaacgggggucuccucgggcgccagcagagcggcucccaguucgcccucuucucggauauucucucaggccugccuuucauuggcuucuucugggccaaaucccccccugaaucagaaaauaaggagcagcucgaggccaggaggguagguugauuucaaagcgggcagaugaaugucuuauuuaggaguaggauuggguucacucaaauauaaguuuuauuugaauugcaaaaggcggcagguuagaugcuuguauacauucucauguauuuuuuauuuuaaacucugcugugccuugguuacaucuuugaccuucuuaagaaugagugaagacauuuguuucauuuagcauugguugagccucagauggagguuggauauuugauuaugaaagauggaacgaaauguuagaauuucauuuugaaggagaagaacaaccacuuuccaugaugaaaaaguuuuuaaaaaguucuuggguaaggauuggauuugugccugaggaagaaagaaacgugcugcggguaaguccacugcuuguaagaagugacagcugacuggggaaagugacagaacaguuugaaaagcaggcagaaggagaaugcucaacauuuugaggcauugggcucaaaguucuccucccccgaauauuggagcauugaguaaaugcuuguaguaauguccuaacauaaaggccaggucuucaaauaaggguguaguugggauuccugcaaagggagcagaggcggccacugggagaagaugagggggaagaguuuaggccagaucauuuagggcauguuggcaaugaguguucgggcuuuuucccaagaguucucccaagaacacuggaggauuuuaaguaugggaguaacuuuauucgguguuuacuuuuuaaaaaauuuuuguuuuuugagacaaagucucgcucugucgcccgggcuggaaugcaguggcgugaucucggcucacugcaaccuccgccucccugguucaagcgauucucgugccucacucagcuucccaaggagcugggauuacaggugcacgccaccacuccuggcuaauuuuuuuuuuuuguauuuuuguggagacaggguuucaccauguuggccaggcuggucucgaacuccugaccuuaagugauccgccugccucagccucccaaagugcugagauuacagacgugagccacggcgccuggccugacuuuuaccuuuuaaaaagaacauugcaguugcuguauggagaauggguuguaggcguacaagaauggaagcagggcuaucaggcaagagacuauagcaguaaacgcccacuugcuuuuuaaauuuuugcgccaccauuucuggaugugagaucuuuggcaaauugcuuaauuucugugagaaucuguuaccucuuccauuagacgggaauggcaccacccuugcugguaguuaauaccuagucuauaaccgccugauaauaguagcuguuaauauuagccuagggguaauauacaucucuuagggugagcuuuaugaguagcgcugaguucagugacauggugcauggguuugaggaaugggaaaggagggagagagaauccuuaauguuuaauuugaacuuuuuuguauuguggucugaaauaauuucccuuaaggucacugagcucuaguucagguggcuggaaugcuguuccuguuuucaugcuguguagagaaauuuuggaguaggaaaauuggguuaccagcaaucaauauugguuccauuuugugaacgccccaggcuuucucuuuauuuuuuugugaaccagggaguuguuagauugugaucuauugacuacuaaguucccauuagugcuuacucuacugaucaggcucugcaaggccuguuuuccuccagagcucuccuuucaggguguguguguguguguguguguguguguguguguguguguauauaaaacaggaaaaacuuaugaagaagcacauuuuugguuaagaugacaaaaggggcuugucuugcccccuacaguaauuuaaauauagucaguucuggccauuaagacauacuaaugggaagaguagaauauugagaucuucccauaguaaaaggacagaaaaguauuuuucugagagaaauuaaaaaaaaaaaaagaauagacaaauucccaguccacuauagagguaaaagaaugcuggguggauauuagaaucacagaguaaaguucuaaaggauuuuaggcuucgucuuccuuuuugcuugauuauuuuuuaaaaaccccuucaaauggcauuuagucuuaucuuaaucauuaaggucaaagaacucaaggaaggugguuccuugcaauucuguaucugaaauguauucaaaugugugaauccaucuaccaagaagaaauacuacaaaauugaauuguucauuuuaaaaagccacugugcacuguuguucuuaguggucauaaaucucucaaaacaagacuuugcaucuuuuuaugaucaaaguuaaaguuuugcugucaguucagccagugacagguuuaauguuuuuccuuguuccuuuuuuggggaccaccucuuugacuaggaucucuuagaguaucaggauggggaaaaaggagggauaaauuaaauaugugcuuauauguuaaggaccaaaauuguaaacaagucaaaucuaagagucgguaugaguuauuucuucucuuguaauuuuguuuauuuagauaaucuucaauuaauagauugguaggcaggauuugacaauccuuuugucauauaaaagugauauuaaauuaacauagauuuuucaaaugaaaauccagaaagagaaaauaaagaugaauaaugaaaauaucuaaggccgcacgcaguggcucacgccuguaaucccagcacuuugggaggcugaggcaggaggaucaccugaggucgggaguucaagaccagccugaccaacauggagaagcccagucucuacuaaaaauacaaaauuagccgggcaugguugcacaugccuauaaucccagccacucgggaggcugaggccagagaauugcuugaauccaggaggcggacguugcagugauccgagauugcgccauugcacuccagccugggcaacaagagugaaacucagucucaaacaaacaaacaaaaaaacaaacaaaaaaaagaaaaugucuaaaaggugccgaauaguuuguaacaugaacucaaaucagaaguuguaagugauuugcaucuugucgauucccaggauauauuugaagaauuuaguuauuaaugauacaguuugcccuauaauaagucuuugaagccccuuauaaacauuuauuauauucggcccaguguggauuucuaaauaugucuguauaacauuuuccaaauaucauguuuagaaaacaauaaauauuuaauuuuauugggauaauaugacacacuuuuauuuaacgaauauuuugauaucauugauuuuuauauauuaucuagauuuuaaaauguaacaauuuguuugguuugauaauauuuaguaucuagcuuuagccuaggaugcaaaaguccaguguguccacauagcgguagcaugauuugaaucuaacaaauuuggauaccuaguuuaccuuuuuuuuuuuaaacagcgcagaaaaggaaccaauauuucagaaacaagcuuaauaggaacagcugccuguacaucaacaucuucucagaaugacccagaaguuaucaucgugggagcuggcgugcuuggcucugcuuuggcagcugugcuuuccagagauggaagaaaggugacagucauugagagagacuuaaaagagccugacagaauaguuggagaauuccugcagccgggugguuaucauguucucaaagaccuuggucuuggagguagguucauauugauuuucaggagaguuacgugguaugaacaagcacucuucacuuagaccauccuaugaccaguaagaagguauuccauuuuauuuucauuuauaaaauuuucuauacucauuuaccaacaaauuugcaugaaagugagagcaaaggauaaaauaagcauuuaauaguaugauuagaugugaauuagacuuaaugagauauaauaaaauggccaaaagauuguaauggucaaaauuaaggacuggaaaauccuagaaugagggcauuaaauuuugugaaaggcgaagggaacugucauuuguagaggguauguuguauacuuguuacaguguuauuacuuagaaucuuuuauuuaagcaccauucauccauucaaccagugcuuuuuaagcacuggcuauucauuuaggaaauauuuaugcacugucuacuuuguguggggaugggguggugggguggggugggguggggaaggugggagagacacaaagaagcaagcccuccccugucuuuuuuuccaagggcacuaauccuaucgugagagucuacccucaugaccuaaucaccuucuaaaggcuccaucuccaaauaucaucacauuggggauuagaguuuuagcuuaggaauuuugggaggacacagacauccagucaauaccauauuugaacauuuuaugucacuaauauauauacuagaguccacuuuuucacuugacagaaacauauuuccaauacuguuaaccauucuuuaucaguaucuuuuuaagcccaagcauaguuguuuuucaguugacuucauaauguacuucacuuuucaaacuuagaugaauguuuagguuauuuucaguuauccuuuuuuagguaacacuauagugaaccuauucuugcauguaacuuuaaagauuauuaaauauuaugucuuuaggaugaauuucuuacauggauuuccaagaguaagauuauuacaucgaaggaugcuaauuucuucaugguucuugauaauuauuguuauauuuucuaaaauauaauauuaguucauaguaucaccaguaguauaugaauuuaucaguuuuaucauaaucucaucagugauuuugaugguguccuguuguuucaauuuuuacuuaauuuuuuuuaucguuugaacauuuuuucugauuuguucacuguuucuauauugcuuuauaugaaucauccauacauguuuuuguccauuacuauuggcgucuuaauauuuuuccagugguuuuuaaugaguaaauuuuauuauauauacauguauuaaucuuuuguucuauuucauaugucuuucccaaaguauuguuuuaguuuuuauuuuuaaaauuaauuuuuuaacuuucuaauuuucgguuggcacuuuaaaaaugugauauuuucuauugaaaguuuuuuauuuuucaacugcuuuugcugcuuuagauuuaagaaagaaguuuuuacaugauucugaugaauucaguguuuuguuugcugccauuuaaauuauuugauguacuaaaaaguucuuugcaguuuguccugagucacuuuuaauggauaguauguaaucaucaacaguugggggauaacucuacccuuuccauuugguuuggaaaaucuacuuuuucauauauucagucauuauauauaaauugggguuuuuuuuugaguuuccauacugguuuuauuuuauuuuuauuucuuuuuggugacaaaucuacauauucauacauugaaagaaguguuaagaaggacuaaauguguuccuaugucuuuauggcagaacagguuuacucaggagaggauuaugguuuauuucauguugcauuuucuuucugaaguugaaguggaauuacagaccugaaauaguuauguuguuaucuuuaaaugauauuacagauuugcuaagacucucauugacuuccagaagcauucacaguuucugaaauaguuacauuaguuuuguucaguucuccagauuugaaggcagagacucauuuuugaugugugugugucuucuuugguucuuaguuuaacgcuggguguguuaacagaauugauuguuuugaacucgauugcuuugcagauacaguggaaggucuugaugcccagguuguaaaugguuacaugauucaugaucaggaaagcaaaucagagguucagauuccuuacccucugucagaaaacaaucaagugcagaguggaagagcuuuccaucacggaagauucaucaugagucuccggaaagcagcuauggcagagcccaaguaagaccacaguuucaaauauauaauuacuaaagaaucaaugcauuuaaauuugaccuuuguacaaauaagauuuuauaaauuuuaaugaauuuuuggggcauagucuagaacauauguauauuaaaauaaacugucagucaaaagaguguuagauauucagugcuuuuguuaagaauaucauauagagaauuuuccuuugacauggaacuaugaagaguucuccuuugacuaaaugaaaauuacauaauuuuuaugugacgggaauuuagaggauauauuuguaacuaaggcauaaguccauuugugcacauuuuggaguuugaguuugugguuacgauacuuucuauuagaagucaggauacaaaacugcaaggagaaaucccuguuucauucucacuaaagacccagucuguuaggacuggcuucuucucuuguuuauuaacuuauauuuaccaguaaccuuuaaaacacuaauugaagaaguuuuaagcgugagaacccucaugugacugacacagacuaaaguauugacaaagcaagugaagaagcaaguggacuuaauccuuuggacuaaaaagacuugauauccauggaagaagaguauguucacuguaugaaaauggaaaaaucggccaggugcgguggcucaugccuguaaucccagcacuuugggaggcugaggugggcagaucacgaggucaggaguucaaaaccagccuggccaauauggugaaaccccgucucuacuaaaaauaagaaaaaauuagccaggcgugguagcacgcaccugcagucccagcuacuugggaggcuaaggcaggagaauugcuugaacccaggagguggagguugcagugagccgagauagcgccacugcacuccagccugggcgacagagcgagacuuggucucaaaaaaaaaaaaaaagaaaauggaaaaauagucccaaauauaaagauuauaaaaauuaccugugaucuuucugacuagaaauaauuacucuuucuuuuuuuugagacugagucucgcucugucacccgggcuggagggcaguguugcaaucucggcucacugcaaccucugccucccgaguucaagcaauucuccugccucagccucccgaguagcugggauuacaggcacaugccaccacgccuggcaaauuuuuguauuuuuaguagagacgggguuucaccauguuggccaggauggccuugaucuccugaccuugugauccgcccaccuuggccucccaaaguucugggauuacaggugugagccaccgugcccugccagaaauaauuacucuuaacaguuugcaggaugcauuccaauacuuguuuuccccucuguguaugaauguaugaggguauguaaaguuucucugccuauauuuuauuuuuuaacaaauuaauuuauuuuuaacaaauuaagaugaaaauccaauguuacuuuuuaaaauauuuuuaaaauauuuaaugauuacuaaugauuacuaauguaaucauuaguaauauguauuaaauguugauaaauuagaaaauaaaaaacacacauuggacacguguuugcacacacaugcauguccaguuuauauggauaaacuggagauaaggaauuuauauuuaauuuaaauugcugaaaugugcugcuuuagaaauguauuuuuuuuuauucuuuagugcaaaguuuauugaagguguuguguuacaguuauuagaggaagaugauguugugaugggaguucaguacaaggauaaagagacuggagauaucaaggugagaaauaccaaaugucaccucuuccuaagagauguuguuuuuccugcuuuuucacuuaccccuuuaaaaaaguaggcuuaccgguuuacauguugaguaucucuuaucugaaaugcuagggaucagaaguguuucagauuuuuuauuuuuuucagauguuugcauuauacuuaccaguugagcaucucuaaucugaaaaucugaaauuugaaaugaucuaaugaguauuuuguuugucacauuacugcucaaaaaguuuuggauuucagauuuuuggauuagagauacucagccuguguuauuuaucaaaugaacugaguucuuucuaagccauaugcaacaggauggguuucagauugcaacacauuguucuuuagaggacuucagaaugcuaugcaaaaaacauuuuaaacagaacuaaugugaauaguuuuugaaacaguaauauacaucagcagagaagcagaggggaacuagcaggggaaagaaggcaagauucaacauaaaagaaaugauucagauaaaaugagcaauuuaacucagguaauaguaagagaaucuuuuuaaaaacaauuuauccuuuuauuuuauuuuauuuuauuuuguuuuauuuuuugagacggaguuucacucuuguugcccaggcuggagugcaauggugcgaucucggcucacugcaaccuccaccucccagguucaagcgauucuccugccucagccuccugaguagcugggauuacaggcaugcuucaccgcauccggcuaauuuuguauuuuuaauagagacgggguuucuccauguuggucaggcugcucuugaacuuccagccucaggugaucugcccaccucagccucccaaagugcugggauuacaggcgugagccaccgcacccggccaauuuuuccuuuuuuuaaaaaaaaauuaucguaguaaaaaacauguaauucuggacugcuccccauaggguuaccaccucuuagaaauuguccucuaaugaaggugacuggaauguuuucucugcucauacuguaguauuauaaauacauguagucauuuguacaaaaauucuucuaagcccuagcugcugacuaaaagcacuauaugaaguuaggaaauuuuagaaugaaagaaucuggcuagucccuugaauuuguaaugagauugacugcucuguguuacaugccugccuuguaguuguuucccccauugucugucaaaguggagaguaaucccagaugguuugcaugggagggcuacaaagggagaugauccucagggacucagaggaaguaucuaaacacuggucaugcguuaucugaagcccacguaacaguuucuucaauaguauuaucuucaacuacucucuauaaugcuaucugauaauauaucuaaaucucuucacgcacauuuuuuaagaauggcuuuuuuuacuguguguuucugacuacuaaacugaguagucuucauuucuguuauaggaacuccaugcuccacugacuguuguugcagaugggcuuuucuccaaguucaggaaaagccuggucuccaauaaaguuucuguaucaucucauuuuguuggcuuucuuaugaagguacuguaggaguguguuauuguaauuucaauaaaagaaacuugaaauuugaaaauuauuaaaacauuuucuuuuuauuuguuuuagaaugcaccacaguuuaaagcaaaucaugcugaacuuauuuuagcuaacccgaguccaguucucaucuaccagauuucauccagugaaacucgaguacuuguugacauuagaggagaaaugccaaggaauuuaagagaauacaugguugaaaaaauuuacccacaaauaccugguaagaaauagcaucuucaguucuuacaaaggcugugucuaaaauaggccagagauaaggauggcaggugaaacauucauccagucaaccagauauucuggaacugaacuauuuaaacuagcacuuaaaaacagcaaaacaaacucccaaauuaauaaaaaaaaguuucgggccgggcacaguaggucaugccuguaaucccaccacuuugggaggcugaggugggcagaucaccugagguugggaguucaagaccagccugaccaacauggagaaaccccgucucuacuaaaaauacaaaauuagccgagugugguggugcaugccuguaaucccagcuacucaggaggcugaggcagaagaaucgcuugaacgggaggcagagguuguagugagccgagaucgugccauugcacuccagccugggcaacaagagcgaaacuccgucucaaaaaaaaaaaaaaguuuugauauguuuuugucacauaauagcauaguuuuuagaauaauuguuuuuauuggcauauaugguauuuuuaaagguagucucuggacacgaaucugacucugaauucuuuaucucuuauaccuaaauauuuuugugcuugguuuuuguaguaaugacagcuaccauuucuugaaugcuuacuauaaaguguuuagcaaacauaauuucauuuaaucuauguaaccacucugugagguaggcauuaucauuauucucauuuuacagaugggagaacuaagguucagagagauuaguuagcuccuccaaguauaaacuauuaguaauggcagaaccaggguugauaucaggucugucuggcucauaugugccuguuugaacagacauguccuguccgcagaaugugagaauuguaagggaucuucaggaucauguuaguuuugaguugaauauaaaggcuucaugagauuuagauagcuuuguaaaaacauuaauaaaaauuacuuuuucacaaaucuaaaguuuucaugguacaguuuuuaggaucuuuuuuugagaaugggaugauauaggaaagaaaaguaaaaaaaauuuaagaauuuugauaaaauugaagggaaacccucauugucaauuaugauaugauuagaguaauaggaaacuauuuuugguaugaguacauuuuguuuaaauauuccguuuuuuucaaguuauuuuuuaaacuaagugaaaccacuuuaguaacaaauuauuaacagaaaugaagugaaaugaagugggcaaacuuagauuuuaaauaaugacauuuucaacauguacauggaaacauuucaauaaauuuucauuuaguuaagccacuuuugaagcuuucagauggggaaauuaugaauauuuaugaaaagggucauccauuaccugauauuuuuagcauuuauuuuucuuuuauuguaaauguggugguuuuucuuuuuuuuuucuuuuuuccaauccagagguuaauuggaguagagugcccugaaauuauggagagaaaccauugguagguuuauauuaauauuaguuagauuaccaaaauucuacuccuuaauaugaauggaauaauuuuuaacagaggcuucugcuccucuauucccagaucacacugggaauuguaugacaguucauuuucuauauaaguagcacagaaauuuaaagcuuguuuggaaguaucucagagaugagcugaucaaaccauuucauuuuuauagaugaagaaauugaagcucagagagguagggcuggccucgaauuccuuuucuaguguacauacccuccugcuguuugugaauugguaguguauuucaucugauuauuacaagaauauauugauuauaauacauuaaauauuaaauaugacaguagucuguuaacauuuggaagaaagguaggugguuuucucccuguuucauuucaucugaauuugccucauuguuuuuucauucaguuguauguauguuuauauuaauguucucuuagauuccuuagucauuccuuggcauuaacagcuaagugcuuaaugaauaauuuuauuaaugaaauaauuaguucuugauuuaucacaagggauauauguaacaaccauaacagauguauaguaggcauuuguuuauacuugauaagaaaauaugugauacuuugaaauugaaguguuaugacccauuucuuuggguuggugggauuuauugcagaucaccugaaagaaccauucuuagaagccacugacaauucucaucugagguccaugccagcaagcuuccuuccuccuucaucagugaagaaacgagguauuauuuuuugggcuuauuuuauaaaggaaucaguauuccaaaugacaaauauaugauuaaauuuauacuguuacgaauaacuucugggacagauaguuugucacuguggauuagugcauuauuaauaccaaaauuaguuuuaugaucuauuuaguuguuaacauugaguguauacaaguauugugcuagucagggaaacaacagguaaaaaacugaccuugaccuagagaaggcaauuuucuacuuaggaauguagacagauaauuuuacaacacuguugauaaauaaaacccacagauucagugucaagaagugugcagagcagggagggaagcuugugaaaugggagggguaguuagggaggacguuguucaggaaacaguggaaacaaaggaccuuggaccuggaggaugagugggaguucaugagguggacacuaagaugaggaacuucuagguagauggaauaacauugccaaaggaugagaaaugguggcacuuucaaggaacucaagcaguuuccuauggcaggagcauagggugggugucagagugggagacagaccauuaacauuuaaucuuacagacaauggaaagucauuugaaguguuuucuuguuacuaacuuuauugauauauaauucacaaaucaguuugcccauuuaaaguguacaguacagugacuuuuuuaguauauucacagugugugcaucaccaccacaaucaaauuuagaacauuuuuaucuugcccaaagaaaccccguacccauugguauucacuccccauuuccucccaacacucagcccuaggcuaccccuaauuuacuuucugugucuagauuugucuauuugggauguuuccuaaaggcauuguauaguaaagcccuuuggaacuggcuuuucauuuagcacaauguuuuugagguucauucauguuguagcauguuucaguucuucauuuguuuuuauggccaaauaaucuuccauuguguggcuauauuacauuuuguuuagccauucaucaauugauagauauuuggguuguuucuacuuuuugguuauuacaagcaaugcugcuaugaacaucugugugcgaguuuuuguguggacauauauuuucauuuuucuugguuauauacccaagagugauauugcuggauuacauaguaguucacguuuaacuuuuugaggagcugcuagacuuguuuuccaaaauagcugucccaguuacauuccuuucagcagugugugaguucuaauuucuccacauccuugucagugaacacuuguauuaucuuugugugcauagccauccuaguagugugaacuaggccuuuuaucauugugcugauuugcauuucucucauagauaaugauguugaacaucuuuucauaugcauauaggccauuuguuguuuggagaaauguauauuuagacuuugcauauuuuuuuaauugggcagauuuaaaauuuauguauuguugaguuucaagaguccuuuauauauuuuagguacaagucccuuauuagauaugugauuugcaaaauuuuucucauucuguggguuuucuuuccauucuucuuaaugguuuccauugaaguacacaugguuuaaauuuucauguuuauuuuuucuuucguugcuugugcuuuugaugucauauuuaggaaggcuuuguccaaucuaaguucaaaaagauuuacuccuauguuuucuuuuucuuuuuuuuuuuuugagauggaguuucgcucuugucgccuaggcuggagugcgauggugcgaucucggcucauugcaaccucggccucccagguucaagcaauucuccugccucagccucccgaguagcugggauuauaggugcucgccaccgugcccagcuaauuuuuguauuuuuaguagagacgggguuucgccauguuggccaggcuggucucaaacuccugaccucaggugauccacccaccucagccucccaaaguccugggauuacaggcaugagccaccaugccuggccuguuacuccuauauuuucuucuaagaguuuuauaguuuuaccucuuaaauuuagcucuuugauccauuuugaguuaaauuuugugucuguugagaggaagggguccagcuugauuuguuuguguguggauauucaguugucccaguaucauuuguugaaaagacuguuuguuccccagugaauuuucuugcccuuguggucaaaauucccuugacugaaagguaaggguuucuuucaacaauauuuuguaguuuucagaguauaaguuuugcauuucuuuuguuaaauuuauuccuaaguauuuuaccuuuuuugauacuuuuguaaauggaauuuucuuaaagaggcaguggcaugauuagacuuuuauuucaggaauauacucugacauuuuuguggaggaugguuuggaggaaagucuaguaaaacauacacuaagauuaauuauucugucaaugaugauaaaaggccagaacuaggguuguaaaaugaaagguaaugaauaaauuuggguaauaucuaggauguagaauguaaaaaacgugaugauuuggauauuauaaugagagugaaaucucuugauguaaauuccagguuucuggcuuagauaguuuugccagccauuugcugacauaggaacaggaaaaggaguuaauuggguuuucuuucuuuuuucuuaguuugucuuaaagguuugcugauuuuaucuuuucaaagaaccaacuuuucauuuuguuaucuuuuguauuuuuuucauuucauuuauuuuggcucugaucuuuauuauuuucuacuaauuugggguuugguuugcucuugcuuuucugguugagaugcacuguuagguuguuuauuugauguuuuccugcuuuuuugauguaggcacuuacugcuaaaaacuuucccuuuaaguauugcuuuugcugugucucacagguuuuauauauugucuuugcauuuuuauuucuaucaagaaauuuuuauauuuacuucuuaauuucuucauugacccacuggucauucaagagcaugugguuuaauuuccauguguuuguauacacagucuccaaaguuccucauaguacugauuucuaguuuuauuccacuguggucagagaagauacuugauaugauuucaauuguuuuuugaauuuuuuaagccuuguuuuguggccuacccaugaucuauccuugugaaugaucgauuugcugaggagaagaauguguauucugcaguuguuggaugaaauguucugugaauauuuguuaggucuguuuggccuguaguccagauuaagucugauguuuguuguuuaucugucuggaugaucuauucagugcugaaggugggguguugaagucuccagccaugauuguauuggggucugucuccuuagcucuaauaauauuuccuuuauauaucugagugcuccgguauugggugcauauguaauuguuacauccucuugcugaauugaccccuuuaucauuaucuaaugaccuucuuugccucuuuuuauaguuuuugucuugaaaucuauuuuacugauguaaauaucacuaugcucuuuuuugguuuccauuugcauggaauaucuuuuuccaucccuucauuuucagucucuuuguggcuuuauaggugaaguguguuuauuuuaggcagcagaucguugguucuuuuuuuaaauccauucagccacuuacgccuuucgaguggaguuuaguccaucuacauugaauguuauuauugguaagugcguacuauugccauuuuguuuuuguuuucugauuguuuugcugucuuuucuuccguccuguuuccuuucugugaagguaauuuucucugguaguauguuuuaauuucuugcuuuuaauuuuuuugccuaccucuuguaggcuuuugauuugaaauuaccaggaagcuugcaggucauaucuuauaaccgauuauuuuaaacugaugacaacugauuccacaaacgagcagagaaaacuaauaaaaacucuacacuuuauccuccuugcuuuuuaacuuuugugaguuuuguaccuucauguaauugcuuacugcucguuaagguccuuuucuuuuagauugaagaacucacuucggcauuucuugugggaaaguuugguguugaugaagucccucggcuuuuguuugucugggaaagucuuuauuucuccuucauguuugaaggauauuuucacuggauauacuauuguagcauaaaaguucuuuuccuucagcacuuucagugugucuugccccucucuccuggccuguaagauuuccacuaagucuacugccagacauacuagagcuccauuguuuguuguuuccuuucucuuguugcucuuaggaucuuuucuauauccuugaccuuugggaguuugauuauuaaauggcuugaacuagucuuguuuggauuaaaucaaucaccaauccuugcuugguguucuguagcuuucuugugcuugaauauugauaucuuucucuagauuugggaaguucucuguuauuuuuucuucaaauaaacuuucuacccucaucuuucuaucuccuuuuaaaggccaagaacuuagauuugcucuuuugaaauuauuuucuagaucuuguaggugugccucauucuugauuauucuuuuuucuuuugucuccucuguguauuuucaaauagccuguuuucaagcuuacuaauucuuucuucugcuugaucaguucuacuguugagauucugccauguucuucaguaaguuaauugaauuuuuuaucuccagaauuucugcuugauucuuuuaaauuauuucaguuguuuuguuaaacuuaccugauagcauucugaguuccuucucuguguugucuugaauuuuguugagcuucuccaaaacagcuauuuugaauucucugaaagcucacaucucuguuacucugggauuggucacuggugccuuauuuauuauuguuaauuuagugaguucauguuuuccuggaugguuuugaugacuguggauguucaccaaugucugggcauugaugaguuagguauuuauuguggucuucggagucugggcuuguuuguacccaucuuucuugggaacgcuuuugaaguauucaaagggaagugaguguugugaucuaagucuuuggucauagcagccguaucuguauuaaggggcaccccaaguccaguaacauugugacccuugcagacuuguagagguaccgccuugguggucuuggguaauaucugggagaauucccuggauuaucaggaaaagaacucuugguucucuucccuuacuuucccccaaacagagucuguccuucuuuguugagcugccuggagcugugggggacgggugacacagguaugccuguggccaccaugacuggcgugugcugagucagaccugaagccaguacagcacuggguauuggugaaaggcuuguggugaugacugccuggucaccgcugauguucccucaagacucaagagcucuacagucagcacaaauccagccaggcuugugcccuucccuugagggcagugagcuccugggggcccaggacugguccagaaaugcugucugggagccagggccuggaguugggaaacuuaggaaucuacuuggugcucuauucuacugcagcugagcuggcacccaaaccuuaagacauauuccuucccacucuucccucuccuuuccucaagcagaaggagccucuccccauggccaccagugcuccaggccugcagugaguacugccuggcugcugcugguguucacucaaggcuccagggcucuucagucagcugguggugaaugcugccagaccugggucucucccuucaguacaaugggcuccccucucacccaggacggauccaaaaaugcuguccaggugccaagaccuagaaucagggaccccaggaacccacuuggugcucugucucacuggccaagcugguacccaggcugacuuuugguucuuaugaaggugcuuuccugugugggagggggaugaucgccagaggacuugcuuuguauaccuggauaccuguagauucuuuuuauuuucuucauauuuuaaggaggccuuacaaauguauugacauuauuggacuugucauuagguuuguauaugagcuucaugagggcagaggccacacucuuguuauuaccauauccccagugccuggccaccuauuagguacccaacauugauucaaacaacucuugaauuuuugccucagcaaauuuuaaucaugauuuguuuucauguauuuucacauuuuucuuauuauuagcuuacaucaguaaucuuuauacauugaguuauccuuuuuguuuugucucaagggaugcucuaaaauaaaaucuucauuaccucucuucauagguguucuucuuuugggagacgcauauaauaugaggcauccacuuacugguggaggaaugacuguugcuuuuaaagauauaaaacuauggagaaaacugcuaaaggguaucccugaccuuuaugaugaugcagcuauuuucgagguaagaucaauuauuuugacaaaaaugucucaaaauggauuuauuucuggggguuaagagcaguggggcucugauggggagaucuguacuaaggaaccugaugcuuuauaauagcucuuaggcaucuugcuuaggcuuaaagaaccugacuugcaaccugugaaucuuagagaauuucuaaauuugaauauuauguaacacuugauugcuaugggccacuuagcucauagugguuguaaauuuagcuucagugucauauaacccauugcucugaaggugauuuuuuauuuuuuuuguaaaugauaaacauaaggcaauauuacuugcagauaguccuuagaaggauaaguaucaguuugaggggauuauaaacaucaguuugugcuuuuuuauccuuaccauauaauaaaugagcuauuucuuuuuuaggccaaaaaaucauuuuacugggcaagaaaaacaucucauuccuuugucgugaauauccuugcucaggcucuuuaugaauuauuuucugccacagaugguaaguguagacacuuuuuagugaauauuacucaauugcagauuuuuagcguaggaaaggaauaaacaaguuagugauuuguccagaaauaaaaauguuaccugaguuugcuaacucccaaguugguaguuuuuuaaaauuccauuuugagcaauaguuguaguuuuaguuuuaguuuggaagguaguggaauuuccuuagacaacauuaauagcaaugccucaguaacauauucauuauuuugaauuccucuggugcagacuagaucaugcuuguccucacacacacaagacugugauggaagguguuuuuggccauguauuaaaaggcaauguagucuuuuucuuccuaacacuaguuucaauuucuuuuuaaaguaguauuuuauaaaaugaauacaagcuguuaaucuugucccuguugaaaagcacaaguaacaaugcauucacccuuuacuuauuuggauuauuuuggugcuuuuguuacuguuuccauauuauacagaggucacggucaauguauauauuagagaaaacacaacuuagcagaagcaguguuagaaauggaggaaaagaggccaggcgaaaugauucaugccuguaaucccagcacuucaggaggccaaggcaggaggaucgcuuaaagccaggaguuucacaccaaccuggacaauaaagcaagaccccaucucuacaaaaaauuaaaagaucagcaaggcaugguggcgugugccuguagucccagcuauuugggacuauauagcucacuacagugagcuauauauagugagcuauaugaagugccacugcacucagccugggcaacagagugagacuucaucuucuaaaacaaacaaacaaaaaauuaaaagaaauggaggagaaaaggcaacugugccaccuccucaccacagcaguguacacaucaguuuaauaguagguuaaugaaacuaggcuuuucaguuuucaagaauaaauacugacucauaugccacuacucuaguauauuugcaacauagcuauuuguaugaucuggcugaggcccuagugauaagugcugugguuauaauuacaaaagaugauacaauaaaaaugcuuucuguagccucuauaaccauuaacucuuccuaaggaaaaaaaacaaaacaaaaaccccaccaaucucacugguuaugauuuuuccaaacaaauuucucuugcuaaauuggcauagaaguuaaaauggcugguugggcaaaugaaaguaacuaaguuuagaguuuugggcaaauaaaaagaacuaaguuuagaguuuugggcaaauaaaaagaacuaaauuuaagaguuuuucugagcucuucuuucuaagcuuuucuaacuucuugaguucuuaacauuaugaauuuaaaucuaccaacaaaacaacauuuuuuaaaaguuacaagauuggaggaggaaagaccuuuauuggagcaaaaguuuaccuguugcauccuuuacuuuuuaaaaucuguuguaaagaaaaaucugggcauaccugaacagaacauugauucuaaaugguuaaaaagguuaucaauugauuacacuacauugugaggguuuuaugaguuacuuugaaagguauuaaaaacuuuauagauauaaggaauuauuauuuaucgcuacucacagcucucuucacuugauaauuuacugcuuaguuagagauacugguuggacaucuuagagacugggaauuugguuucuagaauuguguuaaaaagagcuuccaaaguauuuugcaucacuuaaugaauuaacagcaaaaucaaggaaguaccuuuuaaacaacucuuccaagaccuaaauauuaguaguuauuuacuaacagaaaaaaguuuauucauauuuauauuacucuccauaaugcugauuauggaauucagaagaaauccugguuguugaaauucuaggacuagauauuuaaaaauuaucugcaagauguagcguuuguuauuucucauuuuuucugauauaucauuagcauccuacauaaguguguacacauauuugauuauuuuacaauuuuauuuuagauucccugcaucaacuaagaaaagccuguuuucuuuauuucaaacuugguggcgaauguguugcggguccuguugggcugcuuucuguguaaguugugauggcacagaggauacaaaccugccagauuuucuuaggacuguucaguugaugaauuacugcaaaucuuucuuccuuacacauuuugauauuuuauuaucuguuaguaucccaaugagaagguggcccaaagaaaugaagaaacgcaauauuuaguacuguuuucuuucuagggaacagcaguuaaagguggugguagaggaagcuauaacccuugauuaaaauagaagcuuguuuuuugccuauggauuuauccauauguucuggucugugggagccaggaauaauugagaaauuuuaauuuaagaauuaguuucauugaaguacggggacuuauacaacccaguauuaguuuugagcguacagacauauguggaacuauucuuggaaagucuacaaagugaaaucuaucgaguuauuucucauuugcaaagugauccuuugagucauuucucauaaucuauaaucugaauguuaauacugauauuuuuaaaagcccuacaucccaacagaccaggccaucuagauauuucagcguggugucucaggaugaguaaacaaacagcuaaaaauauaugacuuauguaaacuagaguuacaggaguuacuagcuuuucugaaagggauauauucuaaguauuuuuucuuaaaaaaaaaaaaaggggggugggggguuugcuccugccaucaaacuuaacaugcagacauauuugugacguccucuaaaauguagaauguuucauacagaauuaugaugcuuggguaaaaaaaaguaggauguuuguugagcuucguagauuauauguaauuggaaccuuuggaguaaauuuuaguuucugagucuuaccaauauguauuuuuuucuauuacagauugucuccuaacccucuaguuuuaauuggacacuucuuugcuguugcaaucuaugccguguauuuuugcuuuaagucagaaccuuggauuacaaaaccucgagcccuucucaguaguggugcuguauuguacaaagcguguucuguaauauuuccucuaauuuacucagaaaugaaguauaugguucauuaagcuuaaaggggaaccauuugugaaugaauauuuggaacuuaccaaguccuaagagacuuuuggaagaggauauauauagcauaguaccauaccacuuauaaaguggaaacucuuggaccaagauuuggauuaauuuguuuuugaaguuuuuuguauauaaauauguaaauacaugcuuuaauuugcaauuuaaaaugaagggguuaaauaaguuagacauuuaaaagaaaugauuguuaccauaaauuagugcuaaugcugaggagaacuacaguuuuucuuuugaauuuaguauuugagaugaguuguugggacaugcaaauaaaaugaagaaugaacuuucgugucuuuuuguuucuuguugugggcucguuuacauagcuucaugauaaugaaaaagaaaaccaaagugggaugaaaagugcagagggaaaccuguucuauuaaauaacuggggaaguugccuuaaugucuugaccuugauuuccucaucuauccagugaagcaauuugauaagguuauuuucuuuaaaaaaaauuacuuauuuauuuauuuauuuuauuuuggggcugugacucagauuugaaccgaaagguucuuugcugaguucucugaaaauaucagauucugacaggaaaggcaaucaagggcuuuauaaguuccacuguauagcaacauuuauaaggcagcccaggaugacaucaagaaacagugagugaacaaguaagcacuuguaauacccggcauaauaccuuaaaauccguuaggauuuacugaguuuaucuauaguaaauuugaagagacuauggauguucaaaggguaucaucauaaaaguucaguaaaucuccaaauaccaugaaaguaaauuguuacuucugaaagagcaguaaaauauaaccuggcaaaugaaguuacuacuugagauucuaacagggcuaaaauauaacuuacaaagcuuuuacaauaaaaauuucaauuuuuaaguuuuuucaguugaaaaaaauucuucacuggccaaaucacuagcaaaaucaguuucaaacaucacugccuuguuuuaguagagcauaugguggacccauuugcuugguuucguaagauucccaucuaacugacccuaaacuucuauuuucugguuaaaaacucacuuucccagaucuggccuucuuagcaguuaguuagcuuucuuuuucgagaacaaagaucucacuucaugugguuauuguuaacaagauuacaaaugaaaaauaacacgcuaucguugagauauagauguucccacacaccgucuuugcagggggugagacuuccaagcucccuacguaccaagcaacaguucucuuaaaauucugcccuggccucggugcccucauggccaggauucgagguuacccuuguucgccacugagacuccuuuaaaguccuuucuacuaugauagugaaauaaucaaagccuguaaagucuuuucuucccuucaauaucagaauuugaggccuucugacaaaagaaauaaaaugagaaaaccgaaggaaccugagaaauccuuuaguccuaauuuuacagaugaugccaguaggcuggcuugggacaagguguagcuuguggcagaaccaggacucaaacuuacccuccugauugcaaaucaguacaucuucccccaccacuagcaaaaugacugucaaacagauuuuggcuucuggguuugguuugguuuguuccuuccucuccagagaaggacauaaccauagagauuuaggguggaaacaucuuucuugcucucauccaaguuguugauacccaaguugccacaguaggauggcagugauaugguguggcucuguguccccacccauauuucuucauagcagugugagaacagacuaauaguggcagcuuccuuuucaggguaauuuucaugcagaaaugauuuaggauuucgagggaguuaagcuuaugggaaggcuauuaccaaaaaggacucuggauaaugauacgguuguggggacuuggggcaggacucagguugcugaggaagauaccggaaggagcagcuuuguuaaggaguccuacagaaggaaugcuguggacccccuagggcaugugggauuggaagaggaugaugagacaccaagaaacuucaauggcacaugacacagauuguguggccacuacauuugcuacuagucuggcuaucaccacgugccugccagcuuguugggggugagcuauuauaccuagcagagucaucucuuauuccaaacaggguuuuuuacagggugaauacacaguuuuugaaucauaagcgagacgacuuuggguacuaguaauacuauuuuacugaaaaucuggaguugcacaaauaguucuuuagaacauaaaacuaaauggauuuauacauaacaguuacauucagcauuuaagagaggcaguacaaaaauguguucugcuuuuaucugauauaaauugcauguaauaccaugauuuaaacaauaucaguuauauuaacuaaugccaugagauauaucuuacucagaacgucugauguuucccauaauagacagaaaaaaugcaguuguaugagcaacugaguuucuuuucaucuucaaauucauuugugauggugggaagaucuaaggacaauccuuccauugaagaaguaggaaaaacaguuacagcacuguucugaacucaucaaaaaugaaauuaggcacaugugcuucagcaaccugaaaaauuaaagaauuaaauuauucaugguguuauaguugaacaauuacaaaauuuucauacguaaaagaaaagauauccuuggagcaaggugaauaauagaagaggagacucccaugggcggacgacuccuugaaacagccccuuucugcuuguggugcccccuagacuagcgucucauuucuuggcacugcuaacauuugaggggaugcaguacagc

SEQ ID NO: 17782 - RNA, 26426 nt, Homo sapiens
gcuguacugcauccccucaaauguuagcagugccaagaaaugagacgcuagucuagggggcaccacaagcagaaaggggcuguuucaaggagucguccgcccaugggagucuccucuucuauuauucaccuugcuccaaggauaucuuuucuuuuacguaugaaaauuuuguaauuguucaacuauaacaccaugaauaauuuaauucuuuaauuuuucagguugcugaagcacaugugccuaauuucauuuuugaugaguucagaacagugcuguaacuguuuuuccuacuucuucaauggaaggauuguccuuagaucuucccaccaucacaaaugaauuugaagaugaaaagaaacucaguugcucauacaacugcauuuuuucugucuauuaugggaaacaucagacguucugaguaagauauaucucauggcauuaguuaauauaacugauauuguuuaaaucaugguauuacaugcaauuuauaucagauaaaagcagaacacauuuuuguacugccucucuuaaaugcugaauguaacuguuauguauaaauccauuuaguuuuauguucuaaagaacuauuugugcaacuccagauuuucaguaaaauaguauuacuaguacccaaagucgucucgcuuaugauucaaaaacuguguauucacccuguaaaaaacccuguuuggaauaagagaugacucugcuagguauaauagcucacccccaacaagcuggcaggcacguggugauagccagacuaguagcaaauguaguggccacacaaucugugucaugugccauugaaguuucuuggugucucaucauccucuuccaaucccacaugcccuaggggguccacagcauuccuucuguaggacuccuuaacaaagcugcuccuuccgguaucuuccucagcaaccugaguccugccccaaguccccacaaccguaucauuauccagaguccuuuuugguaauagccuucccauaagcuuaacucccucgaaauccuaaaucauuucugcaugaaaauuacccugaaaaggaagcugccacuauuagucuguucucacacugcuaugaagaaauauggguggggacacagagccacaccauaucacugccauccuacuguggcaacuuggguaucaacaacuuggaugagagcaagaaagauguuuccacccuaaaucucuaugguuauguccuucucuggagaggaaggaacaaaccaaaccaaacccagaagccaaaaucuguuugacagucauuuugcuaguggugggggaagauguacugauuugcaaucaggaggguaaguuugaguccugguucugccacaagcuacaccuugucccaagccagccuacuggcaucaucuguaaaauuaggacuaaaggauuucucagguuccuucgguuuucucauuuuauuucuuuugucagaaggccucaaauucugauauugaagggaagaaaagacuuuacaggcuuugauuauuucacuaucauaguagaaaggacuuuaaaggagucucaguggcgaacaaggguaaccucgaauccuggccaugagggcaccgaggccagggcagaauuuuaagagaacuguugcuugguacguagggagcuuggaagucucacccccugcaaagacggugugugggaacaucuauaucucaacgauagcguguuauuuuucauuuguaaucuuguuaacaauaaccacaugaagugagaucuuuguucucgaaaaagaaagcuaacuaacugcuaagaaggccagaucugggaaagugaguuuuuaaccagaaaauagaaguuuagggucaguuagaugggaaucuuacgaaaccaagcaaauggguccaccauaugcucuacuaaaacaaggcagugauguuugaaacugauuuugcuagugauuuggccagugaagaauuuuuuucaacugaaaaaacuuaaaaauugaaauuuuuauuguaaaagcuuuguaaguuauauuuuagcccuguuagaaucucaaguaguaacuucauuugccagguuauauuuuacugcucuuucagaaguaacaauuuacuuucaugguauuuggagauuuacugaacuuuuaugaugauacccuuugaacauccauagucucuucaaauuuacuauagauaaacucaguaaauccuaacggauuuuaagguauuaugccggguauuacaagugcuuacuuguucacucacuguuucuugaugucauccugggcugccuuauaaauguugcuauacaguggaacuuauaaagcccuugauugccuuuccugucagaaucugauauuuucagagaacucagcaaagaaccuuucgguucaaaucugagucacagccccaaaauaaaauaaauaaauaaauaaguaauuuuuuuuaaagaaaauaaccuuaucaaauugcuucacuggauagaugaggaaaucaaggucaagacauuaaggcaacuuccccaguuauuuaauagaacagguuucccucugcacuuuucaucccacuuugguuuucuuuuucauuaucaugaagcuauguaaacgagcccacaacaagaaacaaaaagacacgaaaguucauucuucauuuuauuugcaugucccaacaacucaucucaaauacuaaauucaaaagaaaaacuguaguucuccucagcauuagcacuaauuuaugguaacaaucauuucuuuuaaaugucuaacuuauuuaaccccuucauuuuaaauugcaaauuaaagcauguauuuacauauuuauauacaaaaaacuucaaaaacaaauuaauccaaaucuugguccaagaguuuccacuuuauaagugguaugguacuaugcuauauauauccucuuccaaaagucucuuaggacuugguaaguuccaaauauucauucacaaaugguuccccuuuaagcuuaaugaaccauauacuucauuucugaguaaauuagaggaaauauuacagaacacgcuuuguacaauacagcaccacuacugagaagggcucgagguuuuguaauccaagguucugacuuaaagcaaaaauacacggcauagauugcaacagcaaagaaguguccaauuaaaacuagaggguuaggagacaaucuguaauagaaaaaaauacauauugguaagacucagaaacuaaaauuuacuccaaagguuccaauuacauauaaucuacgaagcucaacaaacauccuacuuuuuuuuacccaagcaucauaauucuguaugaaacauucuacauuuuagaggacgucacaaauaugucugcauguuaaguuugauggcaggagcaaaccccccaccccccuuuuuuuuuuuuuaagaaaaaauacuuagaauauaucccuuucagaaaagcuaguaacuccuguaacucuaguuuacauaagucauauauuuuuagcuguuuguuuacucauccugagacaccacgcugaaauaucuagauggccuggucuguugggauguagggcuuuuaaaaauaucaguauuaacauucagauuauagauuaugagaaaugacucaaaggaucacuuugcaaaugagaaauaacucgauagauuucacuuuguagacuuuccaagaauaguuccacauaugucuguacgcucaaaacuaauacuggguuguauaaguccccguacuucaaugaaacuaauucuuaaauuaaaauuucucaauuauuccuggcucccacagaccagaacauauggauaaauccauaggcaaaaaacaagcuucuauuuuaaucaaggguuauagcuuccucuaccaccaccuuuaacugcuguucccuagaaagaaaacaguacuaaauauugcguuucuucauuucuuugggccaccuucucauugggauacuaacagauaauaaaauaucaaaauguguaaggaagaaagauuugcaguaauucaucaacugaacaguccuaagaaaaucuggcagguuuguauccucugugccaucacaacuuacacagaaagcagcccaacaggacccgcaacacauucgccaccaaguuugaaauaaagaaaacaggcuuuucuuaguugaugcagggaaucuaaaauaaaauuguaaaauaaucaaauauguguacacacuuauguaggaugcuaaugauauaucagaaaaaaugagaaauaacaaacgcuacaucuugcagauaauuuuuaaauaucuaguccuagaauuucaacaaccaggauuucuucugaauuccauaaucagcauuauggagaguaauauaaauaugaauaaacuuuuuucuguuaguaaauaacuacuaauauuuaggucuuggaagaguuguuuaaaagguacuuccuugauuuugcuguuaauucauuaagugaugcaaaauacuuuggaagcucuuuuuaacacaauucuagaaaccaaauucccagucucuaagauguccaaccaguaucucuaacuaagcaguaaauuaucaagugaagagagcugugaguagcgauaaauaauaauuccuuauaucuauaaaguuuuuaauaccuuucaaaguaacucauaaaacccucacaauguaguguaaucaauugauaaccuuuuuaaccauuuagaaucaauguucuguucagguaugcccagauuuuucuuuacaacagauuuuaaaaaguaaaggaugcaacagguaaacuuuugcuccaauaaaggucuuuccuccuccaaucuuguaacuuuuaaaaaauguuguuuuguugguagauuuaaauucauaauguuaagaacucaagaaguuagaaaagcuuagaaagaagagcucagaaaaacucuuaaauuuaguucuuuuuauuugcccaaaacucuaaacuuaguucuuuuuauuugcccaaaacucuaaacuuaguuacuuucauuugcccaaccagccauuuuaacuucuaugccaauuuagcaagagaaauuuguuuggaaaaaucauaaccagugagauuggugggguuuuuguuuuguuuuuuuuccuuaggaagaguuaaugguuauagaggcuacagaaagcauuuuuauuguaucaucuuuuguaauuauaaccacagcacuuaucacuagggccucagccagaucauacaaauagcuauguugcaaauauacuagaguaguggcauaugagucaguauuuauucuugaaaacugaaaagccuaguuucauuaaccuacuauuaaacugauguguacacugcuguggugaggagguggcacaguugccuuuucuccuccauuucuuuuaauuuuuuguuuguuuguuuuagaagaugaagucucacucuguugcccaggcugagugcaguggcacuucauauagcucacuauauauagcucacuguagugagcuauauagucccaaauagcugggacuacaggcacacgccaccaugccuugcugaucuuuuaauuuuuuguagagauggggucuugcuuuauuguccagguuggugugaaacuccuggcuuuaagcgauccuccugccuuggccuccugaagugcugggauuacaggcaugaaucauuucgccuggccucuuuuccuccauuucuaacacugcuucugcuaaguuguguuuucucuaauauauacauugaccgugaccucuguauaauauggaaacaguaacaaaagcaccaaaauaauccaaauaaguaaagggugaaugcauuguuacuugugcuuuucaacagggacaagauuaacagcuuguauucauuuuauaaaauacuacuuuaaaaagaaauugaaacuaguguuaggaagaaaaagacuacauugccuuuuaauacauggccaaaaacaccuuccaucacagucuugugugugugaggacaagcaugaucuagucugcaccagaggaauucaaaauaaugaauauguuacugaggcauugcuauuaauguugucuaaggaaauuccacuaccuuccaaacuaaaacuaaaacuacaacuauugcucaaaauggaauuuuaaaaaacuaccaacuugggaguuagcaaacucagguaacauuuuuauuucuggacaaaucacuaacuuguuuauuccuuuccuacgcuaaaaaucugcaauugaguaauauucacuaaaaagugucuacacuuaccaucuguggcagaaaauaauucauaaagagccugagcaaggauauucacgacaaaggaaugagauguuuuucuugcccaguaaaaugauuuuuuggccuaaaaaagaaauagcucauuuauuauaugguaaggauaaaaaagcacaaacugauguuuauaauccccucaaacugauacuuauccuucuaaggacuaucugcaaguaauauugccuuauguuuaucauuuacaaaaaaaauaaaaaaucaccuucagagcaauggguuauaugacacugaagcuaaauuuacaaccacuaugagcuaaguggcccauagcaaucaaguguuacauaauauucaaauuuagaaauucucuaagauucacagguugcaagucagguucuuuaagccuaagcaagaugccuaagagcuauuauaaagcaucagguuccuuaguacagaucuccccaucagagccccacugcucuuaacccccagaaauaaauccauuuugagacauuuuugucaaaauaauugaucuuaccucgaaaauagcugcaucaucauaaaggucagggauacccuuuagcaguuuucuccauaguuuuauaucuuuaaaagcaacagucauuccuccaccaguaaguggaugccucauauuauaugcgucucccaaaagaagaacaccuaugaagagagguaaugaagauuuuauuuuagagcaucccuugagacaaaacaaaaaggauaacucaauguauaaagauuacugauguaagcuaauaauaagaaaaaugugaaaauacaugaaaacaaaucaugauuaaaauuugcugaggcaaaaauucaagaguuguuugaaucaauguuggguaccuaauagguggccaggcacuggggauaugguaauaacaagaguguggccucugcccucaugaagcucauauacaaaccuaaugacaaguccaauaaugucaauacauuuguaaggccuccuuaaaauaugaagaaaauaaaaagaaucuacagguauccagguauacaaagcaaguccucuggcgaucaucccccucccacacaggaaagcaccuucauaagaaccaaaagucagccuggguaccagcuuggccagugagacagagcaccaaguggguuccuggggucccugauucuaggucuuggcaccuggacagcauuuuuggauccguccugggugagaggggagcccauuguacugaagggagagacccaggucuggcagcauucaccaccagcugacugaagagcccuggagccuugagugaacaccagcagcagccaggcaguacucacugcaggccuggagcacugguggccauggggagaggcuccuucugcuugaggaaaggagagggaagagugggaaggaauaugucuuaagguuugggugccagcucagcugcaguagaauagagcaccaaguagauuccuaaguuucccaacuccaggcccuggcucccagacagcauuucuggaccaguccugggcccccaggagcucacugcccucaagggaagggcacaagccuggcuggauuugugcugacuguagagcucuugagucuugagggaacaucagcggugaccaggcagucaucaccacaagccuuucaccaauacccagugcuguacuggcuucaggucugacucagcacacgccagucaugguggccacaggcauaccugugucacccgucccccacagcuccaggcagcucaacaaagaaggacagacucuguuugggggaaaguaagggaagagaaccaagaguucuuuuccugauaauccagggaauucucccagauauuacccaagaccaccaaggcgguaccucuacaagucugcaagggucacaauguuacuggacuuggggugccccuuaauacagauacggcugcuaugaccaaagacuuagaucacaacacucacuucccuuugaauacuucaaaagcguucccaagaaagauggguacaaacaagcccagacuccgaagaccacaauaaauaccuaacucaucaaugcccagacauuggugaacauccacagucaucaaaaccauccaggaaaacaugaacucacuaaauuaacaauaauaaauaaggcaccagugaccaaucccagaguaacagagaugugagcuuucagagaauucaaaauagcuguuuuggagaagcucaacaaaauucaagacaacacagagaaggaacucagaaugcuaucagguaaguuuaacaaaacaacugaaauaauuuaaaagaaucaagcagaaauucuggagauaaaaaauucaauuaacuuacugaagaacauggcagaaucucaacaguagaacugaucaagcagaagaaagaauuaguaagcuugaaaacaggcuauuugaaaauacacagaggagacaaaagaaaaaagaauaaucaagaaugaggcacaccuacaagaucuagaaaauaauuucaaaagagcaaaucuaaguucuuggccuuuaaaaggagauagaaagaugaggguagaaaguuuauuugaagaaaaaauaacagagaacuucccaaaucuagagaaagauaucaauauucaagcacaagaaagcuacagaacaccaagcaaggauuggugauugauuuaauccaaacaagacuaguucaagccauuuaauaaucaaacucccaaaggucaaggauauagaaaagauccuaagagcaacaagagaaaggaaacaacaaacaauggagcucuaguaugucuggcaguagacuuaguggaaaucuuacaggccaggagagaggggcaagacacacugaaagugcugaaggaaaagaacuuuuaugcuacaauaguauauccagugaaaauauccuucaaacaugaaggagaaauaaagacuuucccagacaaacaaaagccgagggacuucaucaacaccaaacuuucccacaagaaaugccgaagugaguucuucaaucuaaaagaaaaggaccuuaacgagcaguaagcaauuacaugaagguacaaaacucacaaaaguuaaaaagcaaggaggauaaaguguagaguuuuuauuaguuuucucugcucguuuguggaaucaguugucaucaguuuaaaauaaucgguuauaagauaugaccugcaagcuuccugguaauuucaaaucaaaagccuacaagagguaggcaaaaaaauuaaaagcaagaaauuaaaacauacuaccagagaaaauuaccuucacagaaaggaaacaggacggaagaaaagacagcaaaacaaucagaaaacaaaaacaaaauggcaauaguacgcacuuaccaauaauaacauucaauguagauggacuaaacuccacucgaaaggcguaaguggcugaauggauuuaaaaaaagaaccaacgaucugcugccuaaaauaaacacacuucaccuauaaagccacaaagagacugaaaaugaagggauggaaaaagauauuccaugcaaauggaaaccaaaaaagagcauagugauauuuacaucaguaaaauagauuucaagacaaaaacuauaaaaagaggcaaagaaggucauuagauaaugauaaaggggucaauucagcaagaggauguaacaauuacauaugcacccaauaccggagcacucagauauauaaaggaaauauuauuagagcuaaggagacagaccccaauacaaucauggcuggagacuucaacaccccaccuucagcacugaauagaucauccagacagauaaacaacaaacaucagacuuaaucuggacuacaggccaaacagaccuaacaaauauucacagaacauuucauccaacaacugcagaauacacauucuucuccucagcaaaucgaucauucacaaggauagaucauggguaggccacaaaacaaggcuuaaaaaauucaaaaaacaauugaaaucauaucaaguaucuucucugaccacaguggaauaaaacuagaaaucaguacuaugaggaacuuuggagacuguguauacaaacacauggaaauuaaaccacaugcucuugaaugaccagugggucaaugaagaaauuaagaaguaaauauaaaaauuucuugauagaaauaaaaaugcaaagacaauauauaaaaccugugagacacagcaaaagcaauacuuaaagggaaaguuuuuagcaguaagugccuacaucaaaaaagcaggaaaacaucaaauaaacaaccuaacagugcaucucaaccagaaaagcaagagcaaaccaaaccccaaauuaguagaaaauaauaaagaucagagccaaaauaaaugaaaugaaaaaaauacaaaagauaacaaaaugaaaaguugguucuuugaaaagauaaaaucagcaaaccuuuaagacaaacuaagaaaaaagaaagaaaacccaauuaacuccuuuuccuguuccuaugucagcaaauggcuggcaaaacuaucuaagccagaaaccuggaauuuacaucaagagauuucacucucauuauaauauccaaaucaucacguuuuuuacauucuacauccuagauauuacccaaauuuauucauuaccuuucauuuuacaacccuaguucuggccuuuuaucaucauugacagaauaauuaaucuuaguguauguuuuacuagacuuuccuccaaaccauccuccacaaaaaugucagaguauauuccugaaauaaaagucuaaucaugccacugccucuuuaagaaaauuccauuuacaaaaguaucaaaaaagguaaaauacuuaggaauaaauuuaacaaaagaaaugcaaaacuuauacucugaaaacuacaaaauauuguugaaagaaacccuuaccuuucagucaagggaauuuugaccacaagggcaagaaaauucacuggggaacaaacagucuuuucaacaaaugauacugggacaacugaauauccacacacaaacaaaucaagcuggaccccuuccucucaacagacacaaaauuuaacucaaaauggaucaaagagcuaaauuuaagagguaaaacuauaaaacucuuagaagaaaauauaggaguaacaggccaggcaugguggcucaugccuguaaucccaggacuuugggaggcugagguggguggaucaccugaggucaggaguuugagaccagccuggccaacauggcgaaaccccgucucuacuaaaaauacaaaaauuagcugggcacgguggcgagcaccuauaaucccagcuacucgggaggcugaggcaggagaauugcuugaaccugggaggccgagguugcaaugagccgagaucgcaccaucgcacuccagccuaggcgacaagagcgaaacuccaucucaaaaaaaaaaaaagaaaaagaaaacauaggaguaaaucuuuuugaacuuagauuggacaaagccuuccuaaauaugacaucaaaagcacaagcaacgaaagaaaaaauaaacaugaaaauuuaaaccauguguacuucaauggaaaccauuaagaagaauggaaagaaaacccacagaaugagaaaaauuuugcaaaucacauaucuaauaagggacuuguaccuaaaauauauaaaggacucuugaaacucaacaauacauaaauuuuaaaucugcccaauuaaaaaaauaugcaaagucuaaauauacauuucuccaaacaacaaauggccuauaugcauaugaaaagauguucaacaucauuaucuaugagagaaaugcaaaucagcacaaugauaaaaggccuaguucacacuacuaggauggcuaugcacacaaagauaauacaaguguucacugacaaggauguggagaaauuagaacucacacacugcugaaaggaauguaacugggacagcuauuuuggaaaacaagucuagcagcuccucaaaaaguuaaacgugaacuacuauguaauccagcaauaucacucuuggguauauaaccaagaaaaaugaaaauauauguccacacaaaaacucgcacacagauguucauagcagcauugcuuguaauaaccaaaaaguagaaacaacccaaauaucuaucaauugaugaauggcuaaacaaaauguaauauagccacacaauggaagauuauuuggccauaaaaacaaaugaagaacugaaacaugcuacaacaugaaugaaccucaaaaacauugugcuaaaugaaaagccaguuccaaagggcuuuacuauacaaugccuuuaggaaacaucccaaauagacaaaucuagacacagaaaguaaauuagggguagccuagggcugaguguugggaggaaauggggagugaauaccaauggguacgggguuucuuugggcaagauaaaaauguucuaaauuugauugugguggugaugcacacacugugaauauacuaaaaaagucacuguacuguacacuuuaaaugggcaaacugauuugugaauuauauaucaauaaaguuaguaacaagaaaacacuucaaaugacuuuccauugucuguaagauuaaauguuaauggucugucucccacucugacacccacccuaugcuccugccauaggaaacugcuugaguuccuugaaagugccaccauuucucauccuuuggcaauguuauuccaucuaccuagaaguuccucaucuuaguguccaccucaugaacucccacucauccuccagguccaagguccuuuguuuccacuguuuccugaacaacguccucccuaacuaccccucccauuucacaagcuucccucccugcucugcacacuucuugacacugaaucuguggguuuuauuuaucaacaguguuguaaaauuaucugucuacauuccuaaguagaaaauugccuucucuaggucaaggucaguuuuuuaccuguuguuucccugacuagcacaauacuuguauacacucaauguuaacaacuaaauagaucauaaaacuaauuuugguauuaauaaugcacuaauccacagugacaaacuaucugucccagaaguuauucguaacaguauaaauuuaaucauauauuugucauuuggaauacugauuccuuuauaaaauaagcccaaaaaauaauaccucguuucuucacugaugaaggaggaaggaagcuugcuggcauggaccucagaugagaauugucaguggcuucuaagaaugguucuuucaggugaucugcaauaaaucccaccaacccaaagaaaugggucauaacacuucaauuucaaaguaucacauauuuucuuaucaaguauaaacaaaugccuacuauacaucuguuaugguuguuacauauaucccuugugauaaaucaagaacuaauuauuucauuaauaaaauuauucauuaagcacuuagcuguuaaugccaaggaaugacuaaggaaucuaagagaacauuaauauaaacauacauacaacugaaugaaaaaacaaugaggcaaauucagaugaaaugaaacagggagaaaaccaccuaccuuucuuccaaauguuaacagacuacugucauauuuaauauuuaauguauuauaaucaauauauucuuguaauaaucagaugaaauacacuaccaauucacaaacagcaggaggguauguacacuagaaaaggaauucgaggccagcccuaccucucugagcuucaauuucuucaucuauaaaaaugaaaugguuugaucagcucaucucugagauacuuccaaacaagcuuuaaauuucugugcuacuuauauagaaaaugaacugucauacaauucccagugugaucugggaauagaggagcagaagccucuguuaaaaauuauuccauucauauuaaggaguagaauuuugguaaucuaacuaauauuaauauaaaccuaccaaugguuucucuccauaauuucagggcacucuacuccaauuaaccucuggauuggaaaaaagaaaaaaaaaagaaaaaccaccacauuuacaauaaaagaaaaauaaaugcuaaaaauaucagguaauggaugacccuuuucauaaauauucauaauuuccccaucugaaagcuucaaaaguggcuuaacuaaaugaaaauuuauugaaauguuuccauguacauguugaaaaugucauuauuuaaaaucuaaguuugcccacuucauuucacuucauuucuguuaauaauuuguuacuaaagugguuucacuuaguuuaaaaaauaacuugaaaaaaacggaauauuuaaacaaaauguacucauaccaaaaauaguuuccuauuacucuaaucauaucauaauugacaaugaggguuucccuucaauuuuaucaaaauucuuaaauuuuuuuuacuuuucuuuccuauaucaucccauucucaaaaaaagauccuaaaaacuguaccaugaaaacuuuagauuugugaaaaaguaauuuuuauuaauguuuuuacaaagcuaucuaaaucucaugaagccuuuauauucaacucaaaacuaacaugauccugaagaucccuuacaauucucacauucugcggacaggacaugucuguucaaacaggcacauaugagccagacagaccugauaucaacccugguucugccauuacuaauaguuuauacuuggaggagcuaacuaaucucucugaaccuuaguucucccaucuguaaaaugagaauaaugauaaugccuaccucacagagugguuacauagauuaaaugaaauuauguuugcuaaacacuuuauaguaagcauucaagaaaugguagcugucauuacuacaaaaaccaagcacaaaaauauuuagguauaagagauaaagaauucagagucagauucguguccagagacuaccuuuaaaaauaccauauaugccaauaaaaacaauuauucuaaaaacuaugcuauuaugugacaaaaacauaucaaaacuuuuuuuuuuuuuugagacggaguuucgcucuuguugcccaggcuggagugcaauggcacgaucucggcucacuacaaccucugccucccguucaagcgauucuucugccucagccuccugaguagcugggauuacaggcaugcaccaccacacucggcuaauuuuguauuuuuaguagagacgggguuucuccauguuggucaggcuggucuugaacucccaaccucaggugaucugcccaccucagccucccaaaguggugggauuacaggcaugaccuacugugcccggcccgaaacuuuuuuuuauuaauuugggaguuuguuuugcuguuuuuaagugcuaguuuaaauaguucaguuccagaauaucugguugacuggaugaauguuucaccugccauccuuaucucuggccuauuuuagacacagccuuuguaagaacugaagaugcuauuucuuaccagguauuuguggguaaauuuuuucaaccauguauucucuuaaauuccuuggcauuucuccucuaaugucaacaaguacucgaguuucacuggaugaaaucugguagaugagaacuggacucggguuagcuaaaauaaguucagcaugauuugcuuuaaacuguggugcauucuaaaacaaauaaaaagaaaauguuuuaauaauuuucaaauuucaaguuucuuuuauugaaauuacaauaacacacuccuacaguaccuucauaagaaagccaacaaaaugagaugauacagaaacuuuauuggagaccaggcuuuuccugaacuuggagaaaagcccaucugcaacaacagucaguggagcauggaguuccuauaacagaaaugaagacuacucaguuuaguagucagaaacacacaguaaaaaaagccauucuuaaaaaaugugcgugaagagauuuagauauauuaucagauagcauuauagagaguaguugaagauaauacuauugaagaaacuguuacgugggcuucagauaacgcaugaccaguguuuagauacuuccucugagucccugaggaucaucucccuuuguagcccucccaugcaaaccaucugggauuacucuccacuuugacagacaaugggggaaacaacuacaaggcaggcauguaacacagagcagucaaucucauuacaaauucaagggacuagccagauucuuucauucuaaaauuuccuaacuucauauagugcuuuuagucagcagcuagggcuuagaagaauuuuuguacaaaugacuacauguauuuauaauacuacaguaugagcagagaaaacauuccagucaccuucauuagaggacaauuucuaagaggugguaacccuauggggagcaguccagaauuacauguuuuuuacuacgauaauuuuuuuuuaaaaaaaggaaaaauuggccgggugcgguggcucacgccuguaaucccagcacuuugggaggcugaggugggcagaucaccugaggcuggaaguucaagagcagccugaccaacauggagaaaccccgucucuauuaaaaauacaaaauuagccggaugcggugaagcaugccuguaaucccagcuacucaggaggcugaggcaggagaaucgcuugaaccugggagguggagguugcagugagccgagaucgcaccauugcacuccagccugggcaacaagagugaaacuccgucucaaaaaauaaaacaaaauaaaauaaaauaaaauaaaaggauaaauuguuuuuaaaaagauucucuuacuauuaccugaguuaaauugcucauuuuaucugaaucauuucuuuuauguugaaucuugccuucuuuccccugcuaguuccccucugcuucucugcugauguauauuacuguuucaaaaacuauucacauuaguucuguuuaaaauguuuuuugcauagcauucugaaguccucuaaagaacaauguguugcaaucugaaacccauccuguugcauauggcuuagaaagaacucaguucauuugauaaauaacacaggcugaguaucucuaauccaaaaaucugaaauccaaaacuuuuugagcaguaaugugacaaacaaaauacucauuagaucauuucaaauuucagauuuucagauuagagaugcucaacugguaaguauaaugcaaacaucugaaaaaaauaaaaaaucugaaacacuucugaucccuagcauuucagauaagagauacucaacauguaaaccgguaagccuacuuuuuuaaagggguaagugaaaaagcaggaaaaacaacaucucuuaggaagaggugacauuugguauuucucaccuugauaucuccagucucuuuauccuuguacugaacucccaucacaacaucaucuuccucuaauaacuguaacacaacaccuucaauaaacuuugcacuaaagaauaaaaaaaaauacauuucuaaagcagcacauuucagcaauuuaaauuaaauauaaauuccuuaucuccaguuuauccauauaaacuggacaugcaugugugugcaaacacguguccaauguguguuuuuuauuuucuaauuuaucaacauuuaauacauauuacuaaugauuacauuaguaaucauuaguaaucauuaaauauuuuaaaaauauuuuaaaaaguaacauuggauuuucaucuuaauuuguuaaaaauaaauuaauuuguuaaaaaauaaaauauaggcagagaaacuuuacauacccucauacauucauacacagaggggaaaacaaguauuggaaugcauccugcaaacuguuaagaguaauuauuucuggcagggcacgguggcucacaccuguaaucccagaacuuugggaggccaaggugggcggaucacaaggucaggagaucaaggccauccuggccaacauggugaaaccccgucucuacuaaaaauacaaaaauuugccaggcgugguggcaugugccuguaaucccagcuacucgggaggcugaggcaggagaauugcuugaacucgggaggcagagguugcagugagccgagauugcaacacugcccuccagcccgggugacagagcgagacucagucucaaaaaaaagaaagaguaauuauuucuagucagaaagaucacagguaauuuuuauaaucuuuauauuugggacuauuuuuccauuuucuuuuuuuuuuuuuuugagaccaagucucgcucugucgcccaggcuggagugcaguggcgcuaucucggcucacugcaaccuccaccuccuggguucaagcaauucuccugccuuagccucccaaguagcugggacugcaggugcgugcuaccacgccuggcuaauuuuuucuuauuuuuaguagagacgggguuucaccauauuggccaggcugguuuugaacuccugaccucgugaucugcccaccucagccucccaaagugcugggauuacaggcaugagccaccgcaccuggccgauuuuuccauuuucauacagugaacauacucuucuuccauggauaucaagucuuuuuaguccaaaggauuaaguccacuugcuucuucacuugcuuugucaauacuuuagucugugucagucacaugaggguucucacgcuuaaaacuucuucaauuaguguuuuaaagguuacugguaaauauaaguuaauaaacaagagaagaagccaguccuaacagacugggucuuuagugagaaugaaacagggauuucuccuugcaguuuuguauccugacuucuaauagaaaguaucguaaccacaaacucaaacuccaaaaugugcacaaauggacuuaugccuuaguuacaaauauauccucuaaauucccgucacauaaaaauuauguaauuuucauuuagucaaaggagaacucuucauaguuccaugucaaaggaaaauucucuauaugauauucuuaacaaaagcacugaauaucuaacacucuuuugacugacaguuuauuuuaauauacauauguucuagacuaugccccaaaaauucauuaaaauuuauaaaaucuuauuuguacaaaggucaaauuuaaaugcauugauucuuuaguaauuauauauuugaaacuguggucuuacuugggcucugccauagcugcuuuccggagacucaugaugaaucuuccgugauggaaagcucuuccacucugcacuugauuguuuucugacagaggguaaggaaucugaaccucugauuugcuuuccugaucaugaaucauguaaccauuuacaaccugggcaucaagaccuuccacuguaucugcaaagcaaucgaguucaaaacaaucaauucuguuaacacacccagcguuaaacuaagaaccaaagaagacacacacacaucaaaaaugagucucugccuucaaaucuggagaacugaacaaaacuaauguaacuauuucagaaacugugaaugcuucuggaagucaaugagagucuuagcaaaucuguaauaucauuuaaagauaacaacauaacuauuucaggucuguaauuccacuucaacuucagaaagaaaaugcaacaugaaauaaaccauaauccucuccugaguaaaccuguucugccauaaagacauaggaacacauuuaguccuucuuaacacuucuuucaauguaugaauauguagauuugucaccaaaaagaaauaaaaauaaaauaaaaccaguauggaaacucaaaaaaaaaccccaauuuauauauaaugacugaauauaugaaaaaguagauuuuccaaaccaaauggaaaggguagaguuaucccccaacuguugaugauuacauacuauccauuaaaagugacucaggacaaacugcaaagaacuuuuuaguacaucaaauaauuuaaauggcagcaaacaaaacacugaauucaucagaaucauguaaaaacuucuuucuuaaaucuaaagcagcaaaagcaguugaaaaauaaaaaacuuucaauagaaaauaucacauuuuuaaagugccaaccgaaaauuagaaaguuaaaaaauuaauuuuaaaaauaaaaacuaaaacaauacuuugggaaagacauaugaaauagaacaaaagauuaauacauguauauauaauaaaauuuacucauuaaaaaccacuggaaaaauauuaagacgccaauaguaauggacaaaaacauguauggaugauucauauaaagcaauauagaaacagugaacaaaucagaaaaaauguucaaacgauaaaaaaaauuaaguaaaaauugaaacaacaggacaccaucaaaaucacugaugagauuaugauaaaacugauaaauucauauacuacuggugauacuaugaacuaauauuauauuuuagaaaauauaacaauaauuaucaagaaccaugaagaaauuagcauccuucgauguaauaaucuuacucuuggaaauccauguaagaaauucauccuaaagacauaauauuuaauaaucuuuaaaguuacaugcaagaauagguucacuauaguguuaccuaaaaaaggauaacugaaaauaaccuaaacauucaucuaaguuugaaaagugaaguacauuaugaagucaacugaaaaacaacuaugcuugggcuuaaaaagauacugauaaagaaugguuaacaguauuggaaauauguuucugucaagugaaaaaguggacucuaguauauauauuagugacauaaaauguucaaauaugguauugacuggaugucuguguccucccaaaauuccuaagcuaaaacucuaauccccaaugugaugauauuuggagauggagccuuuagaaggugauuaggucaugaggguagacucucacgauaggauuagugcccuuggaaaaaaagacaggggagggcuugcuucuuugugucucucccaccuuccccaccccaccccaccccaccaccccauccccacacaaaguagacagugcauaaauauuuccuaaaugaauagccagugcuuaaaaagcacugguugaauggaugaauggugcuuaaauaaaagauucuaaguaauaacacuguaacaaguauacaacauacccucuacaaaugacaguucccuucgccuuucacaaaauuuaaugcccucauucuaggauuuuccaguccuuaauuuugaccauuacaaucuuuuggccauuuuauuauaucucauuaagucuaauucacaucuaaucauacuauuaaaugcuuauuuuauccuuugcucucacuuucaugcaaauuuguugguaaaugaguauagaaaauuuuauaaaugaaaauaaaauggaauaccuucuuacuggucauaggauggucuaagugaagagugcuuguucauaccacguaacucuccugaaaaucaauaugaaccuaccuccaagaccaaggucuuugagaacaugauaaccacccggcugcaggaauucuccaacuauucugucaggcucuuuuaagucucucucaaugacugucaccuuucuuccaucucuggaaagcacagcugccaaagcagagccaagcacgccagcucccacgaugauaacuucugggucauucugagaagauguugauguacaggcagcuguuccuauuaagcuuguuucugaaauauugguuccuuuucugcgcuguuuaaaaaaaaaaagguaaacuagguauccaaauuuguuagauucaaaucaugcuaccgcuauguggacacacuggacuuuugcauccuaggcuaaagcuagauacuaaauauuaucaaaccaaacaaauuguuacauuuuaaaaucuagauaauauauaaaaaucaaugauaucaaaauauucguuaaauaaaagugugucauauuaucccaauaaaauuaaauauuuauuguuuucuaaacaugauauuuggaaaauguuauacagacauauuuagaaauccacacugggccgaauauaauaaauguuuauaaggggcuucaaagacuuauuauagggcaaacuguaucauuaauaacuaaauucuucaaauauauccugggaaucgacaagaugcaaaucacuuacaacuucugauuugaguucauguuacaaacuauucggcaccuuuuagacauuuucuuuuuuuuguuuguuuuuuuguuuguuuguuugagacugaguuucacucuuguugcccaggcuggagugcaauggcgcaaucucggaucacugcaacguccgccuccuggauucaagcaauucucuggccucagccucccgaguggcugggauuauaggcaugugcaaccaugcccggcuaauuuuguauuuuuaguagagacugggcuucuccauguuggucaggcuggucuugaacucccgaccucaggugauccuccugccucagccucccaaagugcugggauuacaggcgugagccacugcgugcggccuuagauauuuucauuauucaucuuuauuuucucuuucuggauuuucauuugaaaaaucuauguuaauuuaauaucacuuuuauaugacaaaaggauugucaaauccugccuaccaaucuauuaauugaagauuaucuaaauaaacaaaauuacaagagaagaaauaacucauaccgacucuuagauuugacuuguuuacaauuuugguccuuaacauauaagcacauauuuaauuuaucccuccuuuuuccccauccugauacucuaagagauccuagucaaagaggugguccccaaaaaaggaacaaggaaaaacauuaaaccugucacuggcugaacugacagcaaaacuuuaacuuugaucauaaaaagaugcaaagucuuguuuugagagauuuaugaccacuaagaacaacagugcacaguggcuuuuuaaaaugaacaauucaauuuuguaguauuucuucuugguagauggauucacacauuugaauacauuucagauacagaauugcaaggaaccaccuuccuugaguucuuugaccuuaaugauuaagauaagacuaaaugccauuugaagggguuuuuaaaaaauaaucaagcaaaaaggaagacgaagccuaaaauccuuuagaacuuuacucugugauucuaauauccacccagcauucuuuuaccucuauaguggacugggaauuugucuauucuuuuuuuuuuuuuaauuucucucagaaaaauacuuuucuguccuuuuacuaugggaagaucucaauauucuacucuucccauuaguaugucuuaauggccagaacugacuauauuuaaauuacuguagggggcaagacaagccccuuuugucaucuuaaccaaaaaugugcuucuucauaaguuuuuccuguuuuauauacacacacacacacacacacacacacacacacacacacacccugaaaggagagcucuggaggaaaacaggccuugcagagccugaucaguagaguaagcacuaaugggaacuuaguagucaauagaucacaaucuaacaacucccugguucacaaaaaaauaaagagaaagccuggggcguucacaaaauggaaccaauauugauugcugguaacccaauuuuccuacuccaaaauuucucuacacagcaugaaaacaggaacagcauuccagccaccugaacuagagcucagugaccuuaagggaaauuauuucagaccacaauacaaaaaaguucaaauuaaacauuaaggauucucucucccuccuuucccauuccucaaacccaugcaccaugucacugaacucagcgcuacucauaaagcucacccuaagagauguauauuaccccuaggcuaauauuaacagcuacuauuaucaggcgguuauagacuagguauuaacuaccagcaaggguggugccauucccgucuaauggaagagguaacagauucucacagaaauuaagcaauuugccaaagaucucacauccagaaaugguggcgcaaaaauuuaaaaagcaagugggcguuuacugcuauagucucuugccugauagcccugcuuccauucuuguacgccuacaacccauucuccauacagcaacugcaauguucuuuuuaaaagguaaaagucaggccaggcgccguggcucacgucuguaaucucagcacuuugggaggcugaggcaggcggaucacuuaaggucaggaguucgagaccagccuggccaacauggugaaacccugucuccacaaaaauacaaaaaaaaaaaauuagccaggagugguggcgugcaccuguaaucccagcuccuugggaagcugagugaggcacgagaaucgcuugaaccagggaggcggagguugcagugagccgagaucacgccacugcauuccagcccgggcgacagagcgagacuuugucucaaaaaacaaaaauuuuuuaaaaaguaaacaccgaauaaaguuacucccauacuuaaaauccuccaguguucuugggagaacucuugggaaaaagcccgaacacucauugccaacaugcccuaaaugaucuggccuaaacucuucccccucaucuucucccaguggccgccucugcucccuuugcaggaaucccaacuacacccuuauuugaagaccuggccuuuauguuaggacauuacuacaagcauuuacucaaugcuccaauauucgggggaggagaacuuugagcccaaugccucaaaauguugagcauucuccuucugccugcuuuucaaacuguucugucacuuuccccagucagcugucacuucuuacaagcaguggacuuacccgcagcacguuucuuucuuccucaggcacaaauccaauccuuacccaagaacuuuuuaaaaacuuuuucaucauggaaagugguuguucuucuccuucaaaaugaaauucuaacauuucguuccaucuuucauaaucaaauauccaaccuccaucugaggcucaaccaaugcuaaaugaaacaaaugucuucacucauucuuaagaaggucaaagauguaaccaaggcacagcagaguuuaaaauaaaaaauacaugagaauguauacaagcaucuaaccugccgccuuuugcaauucaaauaaaacuuauauuugagugaacccaauccuacuccuaaauaagacauucaucugcccgcuuugaaaucaaccuacccuccuggccucgagcugcuccuuauuuucugauucagggggggauuuggcccagaagaagccaaugaaaggcaggccugagagaauauccgagaagagggcgaacugggagccgcucugcuggcgcccgaggagacccccguuucgguggcgacagcgguaggagagcaccaggcccagcgagaggaacaccagcacgcacaacaggaccucccuguuggccaaagugaugaaguccccgaacuucuuauaaaaauaggugaaaguggcaaugcccagaaaaguccacaugguuccaaggcuucuuugguggcaccggucaaggcggagauuaucugcucgaguggguuuaagguucuccccaaaaugagguaccaagaggagcacggagagccggccagacuccaguaaacagugucccaggacgagaaguccgaucagaccaguuuuuaaaaaucauauaaaguuaguguaaaaguaugugaagccaaguuguauagggcguagaaagcaguauuuaaaaaucgccugcuggaacagcucccgagcagacucgcuccuccucgcccaggaaauccagauauucccuuuuuuucuuuuuugaugguguucccugagcgguugcugcgggugauggauacucuucugauacuggcucuucgugcuauaauuucuuuucucaccaagagcaggugcccuuucagaagggaaugggaguggagggagggucacagaaacaccucggcacugggggaaacguggccuagccucuggcgacggcgagcagcggccggaaggcacgggggcugcgggccggcgcggguucagaggcuucuuuuuccgcggacggagacacuguacagcccaaccucgggaaaacgccaacgccgacgccuucuccaacaaaagauggccucggacucaagagugcggcuccagggcaaugcagccccaaccuaaagauuuagaggccucccguuucgcuggcccccagagccgcccaccgcgacugcacuuccccaccgauaaaaggugguuuccaggguaccucccucagauggcggcggcggcucccgacggcuuccucaccagcaucccucgcgggcggcggcucucgccagcgcggcgcggccccaguaaccagaguaaccgucgcacgcccccacucgccgccaggcuccacgcgucucagccagcugggcgggcucggcccagacgagggaccg

SEQ ID NO: 17783 - RNA, 275298 nt, Homo sapiens
cucgccggcgacggcugaugacgcaagagcccgcucucacuuuucagcggcaggcgaagggggcugaggaaaggaggugggucuaggcaggggaaauuggggugccaccagacggagacagcuuggacuaccagguagggaagaagcgggggacggcaauggggaggguggcaggaguuucgccacccucagggacacuccacggggacuccgagccggggguccgucuacccggauuaugguuguggaacuuuucacgccacgguagugagucugggacaguuuacccuccuguccgagacgccaucucuccauccuuucgccucaaguguguaggggcaagauuacgaauuuuugauccaaauagauuuuguuugaacugacuuuaaaaguaaggccacgggaaggucguuugaauaaacucucuggaccucaauuuccucuucaguuauguagauugcagugagaauuagcgauaaggagaauaaagugccgggacaccaguuuauggcauucuguaggugaccgagaaaugaugaugucuguuguuauuuuuguaacuggccaaaucuuuauugguccccuauuuugugugaggaauugcuuuauaugcaauagaauaugucaggguucuaguuuaaggaggugucaguuuaaagaagcugcagacaugugagcaaauaguugugaugaguuucauaauaggaguguguuguguacaugugcaugugauagggauaaugguagcaugagggagggaaaagcaauuguaugagaaggauucagagagaagggauuauccuugcauguugaaaaaggagaggcagcucuggcugacuuguacaaggcucccauggauuuaaaggaagucaacauauugucuauaaauaacaugcagagaaaaaacucaggaaaugcacaacuuguucuaaacuuucuuggagaucauagguaccgggaagaaaaagaucaguguuauuaccuggggagggauccaagagagauugauuuaaaccaguuauucucaacugaugcacuauugacauuuuaggccagauaauuuuuugcuguggggucagggugagggcuguccuguguuuuguaggaugcuuaagagcaucccuggccucugcccgcuagaugccaaccacaaagucuacagauacugcuaaauguccccuugcgagagggguaaaauccuucuugguugagaaccacuuaaaccaagccaugaaagaugguaucuuagucaaugugggcuucuguaacggaaaugccauaaacuagguagcuuaugaacaacagaaauuuauuucucacaguuccggggccuguuuccugguucauagguggcuucuugcuguguccucacaugguggaauggcaaagcagcuaucuggagcaucuuuuaaaagggcacuaaucuuauucaugaaagugggccucaucaccucccaagaggccccaccuccuaauaccaucaccuuggaaguuaggauuucaacauauacauuuugggugacacaaacauucagacuuuagcauauggguaagaugugggcagauagaaaacugaagagaggcccuggcacaguggcuuaugccuguaaucccagcacuuugggaggccaaggcgggcggaucacuugaggucggguguuugagaccagccuggucaacauagcgaaacccucucucuacuaaaaauacaauaaauaaauaaauaaauaaauaaguaaauaaauaacauaauugguguguccuggcacacaccuguaaucccagcuacucgggaggcugaggcaggagaaucccuugaacccaggaagcagagguugaggugagccgagaucaugccacugcacuccaguuugggcgacagagcgaaacucugucucaaaaaauaaauaaauaaauagaaagaaaacugaagagaagguuuucucauggugggagcaggaugaggaaaaguccucuuuuuccuuuuuggugacagcgucucacucuuaucguccaggcuagaaugcaguagcaugaucauagcucacugcagccuuggacuccuggacccaaggaguccucccaccucagccuuccgagggucuaggacaauaggugcaagccacuaugucuguguaaguuuaaauuuuuuuuuuuuuuguagaguuggggucuugcuguguugcccaggcuggucuuaaacuccuggccucaagcaaucuuccugccuugcccuuucaaagugcugggauuauaggcaugagccaccacacccagccugaacaaagucuggagcugagauuaagaauauuggguaugaaggggagaaggaaacaggagagcuaugaaucugacugaagcagacaguuaauuuauucauuuauugacuauuuucagagcacuugcuguuugugaagcacugcuaacaucuugcaagauagucacuaacaaaguggagugacuauaauuauaauuauaucaaagaaggugcuguuagagucagagaaaggaguugucuuugacuuguacuuagcuguauuuauugggagagauugagaaaaguaugucuguuccaucuuucugcaccauccauugccuuugcuuuucaauucaaucucagucuuaaucuuuucccuacuccagaauuacagaagagcaugaucguguuuuccuugguccucugcaaaagugaaguuucacuaaaguaaugugaguuuugcauucaaacaaauagugacagcuacuguuugguagauacuuuccauuuauacuggauugcauuaaucuucauagauacugugucuuuguucaagcuaccauaacaaaauaccauagacuggguggcuuaaacaacagaaauuuauuucuuacaguucuggaggccagaaguucaaggugagguugccagcauaguuggauucuggugaggacuuucuucuuggcuuguagauggcugcccuuuuuaugugucuucacaugguagggagagagagagagagcagucccuggcgucucuuccuuuucuuuucuuuucucuuuuuuuugagaaaagagggucucgcucuguugcccaggcuggagugcaguggcgugaucauggcuuacugcaaccucaaccucccggcucaagcgauccuaccacaucuccuccugaggagcuggggcugcaggcccgcaccaccacauccagcuaauuuuuuauuuucuguaaagacagagucucacuuuauugccugggcuggucucgaacuccugggcucaagccaaccucccacauuggccucccaaagugcugggauuauaggcaugagccaccuuuccagccagguuuuagauaaucaguacacaugugccuagugccuaucauauuggacagugcagauuauagaacguuuucaucacagaaaguucuauuggacaaugcugcucuggacaauuuagacuuacacuagaaucaagacugaguagaaaacagaauacuucugcugaucauggugucucaugccuauaaucccagcacuugagaggccgaguugggaggaucacuugagcucaggaguuugagaccagcuugggcaacacagggagauggucgucucuacuaaaaauuaaaaaagaaaaauuggccaagugguggcgcgcgccuguggucccagcuacuugagaggcuaaugugggagaaucacaugagccugggagguugaggcuguagcgagcaugaucaugucacugcacuccagccugggugacagaacaagacccugucucaaaaacaaaaagaaaaccgaggccaggggcaguggcucacgccuguaauccuagcacuuugggaggccgaggccgguggaucacuugaggucaggaguuugagaccagccuggcaaacauagugaaaccccgucucuacuaaaaauacaaaaauuagccuggcauguagcucccagcuacuggggaggcugaggcaagagaauugcaugaaccugggaggcguagguugcagugagccaagguagugccacugcacuccagccugagggacaagagcaaaacuccaucucaaaaaaaaaaaaaaaaaaagaaaagaaaauugaauacuggaauuauaucauuugguccuugcagguuuguguuuuuugauuaauacuuaguacuguaacagguaaaccccacaagucuaaauggcuuugcccaguugaaguuucuuucaugcauggagccugauaggugaguaguuuuccuccaagcagugauguagggccuugagcuccuuccaugcaguaauucucuaucaucagcauauagcuuuacuaaggucccuaugcuugccugcaucaagcuaucaaaugggaaaauguggcuuuuugcagauuaggccuggaaauggcucacauuucauugccuuggguacagucauaggccacagcuaacuucaaggaaggcuggaaaauguggagcauauauaggcauguaaccggguugaagaggaaaugguuuuggugggcaccuguccaguaucugucacaaguguuuuguccuuaccugcccugagaaauagucucaagaaacaguccuagaaguuugcuauugcauuuacuauaaggauauuuuugaggauuauuuuuuucaguguaacccauuaucucauauaugaugauccauacuugccuugauugccauggaaagcuuuauuuuuuucuugaguuucuaguguuauuuguuuuuuuuuuuuggagaaaauaacugucacuuuuuguuuugauugugaggaagcucacuaccaaauguguauuacuaguacuguguggaauccuuuuuuuuuuuuuuuuuuuuucauacggagucuuuuugugaucucagcucacugcaacugcugccuccaggauucaagcgauucuucugccucagccucccgaguagcugggacugcagguguguaccaccaugcccagcuaauuuuuguauuuucaguagggauggggcuucaccauguuggcugggcuggucuugaacuccugaccucgagugaucaacugccucggccucccaaagugcugggauuacaggcgggagccaccacaccuggcccucuguguagaauccuaaagugugcgugacuccauuauaacuuucucauaugcuugguuugcccguaaauuucuguuuuuugauccugguuuuucugaauuuauguuuuuccaucuuuuuguguauguuuguauuuauauuguguaaaaugucucaacuuguuugguauaauacagugagauuguaaacaagcagucucuuucaaugcaaauguuugaagaucaucauuggcuuuuauuccuguuuguauuuuuucuuuuuugauguggaacuguaaagucccagaaaagaacacaacaagaacccuuguuucaucacccagauuuuaacaucuuuaacauuuugccauauuuguuucaggucuugauuuuuaagguaaaguuuugaaaauacauagagcucaaauuuccaugaugaccacuagacccaacuggagugaaucuuuauccuguacuuaaggcugucuacacuauauucccaaagaaugaaauccaguuaucuucccauuccuuuguaccuguaugccaggcaaagggaacucaucucaucguuuacuaccuuaugaucuuuuuucaucucacugcuuccuucaucugaacagcucucccugauaauuuagaccuuuccaaauccugaguaccuuuuaugguccagcuuaagugccuucauuuccgugaagccuaugucuccccuguugugccuauaauccuuuccuuucuugaacauuguagcauaguggguuuguguaaucgguuucuuuuuucaacuucauaguacuugguucauucuuuuaauauggaacuuguucucugccaagccuguuuugagggguuguggcagaaaggaguuauguuuauucuggaauaucaaauaguuaagguuauaugaaauguaugauuuaagucuuggugaaaaguagaaucucugauuugaaaagcguguuugcauuauauuguagaaagcuuuggauacugugcuaauuauguugaauuuuauuauauaggcaggagggaguuaggaccaacccuuccugcuuuuuucugucuuuauuacuggcaucucugucuuauuagcaagcucaaagaccuuaaggugaagcaugccuggguuauuaaaggacuagcaauggccagauaauguagaacaguggucuucaaaguguaauucuuggaucagcaaaaucuacauuaccuggaaauuuguuagaaaugcagauucuuaggucccuucccagacauacugaauuagaaauucugagggugagguccagcaaucaguguuuuaaugggcccaucagaugauucaauacacugacacuacaugucuccuagauauaucagaguuagaauuacauagaggacuuguuaaaacguagauuguuggggccugagaauuugcauuucuaacaaguucauaggugaugcuggugacacuuggucaggaaccauuuggagaaccacuauugucaguuauuacgaagcucuuuggccauuacucccggugagucaggaaguccuuaggaguuuuugagcagaggagucacaugaucuuacguacauuuucaaagguuuacucuggcugcuguguugagaauaggguggaagaggcaagacugagagcagggagaccagguaggagacuguuggaguaauucaggcaagagaugaugguuugaaucacgguguuaucagcagaauuggugagagugguuggauucuggagauaguuugacuacagagcuggcaaaauugauguugaguuugguauaggauaugaggggaggaggagaaggaucaaguaugaaccaagaguuuugguucaacaaauggaaggauggaguugcuauuuaguaagauggggcagguuguaaaaggaguagguuugggggagggguagggugggagagaaggaaugugggccuuccauguuggacguuuuaaguucuggagugaucuugccaaugguauuuagauggaaugggucuaguugggaacacuagguggaugggagaggauggaaaagagagaucagagcacugagcccugggcauaccaccuauacuacaguuuuggagacaugugcuguuuuaggugcuggagauacauaguauuacauucauuccuucuuucagcaagccuuuguugaauggccacuaaugugccaugcguuguuuuaggugcuuggaauacagcagugaacaaaacagaaaaagucaaaaagucuguaaguuuaaggaacuuacaguguaauuggggacuagacacuauaaaccuaauaaauacaagaaugucguuuggcaauaccugccuugaggaaagauaaagcagaagcagaagggugggaaugccuggggguggagauugggagggcuugccguuguauaucagauggccagggaaggccuuacugaugaggugauacucaaagggagaccuuagagaaguaagggaauugaccuaguagauaucuaggggaccaguaucauggcagagggaaccaagaaggcauagcccugaggcagggcuguauuugauuuggguauagaaggagaagaaaaagaagcuuggauucugaaccugggacccuacaacauauggagcucaaggagauggagaggaaacagaaaggagaaugagaacaagaacaagguaggcaggugcagaaagugcaucaggaagggagugauuaacuguguugcauacugcuggcugauaggucaaaggagauagggcugagcauugauaacaaauuuaacauuaagucuuuucaggugaccuugacaagagcaguugcaguggagugauagagauggaacccuaguggggguggguuccaaagggaauggaaggagaggauuuggagacaaauguauacaaaucuacagacgaguuuugcucuaaggcugaguagagaaauggggcugguaaccagagggguaagugggaggaaagucggaggauguuuuugagaugggagaaguaaugguguauuuguuugcugaagggaaugauucaguagagagggaaaauuuaaugaugcaggaaagcagggagaauugcugggagaaugucuuagaguagggagggagggauaggaucuaguggauaauuggaguggagguggccuuaucuaggagcaacaguuuauucauuuuaacaggagggaaagcagaguguaugagaacugaugcugauagguggagagguaagcggugggagcuugcaaaauuucuauucugacugcuucuguuuccucaggaaauuaggaaacuagaucuuucagugagagugaggauagaggaggaaguguuggaaguuucuagugagaggagucguaaaagagcauaauagaaucaggaaaagucaaguauugucuuauguacucugcaaugauuugugcacuucauuccuaccugccuuuuccuuugccugaaugcccuucuccauuacccuuccaucuguuaaacuucgucuuuuauccuuuaaacucaguucuauguucccuucuuugauccagucaggcaaaguugagcauuuucuuaucugugccucagcuuugcaguaacucccauguugcuuuaauuaucagguuuauguuuuaucucugucucuccuacucaguggugagccccugggaguagaggcugaauuuuuuuuauuuuuauuuuuuugagaccgcgucuugcucuguugcccaggcuggagugcaguggcaugaucuuggcucacugcaaccuccgccucccagguucaaacaauucuccugcccagcuucccgaguagcugggauuacaggugcccacuaccaugcccugcugauuuuuguauuuuuaguagagacaggguuuugccauguuggccaugcuggucuugaacuccugaccucaggugacccuccugcuucagccucccaaagugcugggauuacaggugugagccauugcgccuggccaaaggcugaauauuucuagugccugggauagugccuggcucaugauagguuuucaucaaauuagaauaacaaaauaauucuuuaaaaggagagugucuuaagagugcucaucuugaaaacugugguauucucaugcuaaaggaagugccuggcacuuaaagagauacuaaauauuugaacugacaaugaguuguacuguggauguuugagguaaacaaacacuucaaauuagaaaucuuaugcaucucugugcaucuugcaugucucuaugcccuucucuuuuuauauccuguggauuuuugaaugggucucaugauugacaugguagguacucaauacuuaugagugaaaugaaugaaugaaccuaauuaaaaaggacuaauaauggagaaacuacaauaguaguucagcugugagaugaaggugguagcaaugaugaggauggaaaugccagagauacuacacaguuccccacuuaggaagggcagaagggaaggcucuaaugcuaauuaauuguguacuguaugcuauaccauaccaugguuauuccuuuccauuuuaaagaugguaaagcugagauucagagauguuuagcagucuucauguuaugucuaucugauuccaugaaaauaccccuuuuucugcugccauagagccuuguuaauagcccucccaucccuuuaaaacugugaauucuccccacuuuucuaguugguuucaguggauugaguuucaaauggcuucugaauuaagcagagauguccuuuuguaggcagcuuuacauugcuuuacuaagcugaaacaaauugugguugaagauauagauuaggaaguguuaaauaugaagguaauaacugaaacuguuauaguggaugugcugccagaagacaaguuuauacagaaauucugcuuucacugacucugggaucucaccaagucuauuaaucuguuagaagccagaggaacuggcaggaauauagauuuucucuuuuuuuuacaguuuccagaauucaguaugcauauauguuggauaguuuaacgauuacagguuuucaaaauaguuuacuaauaaacuauuuuauuaguauuuuuuucucuuuggaaaauugcaucauaugaguggucuacuuuuucuaacccauuuaucuuguaggcuuuuaagaacugugcuauuguugacuucuucacagaaucaagcacucuuuuggaagaggguaaucucucuccaaaaacugaggacacuuaccuuccccauauauugaguccagcuguguuugguggcccaggugaguggcacagugauuuggugucuucucuauaggauauacagaauaguguggcauuuaugagauauuggauacauuuguaugaauguuuacagcaguuuuauuaauauuuuccugugcaguuauuauucugacuuacgaaucuuguuucauuguguuugaaaacuuagguacuaauuucaagaugccaggacguuccaguucaaauucagguucaacugguuucaucuccuucagugguguagagucugcucucuccuccuugaaaaacuuccaagccuguaucaacucugguauggacacagcuucuaguguugcuuuggaucuuguggaaagucagaguaaguaaaauuaaaaccucuuuugugucuacuuugagguaacacuguguggugguauuuaucugggggugccuuuugaguauccuugggggaaugauuuaaccccucuaggcaucuguugucucauuuuauucuacacaccgcagcaggguacugagggugaaauaagauugacucauucauguguguucagacaguuaaguuccaugagaaacugcgcuagaaauguaugggcaaagauuugaagauccugaccccaaggagcauacaaucuaaaguauuugacauuugugaacuguaagguauauaaauuuauuaugauauuguuauuuuucaguaguuuauacuuuggucauacuugauuaaccaguagauagacuaagcuuaugcuagggauaccagcaaaggaaggccucaacaaaaaugagaaaaguucaacuuuaaugaauuuuaccuacauuuguucaaucaagaagaucuagaaagaugugauuugcaggccgggugcaguggcucaccccuguaauccuagcacuuugggaggccgaggccggcagaucacgaggucaggaguuugagaccagccuggccaauauggugaaaccccgucucuacuaaaaauacaaaaccaacauggugaaaccccgucucuacuaaaaauacaaaaaauuagcugggugugguggcaggugccuguaauuccagcuacucgggaggcugagacaggagaaucacuugaacccgggagguggagguugcagugagucgagaccgagccacugcacuccagucuggacaacagagcaagacucugucucaaaaaaaaaaagaaaaaagauguuauuugcuuucuuuggaguagaaucguuuuuauuuuauuuuacacauggagccagaggagcagcaugauccuuuuguuuuguuuuuauuggcauagguuuugagcaauuugugaugugccguggugugauuuuuuuuguccugacugauauuguuugagauuuauggaucugucagcuuauaguuuuuugaaucaaauuuggaaaaauuucugcuacuauuucuucaaauauauuuuuuuaauuccucugcucuccucuccuucugugugacucacauuucauguauguuagauggguugauauugucccauaaaucaguggaacuugauagauuuuuuccagucuuuuuacucuuuagcuucaauuugaauaauuucuauugcuaaguucauucaucuugucuacugcagugucuaaucugauaauuccauuuagugaauuuaaaaauuucaguuacuguauuuuuaauuguugaagacauaacaaagaauuaaguagaaucuuuuuuuuuagucuuccauuucuuucuucauuguguccauauuuuccucuacauucuugaguauauggagcauguuuauaauagcuauuuuaauauccuuguauguuaauucugucaucucuauguguauuauguuguugaguguuuggauuuuguugucuuuuuuuuuuuuuuuucagccggaauuuugcucuuguugcccaggcuggagugcaauggugcgaucucggcucacugcaaccuccgccucccggguucaagcgauucuccugccucagccuucggaguagcugggguuacaggcaugcgccaccacgcccagcuaauuuuguaauuuuaguagagacggaguuucuucauguuggucaggcuggucucaaacucccaaccucagguaauccgccugccuuggccuuccaaaaucuuggaauuacaggcaugagccuccaugcccagcuuguuguccucuuuuaaauaguguuggaguuuguuuggugugcagcuaagugauuguggauuaggcugauccuuucuaggcuuaucguuaagcuuuguuaggucaagucuaauauagccuuuauguuagggcuaauuuagccuuguuacaaagcauggcccuucuggagucucucuugauugccccgaggguucagugcgauagcucuacucuggcuggauggaauuugagugucucccgguccuagguccuacgugacugaaccugggaguuguucacuuuauagcugucaguauuuguugcucagcaucuuaggacucagcaucagacucaaggggaccccagugcagauuccuagagcucuuuaucugcauagcucccucacucucuugcaaacccugcuggcugccucagccucccugaacugaagucucugucuccucaauccuucaagacugcugugcuaggccgagcaugguggcuccuaccuguaaucccaacacuuugggaggccgaagcaggaggaucuccugaggucaggaguuccaggccaaccugacgaaacccugucucuacuaaaaaacaaaaauuaggcaugguggaggaugccaguagucccagcuacuggggaggcugaggcaggagaauugccugaacaugggagaaggggguugcagugagccgagauugugccacuguacuccagccuggggaagagagugagacucugucucaaaaacucccuuggauuccuccucccuugcgcagggaggaggccauugcaagacuuuucccaguuuucccuuauugcaguaauuacaguccugucccgccuuuguccuacugucccacagcuauuguuucauauauuuuguuuaguuuuucagucauucauggcagguggaccagcuccauacaguuauucauuuacggcuaacagcaggugucacucauaaucuuuuuaguggguggccuccaaauguuuuaacccuacccagucuguuuuugauuauguuuuuggugaucauaauuuagcuuugauagauaggccuggauaaaagucauaauaaaaucuuaaaccauaagagagaagacuggaacauaaccccuugggagauuguaucaguuuuuuucaggauucuuuuugaagauuccugggaguuuuagcuacagaguuuuuuuuuucucuugguuuuguuuuguuuuaaauaagagguauauuuuguuguaaaauacaacaugugcaauuuaagaagaauuauaaacaucauuuuuugaaagguucaugcucuaaagccaaaguuggcaaaguuuuucuauaaagggccagauaacaaauauuuucaacucuguaggccaugugguuucugucacaacccgcuguuguagugcaaaacccaccauagaugguacguaaaugaaugggcauggcuguggucuuauaaaacuuuauuuacaaaaaugggcagugggccggauuuggcucacaggucuuaguuugucaaccccugcuuuagugccgcagauugucauuaaguaauuuuuaaaagaaagauguauuuauuuuuuaauauuuggauuaauuuuacagcaaauacuugauuuugcauuuaccaaaaaaguuaauuuaagaaaaauuuugagcaaguuauaugggaaaaaaagugaacuaaacaacuuagacagacacagagucaccaggagccuggacuucuuaugaacucaauauguauaugaauacaugcgugugugugugcauacacacacacacacacacacacacauuuuaacuaauaccaggagucaaaauaacaaaguagucaacauaaacuaaccaagugacuauucugcauauaauucagcucuagguuuuaaagaggacauaaacaaguauuaaguaguucuucccuucauagaguuuaccaucuuagugggaagacaaacacauauuaaaauacuaaaacaaugagaaaacagaaaagauguuauaaagcugcaaauaacuaauaucaccacugaucuuaucagaaaagucauacgcucucaaauuuauaauggugaacacaaauuuuucaaaguucuaauuuuuucuuuaaaacuuucacuuugggcugagugugguggcucaugucuguaaucccagcacuuugggaggcugaggcagguggaucacgaggucaggaguuugagaccagccugaccaacuuggugaaaccccaucucuacuaaaaauacaaaaauuagccgggcgugguggugcgcaccuguaauccgagcuacucaggacucaggaggcugaggcaggagaauagcuugaaccugggaggcggagguugcagugagcagagaucaggccacugcacuccagccugggcgacagagcaagacuccaucucaaaaaaaaaaaacaaacaacuuucauuuuggccgggugcuguggcucacacuuguaauccuagcacuuuaggaagccgaggcuggaggaucaccugaguucaggaguuggagaccagccuggcuaacaugacgaaaaccugucucuacuaaaaauacaaaaauuaccugagcgugguggugggcgccuauaaucccggcuacucgggaggcugaggcaggagaaucgcuugaacccugggggcggagguugcagugagccgagaucacgccacugcacuccagccuaagugaaagggcaaaauucugucucaaaaaaaaaacaacaaaaaaaaacuuucauuuuaccauuagcaacaaaugcuguuaguuguugucuuugaaauuacaguugcacaggcucacuuucuucauuuuugagaaaaugucuuucagauacccaaaccugaauaaccauaguuugucugugaauuguucuauauuguacuguuuuaucaaggacauucuuuuuuuuuuuuuuuuuugagauggagucuugcucugucccaggcuauagugcaguggcacgaucuuggcucacugcaaccuccgccucuuggguucaagcuauucuccugccucagccuccugaguccugaguagcucggauuacaggugcacaccaccaugcccggcuaauuuuuguaucuuuaguggagacgggguuucaccauguuguccaggguggucuugaacuccugaccucgugauccacccuccucgaccucccaaagugcugggauuacaggcaugagccaccaggccuggccuaucaaggacauucuuaaaugaaacuagcauuuguuuuacuaugagugcuugguagagaggaauacaaugaucuauuagagugcaacaguuuggugccacugcucugauuuuugcuaaggcaccagcaguuuuuuccacaauugcuuuugcaccauuaguacaaacauucaacauuuguacuaauggugcaaauguuaaaaaagaaaaagaaaaacaaacaaacccagacaaauagcaucuuaaaauuaugauguaaauaagcuaggccugguggcugacacccauaaucccagcacuuugggaggccaaccugggcagauugcuugagcucaggaguuugauacuagccugcagcaacauggcaaacccugucucuacaaaacauacaaaaauuagccaggcaugguggugcacaccuguagucccagcuacucagaaggcugagaugggaggacagcuuaagcucagguggcagagguugcaaugagcugagaucacacgacuguacuccagccugggcaacagggccagagccugucucaaaaaaaaaauaaaaaaaauuaugaugaaaauaguuucgacccauggauccccugaaagggcccagaagaaauuacgaugaaaauaguuuugacccacggacccccugaaauggcucagaagaccacacugagaacaaacugaguuugauugcuuaugaauaggagguagaugacaugagaaguccucugcagagagaaagccaagggcaaucacucccacugggguaauucagcaagaacuuguuaggggagcaguguuaaugugauaccagacugaggugcuguccaaggacccagagaguaggaaaacaccgguuguuuaaggaaauuggaggguagaucagccuguaacaguagaugaaagacuuguagaaggcugauacuaaggcagccaguaucagcacuuaagugcacgcuugcuauuggguccaguccuaacucugucauaaguucuguaacuuugaguaagguaccuaacuucuuucagcuucuaauuucuuaucugugaaauaggauuaaaaugccugcuucauaagauuguugggacuaaugagauaauauaugcuaagugcucucagccacaauguuaauucaauagcuaucauauaugacaaccagcaauuaguaaaauuugagggucagaacuuagaagaagggccugugaugugaagaggguaagaaagauggaugaguuuggaagucuguguaagacugaguccagcuaagucacuaauucaucagauauguugccaaaacuacaaagauaaauaaagguuucuuccuuugaguuguuuacagucuagguaggaaauaagacauauacuuguuauucaaucauuaagugaacauugauggccuauaaugugaugcuuugccaaggaguuugaaccuuaucauuggaagguuuaaaguagaggaaaaaauaugguaagauccaguuuuagaaagauaacuguccacagcaguacugaggaaggaaagacuucagguggccaaagaggagauuaugucaguagcucaagugaaaaagaaaauaacuuugacuaagguauuguaacuaagguaaaaaggauuugauuugugugcuauguaucuuauacccucauuguaauacaggcauaauaguguaauagaugauugcuuggguucuuaucccagugcccucucuuaucuuugugaccuugggcaaauucucuacccuccaauuugccucagguuuccuauuuauaaaaggcauuauuguggggauuagcgagauaauauuuuacaaauuacuuagaauaguaguaagugcucaguaauuguuagcuguuacuaguaauuuggugugcauuugaguuugaguugaccgguggguguguuggacaacagagaauggauugggagagauuaaagugcagaagagcaaguggggaauuucauggauuaucccagaacagaaauacuguuuuccuuaguuuuaugagauuguugacuuuuuggguugccugauuucaucucaaaucagagugaacuuugauaaaccaaaugauaaugaucacauagguaucauuuuaucacuuugcccugacauuuuccuguuguuguauuauuaaguuauugguaaaggagauucuugcucccaagaacuaggguggugauguguuuuauuuuguuucuuauugguugcagauuccuaauuccuauaccagguguuugucccuguucaacuuucuagcuuauuugaaaugaucaccuuugccuguguuacguuagaauauauggugucuaggcaauuagacucaccacuaccauguuuauucauuuuucucuaaauuugucgauauucuaguauuaccuucuucuuugaccuaacugggaaaugaaauuuguuacauuaggagauuuuuuuugagauuaccgaagcuuauuuuuuucagguuuuugaguuuauuauguacuuuucugccaucuuacacagaauauacugaccuaauuaacuggaauuauuuuuaaaucaucuuuaaguaguuuuaguaagcgcuuuagguuuaguuaaguaaauuugaggaaucucccuucucuaaaauguuaauguaccucaaagauguaaacuacaucuuuguaguuuucaaagaugugucaucucuucucaugccucucugccagggcaagucugugaaugggcuucagagguuugguuaaugcucugcaauucuacaaaaauguaugugcaugaggauuaaaaguuuuaccagauucuugcuaaauauuugauagcaacauuuagaaguaaaggauuaaaguuuucucuauauauugcuuuucuuucugugauuucggagcuauagggcagaaagauuacaguuacuauggucaggcaguuaauuggguauuuguugagcuaugcuaaaguauggugaugaugaugaauuuguuacauacuuaacuggugcucuuuuuacaugugcuauuucauuugauccuaacaguaauccugugcaguagggacuguugcuguccccacuuuacacaugagaaaaauugaggcuuagugaaguuacaugcauuuuuuaaggucacaaaguuaguaaauguuugaguagggauuugauuauaagcagucugacuucauaguuucugcccuucaccauuacacuucauaaaaaauguauugugccagcgucauggccugugcagucaaaugacauuuagcgacguuuugcuuagauaauuuugguuguuguuguuuuuuuuuuuuuuuuuuuuuuuugaggauaauguuaucugauuuuuuuuuuuaaauacccaaaugagguugcaugcuuuuucugaaacauccucucauggaggucauguauggucauggggggaaggagcugggaccuuucagggccuuuguacugacccuagacugucuacuuucaguucuuguaauggcaggaaaagaaaccccuguuuggcuaagcaacagcucucauguuugcucuucuuugcagcugguuacaguccugacucauggaagugauucaucaaauugauugaaugauagucuguucuuucauacauccacaacuuguguucuggcuaagaaucaucaccuuuuuagaucuaguuccuuuugucuuaccuuaauccccacgcagccaaaaaaguuuucacuguguggcaguuacuucagaguucaugaugaguaaaaaacaaccagcaaagugaaaaauuacauggucagggacauuuacugcccucaugaauaacugaccuuuuacauuugcaaauguuaagcauuuccuugagagaauaguuuuaaauccgggugcuuuggggguaagauucuaguuuuguuccugaauaagacauucuuaaaucuagaaauuugguaaguaugggugaaaaaaaacucccagaaaauugugaucauccauaacccuaucacccaucaccuuauuuuaugaaaaagggauaagcauuuugcuuaaaccuuucauguucaaaauguuuugaggcugguugcgguggcucaugccuauaaucccagcacuuugggaggccgaggcgggcggaucacuugaggucaggaguuccagaucagccuggccaacauggugaaaccccaucucuaccaaaaauagaaaaauuagcugggugugguggugugugccuauaaucccagcuacuugggaggcuaaggcacaagaauugcuugaacccaggaggcagagguugcagcgagccgagaucacgccacugcacugcaaccuaggcaguagagugagaccgugucucaaagaaaaaaaaaugguuugaaaauuacuugauaauuggauaugucaauacaacugaccugauauuuucagggcuugauuuuuuagaaagacuuacauucuggauuuuucacuguguugugauauauuucuccauuagagcacugcuuuuuguuauuaggagucuaguugagucggggagauuucuuuuugaccuuguuccugucuuuuauuucauaauuauugaauagaaggaguaacuagaaguaggugguuucuaguggugagugguggccacaaugauaauaaaaauaacaauaacccuaagaagccaauguuuguaugcuuauacagcuuuuauaacuggagccaacuauaccagcaaaauagcauuauaacuuaaauuagugaagauuauuaaacauauauacuuaauuaugcuguauauaguacuaaaaguaaaaggcaaugccuacaccaggauguagagaaaagggaaacccuuguguauuguuggugcgaauguaaaucaguacagucauuauggaaaacaguauggagguuccuuuaaaaauuaaaaauagaacuaccauaugaucuagcaaucccaguaauggguauguauccaaaggauguaugucaaagagauaucugccuucucauauucacugcaacauuauucacaauagccaagauacagaagcaaaccugagugucuaucaauggaugaaugcauaaagaaaacugugcuguguauacauaauggaauauuauucagucuuaaaaaaaaaaugaaauacugucauuugcaacaacaugggugaaucuggaagauguuuugcuaagcaaaauaagccagucacagaaagauaaauagugcuugaucucacucguauguggaaucuaaagaaggugaacucauagaaacagagaguagaaugaugguuaccaagggauuggggaagggaagggugggaggacuggggaaauguuggucaaaggauacaaaauuaccauuaggaggaaagaguucaagagaucuauuguauaauauggugacuauaguuaauaacuauuauauacuugaaaauugcuaagagaguagauuuuaaguguuuucacuaccaauaacugauuuaaguaugugagguauuguuaacuagcuugauguagccauuccacaguguuuacauauuucaaaacaaaauguauaccauaaauauauuuaauuuuugucaauuaaaaauaaauuuaaaagugaauauauauuaacagaaaaugggggggggggugagucaauaccuacagaauaugaaaaauccaacuuugaaaaacucaguucuuuuuugcugauaucuuuguguuuccuaggacuguguuuauucauucauuuuaguguuaccauuguagacuuuauaguuaaguaaagaacuguugugguggcucacaccuguaaucccagugcuuugggaggccaaggcagaaggaucucuugaggccaagaguuugagaccacucugcacaacauagugaaaccuugucucuacaaacauuuuuaaaaugagucaggugugguggcaugcaccuguaguccuagcuacuccagaggcugaggcaggagaagcccaggaguucaaggcuacagcaagauaugauuauaccacuacacuugaaccugagcaacagagaaagacccugucucuaaaaaauaaauaaauaaaaauauauaguuaaauggguaaaaagaacaacuuaugagaaauacauuucugggggaggagauuaaaguguacuaauaaaaagaaucauaaggaaaauguucacaaugauguggauuagaaccugaacacaauaaaguguaaaccaaccuuucaacaccaguuuaggugugcagaaagauuuaccagaaugaaauucauaauucauuucccccgucauccucuccuuucucaucagcaggauccaccauguucacauagaugaucuguuaauaucaucuugauucugaaagggaccuuagugguuagguaaucucucaugaaugcuuuugcccauugguuguucagggacugggagcuuuucagaaugagugagguuuagcagguucuaggauuggguagaggguagaggaguagugugacaacuacuuuuaugaauuugauaggauucuucucccuuugguugugaaccaaaagaaguaaauucccaguuauuaagauuaaaucuaauuagauuuagacuuguuuuuagauuguauucucaagaaguuaccuauaagcacaugaucuucugaaaaucugaacauaaauauuuugcccgguaugucuaggcccuugaaauuuagaauugcagcauguccuucaucccacuccuuucagaaucucuuaccccuuucucugcuuuauuuuucucucgacuguuuaauacuuaccacuaccucacuuucuaacauacuguauaauugcuuuauuaauguuauuuauugucugugucugcccugaauguaugcucugugacagcagggguuuuuaucagauacccuuacccgcugcuauugccuauagguacaugauacacaguaagcacucaauaaaugaaagaauguguuuaaaaccuaacaggaaaauuacuauaaaaauuuccucugauugucuaacucauucauauauacccacacccauguucauggauuauauaugcacuccaugccuauaccccauccauauccauguauacauacauacguacauauguauauacagcagugggugauuuugcccuccaggguuccuuuggcagugucuggagacauuucuggcugucacaacucggggaugcggggagcaugugugcccuggccucuagguguucagaugcugcuaaacagccuucagugaaugggacagccccugcacagcaaagaacugugcagccuaagcugucauuagugcugaggcugagaaacucugauacacacacuaauguaugcauacauacauacauauacacauacauacacauacauagucacugguuuaaaaaaucuacuuagagaauuuuugaaauuugaaguggaaaacauaggcaauacuaaggguucuuuagguaaauaauacuuggaccuuuauugcucuuuuugcuggcaguuaaggcuuuuccuuauuuucagaguugauagcauuccucguguuucccuuauauuuuauguuucuuuaugugucauauuucccucacuggacuguauguccuugagauuaggauucccauacagccauccucaugcuccaacucucagagcuuggcaguggacuuuguacauuuuagguucucuuuaaaugcuuuuugagugaaccagucagucaaccaaguaacuaagaaauuuggguguuggauuguagaagccacgguaggaauauugacuccacccauggaaaugggcaaaugucacaaauuagacccuccccaacagcuggagagcugguuaugaagcaguuaccagcaccccccugggcauaucugacauugaagcaaauuugcauuugguagacagguuugggaaagggcuuuaaaaguaacaaagccuauauauuggaggagcuucagagucauccuuuuucuccaccagugagauuccauguacauugauuuaugucuuggaaauaugugaaagauguuucuauuaaaucuuucaggccgggcucaguggcucacgccuguaaucccagcacuuuggaaggccaagucacacagaucaccugaagucaggaguucaagaccacccuagccaacacagugaaaccccaucucugccaaaaauacaaaaauuagccaggcaugguggcagauguguguaaucccagcuacuugggaggcugaggcaggagaauugcuagaaccagguggguggagguugcagugagccaagauugacagagcgagacuccgucucaauaaaaaaaaauaauaauaaauaaauaaaucuuucauggccauuaguauauuguuuagucuugaccugggagaugcuugcugaugcaacuguuuacaaaaauguugaaguaggugaagaaaagggagcugucauagccuacaauaggcaaguaugaaauaaagguguauguuguggaaaucacugaaagaggucaauauccucauccucacuccacagaaggggaaauuaggcucauugaauugaaacaacuuaccauaaggcacacacccaaguugcaaauugggaauuugcauuuggacccaguuugcccaacuccagccccaugaccucgauuuaucuguagucucuuuccuuucuuuccucuuucugcuaaccauggaugaauggcaguaauccuuaacagcuguuagugauguaucagacauccaguucuuauugcaaauauaugaggcuuguaauaugaauucuauuuuacaaaugacaaaacuuaaagcucaaaaaguuaauuuuuggaccaaggucacagcuaacaaauggcagaacauuugaacuuggcaaggcaguauggcacacaggcucauacacugcucaccacagguccuucagugcaaugacaaugacaacaaagaaaguuaauuuuuaaaaaugagaucaaagauuuucuuccuuauguuaaaaaaauuauuauuauuuccauuuuacuugacccagcuuucugugacuuauuuuuacuaacuuauuucuguguauagggaagguuuggaagaaagccuuuugucagaaacucauccuauuauggauaguugcuuuuauaauguuagaauugguugcucugugugugcgugugugugugcguauaugugcacacaugggagugucuguguuuugaaaggacaaaauaaaaacuaaucaauagagcaggucuuugaaauuccuuaaccuacuuaugucauuagcaguaaugucugugauguuaccugucauggagucuugagcuugcaaggcuagcuuuucagaggugauuuauuuucuucuaagugauauguuugcaguuugagccacagaacaaagcauagugccuaauuaucacuauaugggccaauggccauacugaagauauaucucuugauccaguuuuuuuacuuaagcauauaacuuuuuuuuuuuuuuuuuuuugagauggagccucucucugucacccacucuggugggcaguggcaugaucuuggcucauugcaaccuccaccuccuggguucaaacaguuuuccugccuuagccucccaaguagcugggacuacaggcgcucuccucuaagaccuaaauggaaaagaaacaauuuagcagagcuucaucagauuugcuuuuuucuugauuacuuuauaauauaguuacacaaagcagauguauacaguggacuugcaguggugucuauuagcauuaggguagcugcugcuuaauuuaaaaaaucaccaauauucagcuucuuuggcuuuuuauuuuuuuuucuuugagacagagucuugcucugucacccaggcuggagugugguggcaugaucucggcucacugcaaccuccaccucccagguucaagcaauucucacgccucagccucccaaagugcuaggauuacaggcgugagccacugcucccagccuucagucucuuuggcuuuuuguguguuuccaaguaaguguuccuccuuccuaagauaccauaauuugccaugucucgauaucucgauauccugauaccaguuaaugcguuuucuuuguuccauggggcuuuuugcauuuauaccuuuuuuauuuuuauuuuauuuuuuuaagagauggggucuuacucugucgcccaagcucacaguagucucuacugcccuggcucaaaugauucucccaacucagccucccaaaguagcugggaccagaggcgugcaccacgauccccagcuaauuuuuuuauuauuuuuagagacaaggucuugcuauguugcccaggcuagucacaaacuggucuucccuuuuaacuagguuuccugaggacaaagaucucaguguguucaucugaugucuucagagucugggacuuuaaugccuauuagguguugaauccauauauaaaugcguuaguaacuggcuuucaagauuguguucucuuaauacaaauaucuggaucaagaauguaggaaguuacuuuccaaaaugagaaaauaagcccuuuuguuaauuuuugaaccuaauuuuuaaagaccgcauucaauuuuuguguaugaaaugucuuagccagagguucucaaacuugagggugcaucagcaucacuuuagagagcuugcugggccaggcauggagaagggucacaacuguaaucuuagcacuuuaggaggccgaggcgggcggaucaccugaggucacgugaccucagccuggccaacauacccaaaccccaucucuacuaaaaauacaaaaauuagcugggcaugguggcacacgccucuagucccagcuacucgggaggcuaaggugggaggaucacuugaacccgggaggcuaaggugggaggaucacuugaaccugccaggaggcagagguugcagugagccgagauuacaccaccgcacuccagccugggugacagagugagacugucuuaaaaacaaacaaacaaacacacacacacagagauugcuggaccuugccacuagaguuucaguaggucucgaaugagucuaagaaugugcauuucugagaaguucccagggucugcggguacacuuugagaacccuucucuagucaguauuucccauuugguaggaaauaccacuagguggcaccagaacacuucuuaugaaguagcuauuggcuuuuugaacagugcuuauugcacaguuuaggauuauauaaaagauacaaucacuaaauuauuggaauuuggagccugaauuaucucauguauauaaaaaguaaaaauguguugauucuauuagaccagagaacuauacgacuauuaagguuaaauuuuuagaucaacucuuccaggaaugaggacuauaccucucaccuuugcugcucuccuuuucaguuguguggguuaaucaguuucauuuaccagugauugaugcagauccuuucacaaaauaaaaauaaacauuucauaugaaucauaaguauuuauucuuccagguuaauggaucuugauuuuguuaucgauuacauuuuaaaaccacuuuuaaaagacuuauacauauugugcgcauaaauuucuuguaauuuuguccuuccuccaguggcccaguuguauuuggggcaguuuuagaaugucaaaaagggugaaaugugcuuuccuauuggcuuccuuacucagaaaguugaguaguuuccuuuuuaagagcuauugagaggaaaguuuuggcugcuguucaccucaucucaccuccuguuaccguggaaucucacuccauaaauuuccaaucauuccaacaccuccagauuuucuuuccuccaccgacuguaacaaccugaaaguuggcaugguuucuccacaugauggcguguguggaaauaauuacuugcuguguuccccuguuugcuaagcucucccauucacauuaggaugucacuuugugaaacaguaaaugagucacuuuuuaguuuuuaaaacagcguguauaguaucugaauaccaucuggguuuuucuagaauccugagaauaauuuuucuauuaauucugcuuuuuugucuuuggagcugaagcuugguuuagguuucaguggccuaacaggguuugaaaaugaccaucacagaaaaaauggaauuggagucacucaaucagauuaaaauuagacuagcacuuuauuauaucucuuugaucauuggaaauaauugagacuaguuuaaugcuaagcaaagaugacagcuuauggaagaaguagauagaacagacuuuaggauuauuuuugagacaucagauuccuuuuuaaaagacauaaaauuuuacgucuucuaguaagcagaaaggagcuuuuuguagauuggcaauuaacauagcuaaaccaacuugauuauucuagagaagauuauuuuauuauccagaccuauuuuuucucccucuucuuucuguacuuuauaaaugaaauuauuuguuauauauaaauguaaagcauuauuuauauauguaaagcauuauuauuuauauauguaaagcauuauuuauauaaaguguuagccacauguguaauuuaaaauuuucugcuguccuuauuacaaaaaguaagaagaaagaggaaagauuacuuuuagaaauguuuuauuuaaacaaauaugucuaaaauauuuuaacauauaaucaauaugaaaguuacuaauauuauuuugacuuuuuugauacuaaaauuagaaucuuacaguacaugucaaccuggacuagccauauuucauauauuuaguagccacaugugaaaaguggguacuguauuagauaacagcacagauauagguuauuucauuugucagugacugugucagagaagggcaagaaagcauaaggauauuuaaaucaaucaucauguaacauuuuagaaguuuuggagaguacucaaaucaaaccagucgguaaaacgaguuauuaucuguugauuucuuuuguauuugucacuuuucuacccuaggugugauugguauuuuaauacauaaaaugccaauuuuaaaaauaguuuagucagccuaaaaugacuuacuucugaggauccugcuaguauuugcuucuguuugaaaugucaugauaauuugaauccacaucuacaguacuuucauauuuuguggcugaugugguaaacuaguuucuuacgauauugggcaagccagagguuaagccuguuaacuucagcagccagaauacuguacucuaguugcuauaaacaauuaggccugucagcaauugaccuuggaaaugcuaauuugcuugucccugggugcugccucaggcacuggcuuucucucugugggugggaguuaugaaccuaguuuggaggagaacuugaggcauuuggggcaagcuccaaacagaugugcuucuugcuucauuuuugcaugugaccaagucgcaagaggcgcauuccuugcaugaauuucuuugaaggccuuguagaaucagacauguaugccuugacuaaaguugagaggaagcuuuauuacuuuugaauuuacccuucccucuucauucuacugcacaucugccauaacgaagguugauugaaaaaugcuacacagugauuuucaucacuauuucauuguauuucuuaaacuuacugaaaaagaacuuggaaggcaucuuuuauuaacucuuuugguuuuguguuuauuacuacuauuauaguagagccaggagaaaguggccugaauaagugaggagaaagaaauguuaguuggaaaagcuauauauacauggugagaaguuauagguagcgugcucaguagaugaagaagggaaagagaauauuuauaaaauucagaguuacugucuuuuuaaacugguggugacagcaguggcagauuuuacuccaagacaaagauuugcgcuuccucuucuuuugggcagguaauuuuggacaagguaauuuugucccuuuauuguacaauacugauucaaacauuuauuugagguugguugauugccacuguuguuagguaauuguuagcauuuuauguugaucagucaccaauuauuauuggcucaugcccucaaaaggcuaauaauuuuguuagcagauaaggcaaauagguauccaugcaaagaucaggagaacuacaugguaguaaguaaugugugccaaaugaggagaccaugaaucuguaugucucaaucaagaaucugugaauguauuuuuacauuuuaugaccuagcagccugauucuguaucccauaggcauacaucuuuuguagacucuaauuuaauaggcaacuuaauaauagccaacuugugaugcuuuuuguguaccuggcauguuauaaaugccuuauguguauucauucauuuaauccuuacagaaauacugucagguagguagguaucauuaccauuauacauaugaguaaacugaaccuugagguugaccaaggacuauauacuguaucucugaaggagugguuuuuguuuuuuaaccacaauaauggauuucagauuggaaauauacauuuuaauuauuuacuccuuacauauucucacccaucauccuuuguaacccuaaccccuucccaauugcaguaagcucugagauaaguucuuaccuacgcauuauugaccuaggccugugcucaguguagauagcucuuuugcagagcucugacaccguuaugccugaagaugaguucuucauuaaaaccauuuauagaguccauucuaugccaacucugaugauugacuuagaagguucucuggcugagccaaaaaaaaaaaaaaaaaaaaaaaugcugccuauuauaugaaauguacuaugcuagaaauacaaagauaugaagauacuucaacaaaucucuagauccuuacuaggauuguaagucuugauuaccgugaauugacuucuuggaucaucuuuguuugauuguuucucuagccauaaccaaagcaucuggcauuugcuucccgaaaaaugguaguuauuaccuucuacaacuauuuuaaacccuugagcauaacuuacagaaggugcaugaugucacuggcuauauccccuuauacucuauauacuccagucauggagccugguuuaagugccaucaacauaugcucuuuaagccucuuuucucugcucacaugacuuccucucccuagaaugcccuuucucuguugagugcuuugagggcaccaauucaucuuucaaggauaagcuuaaguaucaucuuuuuucugcagacauuccucucccacccaaaccaaauugaucucuucuuggguuccucuuuguuuguuguacauucguccaucuaaacagcagagcacuucuuugcacucaguuguauuucaacuauauacuauauauauuucaaccuuauacuuuagcauaagguauucucaccacuagauacagggguuugaaaagaccaguuaauaauauccuguuucccagccaaguuggggcuucguguuccagucuguguugcacuacucaacucugccauuuucacucaaaagcagccauaaacaauauguaaacaaauggaugugauuugaauaguagugggcugcacuuuacucauccguggucuagagaaguuugauaguuuugucucaugucuuuaaaggcuaagaauggguuaaaauuucauaaaaucaaaauauaaagugauaccugaaaagggauuauagggaagauaacagaaaugguucuugcaaauauauauauauauuuuucuggccaacucauuaaaugacugguaggaaauaauuuuuacaaagaguacgauauaagccuugacaacuucuauaucauggguuacugaaaaaucuuaccuauaaaguucuccuagacucagguguguuuauaauaaaguuuauguuuuaguuuccuccuuuccaaaagcccuuuacauuuucugaaguuaguuccacaauauuuacuaaguuccacaauauuuacuaagcaccuucucucugaaauauaaagauauggagauaucacucaacaaauuuauaaaucuuauugcaguuauuuuucucucuuaacaauccuaugaaaaugaaggagacacuugacagaugaaagagcuaaagcucgaaggguuaagugacuuaucugaagucacaaaguuugagaugcuacucacauccagaauaucuucugcagugcuaacccacauguguacaugcgcacacgcacacaaacacacacacacaagugugcaucuuguguagaucaacaugucccaugccaguccuauuugccguuauauguagagcuauuaaguuuggaacauuaaguaaagaaucccucauuauaggaugcaauuuugcuguaaugaaauucauuucagcagauaauuaauuuaguauuuaaucaccuuaaauucuucuuaauaguauuucaccuuguuuuuuaaaaaaauuccucucaguuagucacucccucuaaaucccauuagcuuuuuuauucuuuuauuuggugacaauaacaacuuuauugagguaugauucacccauuuaaaauguacaauuuugugguuuucagaauauucagagauauauaaccaucaccacagucaauuuuagaacauuuucaucacuucaaaaaaagaaacccuguacccuuuagcuauugccuuccuguuuucccauucucacuauuccuaaggagccacuauucuacuuucugucucuauagauuugccuauuuccagcaucucauauaaauggaguaauguaauauguggucuuuugugacuggcuguuuucuuagcauaagguuuucaagguucauccauguugcauguaucaguaaguacuuuauuccuuuuuauagcugaauaauauuucacuguacuucuguuaaauuuauucauaaacauuuuauucuuuuugauucuauuauaaauggaauuguuuuccuaauuucacuuuuggauuguuuauugcaaguguauaaaaauacaguugauuuuuguauauugaucaugcuugcauucugaaacugcugaacucauuuauuuguucucauauuuugauuuuuuaaaguggauuccucaggauuucucucucucucucucucucucucucucaacaaggucucacucuguugcccaggcugaaguucaguggggugaucaacagcucacuguagccucaaccuucuaggcucaagcaauccucccaccucagucuccugaguagcugggacuauaggcuugcaccaccacaccuggcuaauuuuuguauuuuguagagacaaggucuugcuauguuggauuggcuggucaugaacuccuggggucaagcgauccuccugccuuggccucccaaaguacuaggauuauagacaugagccacugcacccagccuccucaggauuuuguuguuguuguuguuguuuuuugagacagagucuuacucuuuugcccagccuggggugcaguggugugaucucagcucacugcagccuccaccuccuggguucaagcaauuauccugccucagccuccugaguagcugggacuacaggugcccgccaucacaccugacuauguuuuauauuuuuaguagagaugggguuucacuauguuggccaggcuggucuggaacuccugacuuccagugaucacccugccucagccucccaaagugcugggacuacgggugugagcccagcuaggauuuucugcauacaagaucaugucaucugugaauggagauaguuuuauuuuuuccuuuccaaucuggaugcccuuuauuucuuuuucuugccuaauuguccucgauagaaccugcaguacaauguugaguaaaagugucaagagcauacauccuuuuuacugaucuuagggcaacagcaucuuucaauauuaaguguaauguuaucuggagagcucccuuccuccugcaguggccuucuaacgcccuuuauugagaaagcuucacaucauucucacuguaagagaaaaugcuucaagcacuuccaucuauuaucacagagcggguauugaagggugaauuuugagcugagaggcaauuaauugauaacuggcacagaacaugaauaagcaaguggaauaaagcugugaaggugcugugauagaaaccuaauugcaggaaacagugaaggcaccauggaguuaguggucaauucuagcagaggaccuuuaguagaacuucuguacuggaaaugaggacauuaaugaugaguaggcauucccuagagagugggagaggguguuucugaggguagcaaagaugagaagagcugugagcagcuuggugucaagaucugugaaagcuaacagguuagucugccacaguguggcaggauguuggcagaaggugagagcuuaugagucagagacaaaggucuuuaucacuuguugcacauugcacaucaaacagugugaguaucauaguucaccuuguuguccccucugucccaaguccuacauuggugaggaagggcccagggugauacuguggaggguuugugucacagcugaggaacuugggggcuaagggacccagauuuuuguaacgagcaguaaacuucccugaccuuugccauggaggaagacaucaucuuauuauacugcccucugauguagaaggaggcacaaccucaaucuuccaggguuuuguucauuauacaaacauccuugaaaacuauaaaagggcaguuagucauccaggcggggugacucacaccuguaauuccagcacuuugagaggccaaggcgggcagaucacuugaggucaggaguucgagaccagcuuggccaacuuggugaagacuccaucucuucuaaaaauacagaaauuaagcuggcaugguggugggugccuacuaaggaggccgaggcaggagaaucacuucaacccagaggcagagguugcagugagccgagauugcgccauagcacuccagccugggugacagugugagacucuguuucaaaaaaaaaaaaacgagggggacaguuauugucuuugcucacaagaugugaggagaugugugagaccaugaggaauagugucccagcaccuggcagguucagggaacugcauguuaacuucagguugggccuuuccaagaauuuuaccaccacguauuauagcuucagcacuuacuaccucaagaagauguaguaccuuacuugaugcacgaaaguccuauuugcugcuggauuccuucuuucccuuuuuggcaaagagggcaucauauucuguuggcuaggcagaauaaccucgagcuuucagaaacaauuuuggaaucaggucgcuagguucaaacacagcucuggcaauuauuagcauuguguaaguuuugguucucucauuugcaaaaugaggauaauauuguaaaauagcaguuaacaucuaauaaguauuuaacuuuguacccacacacaucucccuuauucucacuuuauuuaggauugaugugagaauuaaauacuguauauaaaaugcuuuucacuuggcacacagcguucuuauuuuaucugucaguuauuuuguuuugcuuauaauuauuugguucuuucgcaggugagagagguggaugcuuuggagcuuuuggcucagaaaugauaauguacauaacacaggcagccaugaguuaaaaugcaaguucugcuaucugcuagcucugugaguuugaaccaguuacuucacuucuuuagcauucuuuuccaugcaugaaaaauauggacauuaucuccuuuucaugguuccugguuugaugaaacaguuacaugcuuugcuguccaagauuuacuucucaacuugguugaucagccuguaaaugcuugcuuugguuauaaagggaauuaguggaaaaagaauuuaaaguguaugucuuacuguuaggauggggaauggcacugagaaugugugcugagguugggggaguacaugauaguaagggccauguguguuucuguguggggggagauugucuucuuaauaggaaaaaaugauguuuaugauaugguuuaagaaacaaaaguauguucuaguuuuagaaaaauuaguaugggauuucauuucaagcaaaaaaagaugagugcuccugugggauagacuaaaauaggcguuuaaaccaguuaacaaagaaagauuauguaauguguuacauggaagaugcaguuuuuguuaguugucucccucucuucuucuggaauggagccuuccagaguucuugggucguucuggaguuuguugagcauuacccuguaucugccuuaucuuuguuuucugagugguaagcuuaugagggguuuggagucuuggcugaaacuuaauaauacagguugaguaucccuuaugugaaauguuugggaccagaaguguuucagauuucagauuuuggaauauuuacauauacauaaugagauaccuuggggaugggauccaagucuaaacaugaaauucacuuauguuucauauacacauagccugaagguaauuuuauacaacauuuuaaguaauuuugugcaugaaacaagguuuguguuaaguacuuauguguggaauuuuccacuuguggugucaugucagcgcucaaaaaagcuuuggauuuuggagcauugaagauuuuggauuuuugaauuggggaugcucaccuuuauuagaaauacagcauugacuaaaauagacauggccauugugcuuugagcagaagcuggagagacuuggagagggccagacuagugguaguaggcucuuguaagucaaauuaagaagcucuuacuuuagggcaaugggaagguguuaaagaguuuaaaaauaggaauaggauaauuuuauuuugcauuauucucuggccauaaugugggaaauggcuuccuaggaauaugccuggaggugugccuaacaguugggagguuguuguaguaguucccagcuauuagguaguagugacuuggacuagaaaggugguaagggauugaugagaaguagaucaauuuauaaaagacaaaggaggaguaauugaugaaacuugaugguuuauugaauauggaaauugaggaaaaggaagaagucaauggugauacucaaauuucugacauacgcaucuauguuaauggaggccccauuuucuaagguggugugaugcuuugcuguugcugcuggaacaaaguaccacaaacuuagugacuuaaaacaacacaaaucucaagccugaagugaaucuuaacugggcuaaaagcaaaguguggcagggccaugugccuuucuggaggcuccaggggaaaaucauugucuugccuuuuccagcuucuagaggcagugcacauuccuuggcuucuagccaucuuccaucuucaaaccuggcaauggcccauugagucuuucucauccugcaucacuaugacauuaacuaaccugcuuuucucuuucauuaauaacgggccuugugauuacauuagguccacccagauaagccuggauucucuccccacugcaaggucagcugauuaacaaucuuauuuccaucuauaaucuuaauccccccuuuccauguaacauaacauaauuguggcacugggggauuauuagagggccauuaaucuccucacagcagauaagaacacguuuuacagaggaaauaaauuuaguuuuagagaugcauucaaguggggaugacaaauaaacaguugguuuuugagcuugggauaaagauauagauaugacaaaagccuauacaugaaaauugaagccauagaaugaauguuuguuucuuagguggggagggaauacgugaaaugacaagaaggcccgggccaguguccuuaggguuuggguaaaguugcagguagugagauugagaaggagccacuggaggguaggaggaaaucuagaggaauuugauuuuaaggagguugguaaugaccuuuauagacuauuguguguuuggucugaaaggauacuuaaacaucuuuuuaagccuauugcuauuacagaucaggaaauugaggcccagagagaugaagucacuugucuaagauuguauaacuaguuaauagaagugcuucuucauuccuacuuaguuuauuugccacccugcaacccagguccauuaaaucuuuucauuuugaagauaguguuaggaaaagauuuggcucugugugugugugugugugugugugugugugugugucuguguguuucauugauauucugaauacugagagcaaauugcuggaaugaugucugacuggugccuuauuuacaugcaaguuaaaaauuguuuauacuaaauaauagaauuaauaauuacuuuuuaaaucauguaaacuuuuuuaaaugcaacuucaucucuuuuugcaguuucuuucaccucauuuugcaaucucucucuauccuuuuuauuuuuucaauaaguuuuuuauuuuggaaugauguuagauuuaccaaaguuguagauaguggaguucccauauacccauacccucacacaguucccucaguuguuaagaagaucuuauacuaccaugguacauuugucaaaacuaaggaacaacucugguacauuccuguugacuaaacuaaauaguaagcuccagacuuuauuuggauuucacugauauccuuuuaaagaacguugucugggauccaauccaggauaucacauugcauuuaaucaucaucuucguagacgcuucuuaguugguuucgcuuuuuuuuuucuuguaauccugacaguuuugaggaauccugcuuagguguuuuguagaaugucucucagcuggaguuugucugaugucuuauuaugauuagauuugcguuacagguuuuugggaagaagagcacagaggucaagggcccuucucaucacgucauaucaaagcuagugcaagucaucaacaugaccaguaaugucaaccuugaucaccuggcccuaguaguguuugucaaguuucuuuacuggaaagguacuuuuuucuuucuuuucccucuacauacuguuuuuuggaagcaaguagcucgcuguauccacacucaaggggacauaauuaaacucuaccuccuggaggaguaauuaucuacauaaauuauuugaaauucuguaaagaguuuuguuuucucugcuucugccccugccuuaggaucagcuauuuuuccaagggcccugguucuuuuugauuggaaagugguauugagaaaccaagaucugggcuccagaugugcuugcugcuaccagaaagugacugccucuaagcccuuucagcagacagagcuaggaaauauguguauguaggcuaauguauguguacauacauaccugucacuuguauguguauucaucuguaucuauauuaaggggaacauguguucacaccauuaucuucaacgcuaaucuagugcugcgugguuaaauucuuuucuuuuucccugcugauuuguaauuucccucaccaacauuaagaaacuggacucccaccguccacuguacauuugcuucugugugugccuccaguauacauguaaagcauuuucagaauuauuagccugugcuucugugacaaacaaguucaucagcuagcuuaggguuuacggacaguucuuuugccuuuaguguuaugguuuucagucagaacaccauuuccaagguuacuuaggucauuucccuuuguucuccacuuccuucagugacauuugucaugcauuugcaauacaguuacauuguugucauagucuggauucuauuacaggauccccucauuccugauuguuggcauugugguaguuuauuauuauuauuuuuggauacauuauaauucuuugugagugaaauuuacaugggucuugacauacugcaaucucuuuuugaaaauauauacguacuuggaaaauauacgcacugaagacauacuagaauguuugcuggcagcaguguuaaggcuaagaccagagcagugaaugaagcugcagucagauuuauaggucagcaaucaggguuaaagauguucugcuuuccgaagucagaauucacucauauauaacaaaacuucaguaggcaagagccuacagaugcuuggguuuagagaaugaggcagaucucaaauauaaggccaagaauugaguuacaucauuacaucaggauauagauauuggaacuuaugcacaccuugcccagccaacaggugcaacaccaugguagcuuuucauugaguucuaacguggaaaaaaaaaaugcuuggagauuguaaguacuugagaggagagauuaugucucuuugaaaccccuacagaaauguuucuuaaacugcagucuuagaggcaccugggauguauauuuuaaaaaugcaaaauuggagcuucugaaagcagagcccagaaaucugcauuuuaaacaagcaucccaaguaauucugauacauccugaaguuugagagcccuauccccucacuuugaauggugaggugccuugcacaaguaggugcacccuguguguuuacuaacuugaauugcagguaaguaaaaguucuuaaguuccagaauucaaaucugggcagccugucuccagagucuauguuaacaacauuguaaaagcuuugcuuugggggauucaugucaugcauccuuagaguuucucagguaaauuaagccaagaaauaauugccauuuugguguuucagcaacuaaaaauauauguguauucauauucuucuucuucuuauggggaguugguggguacaggaucuugcucuguugcccaggcuggaguacaguggcacaaucauagcucacuguaaacugcaacuccugggcucaagccauucuuccaccucagcuuccugaguagcugggacuacaagcguacaccauugcaccuggauaauuuuucaaaaaauguuuuguacagacagggucucacuauguuggccaggcuuaggcaauucucccacuucuuuggccucccaaaguguugggauuacaggcaugagccucugugccugaccuguucauauucuucuguguucagcucucuaggaagcagugugauagcaguguucuugaauccuaaggagaggcauguaucuuaagacaauuuuuaaauuaaaaaaaaauuuugguuuuuuuuuuugagacaggaucucauucuguugcccaggcuggaguacacuagugcagucucagcucacugcaaccuccaccuccucaggcuuaagcaauccucccaccucagccucccaaguagcugggacuacagauacacgcuaccacacucgggucauucuuuguauuuuuaguagagaugggguuuugccauguggcccaggcuagucuugaacugcugaccucaagugauccacccaucucagccucccaaagugcugggauuauaggugugagccacccacacccagcccaauuuuuaaauuguuaaaaauggauacaauacuuaagaaauaauuuggcaaugucauaugaauguaaaaguacaguaacauagaacaugagauaagacuagauuuauagacccuuaggccugaaaugcacuuuacaggucaucucaucuaacucucucuuaaaaguaaggaaacugagcaccaguaagauuaaguuauuaacucaaagucucagagaaaauugacaguugcagauauccugauucaauccaauauaauuuccacuuucauucugcuucuaucuucagugucucuaugaaaugauuaaaaaauuuauuaauuagauuuuuaaaauccauuuuaaauuaaaaacugcagauauccacuagaggaugauaauuuguagcugaaauuagaagcaaaucuaguaaauuuagaaggaauauucagugcaguugcaaaaaauagaugugaguaaaugacuaggauauuuaaguagaaaaguuuguuuuaaaacaaacauuuuuauggaaugcuuuauuuugggaucuuacauccaguuuugguuuucuagcuuaaugaaagacugaaauaauccagggguguaaaaugggaaaacagcugguugaguucuacauuuguugaaaacauugauuugaaguaauaguuugucuuuaaauucagccgggugugguggcucaugccugcaauccugacacuuugggaggccaaggcaggugauucacuugagcucaggaguucgagaucagccuggccaacauggugaaaccccaucucuacuaaaaauacacaaaauuagugaggcaugguggcucgcaccuguaauccccccagcuacucuggaggcuaaggcaggagaauugcuugaaccugggaggcagagguugcagugagccgagaucacgacugggcaacagagcgagacuccaucucaaaaaaacaaagcaacagagcaagacuccaucucaaaaaacaaaaaccaaaacaaaaaaaaagaaaaagaaaaaagaaauucugugaaaucagaaagagucucagagaaaacgccguuuaugauuuuuaacuuuguaucauacauuagaaccguggaucucaaauuuuaucacuaaucagaaucacuuggaggacuuguuaaacugcagauugcugggcuccaacccccaaggcuucagauucaggccucuggggcaggacucgagaauuugcauuucuaacaaguucccaguugauggugauggugcuguuaguccagcccaaccacacuuugagaaugacuagauuagagaaagcaaauuauaguacaaagcaaucauauucuggugaggggauuauacauuaaaagcugguuucuuucauauuuguuauguaaaaaaucuguauugaugaauguuuucauacuuaacagaaaaacuguaacgaggacacccagacauuauguuaugaagacuucugagucauuaugaugagauuucauuauauuaaaugugguuuaaauuauauaguuaaauguacuuuuuuaguaauagaguuacuauuagaaguggaaguauuauggcaagucugaaaauaugggaucuauguguggaguauauuaagggaacucuauagucgcuccccauccuugucaacacuugcuacaggcagucuucuuacuuuuagccauucuaauagauaugcaaugguaucuuauagugguuuuaauuugauuuuucuaaugaucauuaaaauugaguaccuuuuaaugugcuuauuuggcauuuaccucuuuggugaaguaucuucaaaucuuguguugccauuuguuauuggaccaguuuuuuaaucauugcauuuugaggguucuuuguauacucggaauaaaaauucuuuaucagauauaugauuugugaguauuuccuuccagccucuuuguuuuuaacggauuccuuuuuuuuuuuuuuuuuuuuuaagagucggggucuugcucuguugcucaggcuggaguacaguggcaugaucauagcucacugcagccucuaccuccuggccuccagugaucuuccugucucagcuuccugaguaguugggacuauaggcguaugccaccauacccagcuaaugaaaaauaaauuuuguuuuguuuuguuuuugagauggaaucucacucugucacucaggcuggagugcaguggcucaauauuggcuuauugcaaaguucaccucccaggcucaagcaacccucccaccucagccuccugaguagcugggaccacagaugccacaaaugccaaccuccaugucuggcuaauuuuuuguauuuaugguagagaugggguuucacuauguuguccaggcuggucucaaacuucugagcucaagugauccaccugccuuggucucccaaagugccaggauuacaguuguaaccugcugugccuggccuaaaaaagauuuuuugggggacaagcucucucuauauugcccagguuggucucaaauuccuggccuuaggugauccucccaccucaacuucucaaguagcuggaauuacaagcucgagccucugugcuuggcucaaacagauucuuuugaagaacagaaguuuuuaauuucugugacauccaguuuaccaauuuuuucucuuguggauugugcuuugcucuuguaucuaagaaaucuuuaucuaacccaaguucccaaagauuuucuucuguauuuuucuagaaauuuuguaguuuuagguuuuguauuuaagucugugauucuuucugacugaaguuuuguauauggaauaagguacgagguauagaucaaaguucaguauuuuccuucuuuuuuuuuucuuugcauguggauagccaauuguccuagcaccauuuguugcugaagacuguuuuuucucagcugaauugccuuugcacuuuugucuguuuaguuguccauguagguauauauccauuucuggacacaauucaaugcuguugaucucuuuuuccaucuucaugccaauagcacacuaucuugauuacugaugcuuuaugauaaaucuugaaauaagcuaguguuaguccuccauuguugucuuuuucaagguuguuuuggcuauucuagguccuuugcauuuccaugugaauuuuagacuuggcuugucaauuucuacagagaagucggccaagguuuugauugauauugcaugccuugcagccuggaggcucucucaggauacuaaggugggcauuuauauggcuuaccuuguaugcuucuagucacucuuguucuuuccuccuugcaugaugauguccaguaucuuauaaaccuuuuuuaaaacauuuuuuaauuuuuauuuuuuugguuguuugagacagcagacaaaucuagccccuguuaauggccaguggaaguauuauggcagguuuuugauaaacaggagaguaacaccagacuuguacuugagaaagagaauuggcaacaucauggaagaacuauuagagggaaaagaaaagagauuggaaaaggaaaugacgaaggaaacaaaucaauaaucugaggaagaaacaaagauugaaauuaaggcagcuauaguuggaaaggaaauacuagcugacuuuagcaggcagaauagauagacauuugugacuaguuagauguggacaguaagagugaggagucuaagaugacuuuauguuuuaggucuugcauauaguuugguucuguuugguugcagagacuaggugccugcaugugggaugugauugauuagaaccucccauuuuauaaauaguacugugguguuauaauugauacccuggaguucagaaccaguuacucagugaauauuaauaguucuuuauuucuuaguuugcaguucauuauaauugucauccaaacacagauacacuagugggugcuuauucccauuauagaaguaguuuacuucacucaacaaagaguuuuuuugaggcuucugguagguuuagguguuuaugaauuauuacuauuuuucaauaggaagcuuuuaaagauggaaaaacaaucuuggaagucacugaugauuucagucaauuaaauugaaaauaaaacaucuuuaaaaugucaauauaaguaaggaaaaaauaaaaauuaccuucuaaaaugugagacaucuuuucagaaacuugcaguguguggagguguaaauauaaggagaaaugcaaauugaaugggauaaguauaaugauauuuguaguuaauuaugauaacuuauuuuuugguggugucagugauuuaaauuuuaaaggauugauuugcuauuauuuucaugaaaucaaaauuuuuuuuuuacuuuccaacaauaaucauagaaauuauucuccgacagauaggaauaugaaaugaaguuguucccuccuuuugugaucgugacacuucuacucuuuccugaaagaaauguuucuccccacaaacuacuucuuauuuagauggacauuugagaguuagguaaauaacagagauuacagccugucaucauggaucuuauaaucuaaucaacuucuugucagauaucuuggaaucuuaaugcuuauagggcugauuuguuuaauuaaacuguuccuucauuaacuuucuguuuuaaaggaggcugacccuauucguaucuuuuucuugguauaaauguguuuaaaauaaguguagagauaugcuaaucuaaggcaguugcuauccacaugcaagcuaaagguaauuaaccuuuuuugaguggcuaucucauuuaugaacuuacuugauauuuuuguucuugaucccccuaauucucuccugcuccuuuuuuuacuggugugguuucucuggcacaguaggcauguuuucugaucuaacaugcauaaaucuuaagagcgaauuugacaaagucuuaugacauagaaauguuuaugcccaaaggguggugauuauugagguaguuaggcgaauggacucuguuauuuaauagguccugauuuaaguccugcuucugcagcuuauuacuauaugacuuuaguucaagguacuuaaccucucugagccuguauuuucuuucauaagaugguaauaaugauaaugucuucuucacagagcuguuguaguaaggauuaaaugagaugaugcauguaaauugcuuagcauaaugucuggcacauaguaugugcucaauagauguuugcuguuuauuuaacuuccugauagaaaaccaagaaaauuuaugucaaauuuaugugucacagaaaaucagggagacuagcugaugaauuagauaagauugaaauucagaaagacuuucuuuuuaccuccugaaugaaauaaaaugucagguuucaaauucaugaaaucugauagucuuaaguuuugcauuuuagauuguaaaagucagcaguacuaauauaggaagggagagaucuggcuuaauaguacuuuuuguugaguuuuuucuuuuuaaauuuauuuucucuuuuagagaccuggucaaucucugucacucaggauggagugcagugguaugaucauagcugacugcagccuugaauuccugguuucaagugauccucccaccucggucuccugaguagcugggacuuuacaggugcaugcuacugugccuggcugauuuuuuuauuuuuaguagagguggggucaugcuuuguugcccaggcuggucucgaacuucuggccugaagugauccuccugccuuggcuucucaaagugcugggauuacagaugugagccacugugccuggcugguuuuuuuguuguuuuuuuaauugacaagaccagugugugaucagguaguacaaauguaauaguaguauuaucauagucuucguuguuuaacuuauggcuguaauuauugcuuuuuauucugaaguucaucuuuaaagugacaaaugaagcauguuuaaguaaggcaggucaacucggucaaaggaauuugaugauuguuauuuauccugggaagcaaagauucgcaggguaggagauauuuaguggcuaccuucagaucuuugaagcacuggaaucuggaagagacuugagacuuucuguuugacccaggagguagcuuuucuguagcucuggaguagaggaccagaauuuacagccugcuucugauauugagguggaaguaguuaaccucucugagccucaauuuccucaaccauaugaagcagaaaguaaaauuacucuaugcagaaguuaugugguguaaauaaguuaaugugugugaaugagcaauuuggauuuauuguugucauugccuggcaguguucuagggaggcgcugaaucagcucugucuuuggaaggacucuaauaaauggaacuguucagcgguggaacaagcuuugccaucacacuaagagccaaacaaauuccagauaguuauaucagggcuuuuuaggaaauuuuacauggaguagaaguuuguaaaagcucuuugagagaagauacaguguuugccuuauucaccacuguguccaggguacccuguacagugcuaggcacauggucugcucaguaaauauuuguugaaugagugaauggaaguuccuccacuaacacucauauucuaaucuuuguuuagcaucacucuuuuuuuguuuuuaauauaguauguguugucuucuguauuagucuguucucacacugcuaauaaagacauaccggagacugguaauuuauaaaggaaagagguuuaauugacucacaguuccacauggcuggggaggccucacaaucauggcagaaggcaaaggaguagcagagucaugucuugcauggugucagguaagagaaccugugcagggcaacucuccuuuauaaaaucaucagaucucaugagauuuauucacuaucacaagaacagcacaggaaagaccugcccccaggauucaauuaccucccacugggucuuucacaugauacaugggaauugugggagcuaaaauucaagaugagauuugggugaggacacagccaaacuauaucaucuucccacauauauuuguuugcccuuauguugucauuuuauaguggaaauuuugucauuaaacugaaccagacauucacuuuuccuucuguucaccuacacuuacugaaaaguagagcacagagauacaauuuucaucgugaaacuuccugggaguaguuucuccucagguguagauguuuuuaauuuauuucugcuguuucuauaaguauuugaauuucuguaguccuuuuuaaaagggaugccuuacacauggaauauuugcaugggauuacugucccaagaaccucacagcaaugguugccucuaaggagagcauuugggaauuggagauaccacaugauuguacuguuagaauuuuucaaccguaugcuugauuacuuuuuuagucauaugcuuuauuaauuuuaaaaacauuuuuuaaguaguuggggaaaccccaugauucaguagauacuagcuuaagugaagaagaagauuuguauugggaauauugcaaaguacaguuaauacagcaaaauacccccauuuguuaagagucuccuguguuggaggccuuauguugagugcuuuaccuacauucucauuuaauuuuuucaauaaucauauaaaggccaggcacaguggcucacgccuguaaucccagcacuuugggaggccaaggcgggagaauuacuugaggucaggaguuugagaccagccuggccaacauggugaaaccccaucucuacugaaaauacaaaaauuagcugggcgugguagugggugccuguaaucccagcuacucaggaggcugagguucaaucgcaugaagagguugcagugagccgagaucaugccacugcacuccagccugggugauggagugagacuccaucucaaaaaaaaaaacauaugagauuuaagccucacuuucuuuugucuuggcugccacaaauucaugcaagagcuuugguauuuggucaaagccagacucuguuucuuaagccucuuggguuuccaagucaugcaacuguagguaagacuugagcacagccaaagacuugaagaccagagagaaguggcaguuguugaaaauauguugccugggaaaugcucuuguggccuuaaauucacaguuucuuuucagucuaccagagauuagauagaauuggacaagaaagauguggaaaaaagauaagucaaaugaaagacaccuggccgugaagauuuggaggcuuuagguagccaaagggggucugcggauaugcuuuaaaaugacagauucccauagccugaguuuccauaguguuuuugauggcuggcaaagauugauuucuaugauuuuuauuaauugaauucauauacuuuauuucaaacaguauuuugaauuauaccacuaucacagucauuuauagauauuaacauacauucuaaggauauaucugucuauauaaucaaagaugucguggucuccaucacucugagguagagcaauuuauuuaagucaaucagucucucuuucauuuucucuccuaaaagaagguaauguuuaggagaauuccuuuaguacagaacagauuauucauuacucccugacuuuugcaugaaggguauauuauugauuucuguguaauaguccagacacuggcaugugccuuccaugcugacuuugucagucuugaggucagucauaacuccaucauuuauuaacuaugucaucuggggcaaaugauuuagugucugugagcaucuguuuccuuaucucuacaauauguuuaauaacacugaauucauguuguuguaacaaagaacuggauaagguaauaggugcagggugccuggcacagacucagugcuccgugaagauuuguucuguuuuaaaaaucuauguccuucuccucucuucauucccaaguguuuuuguuugaccauuuuaacucuaauguagucucuguggagaggagugaggcauuuguuuagccucuaccccaguccggugaacaucugaugaacacuuacucauccuucaagacacaguucaaguuugcccucaccagcuaaaccuguucuuucuauaggcaguguuagcugcccguucuucuugcuuugaaacauuuuuccccucugccuaacauguggugagugcucaauaagcauuugccgggcaaaugaguuucugaacuugggggagggguaugguguuuacagugcuucuuauggagcauuauugcagucuugugaguucaguuucacgcuuuagaaguuaguaaaaaacaaccuagagagcuaagagagcuaggaagaugauuuucacuugcuaccuuuugguuccaaaggcaaagugcuuucaguauuuagacuaauuacacuugcagaauaguuaucuauucuguaauaaugauaaugacaaauauuuuguuagugcuuacugugagccaggcccugugcagaucauuuuaccuacauuaucucauuuaguccucauaucagcuuucugaaguaguuacuguuauuguacccauuauauauaaaaggaaauugagacucuaguaaaaugacuuaccaaaaacuacauagcuagcauguaauuucauaaagccuagauuugaaugaagucuaauuccagagcuagcuuuuuugauuacuguauuacaucgucucucuucugugucacgaugaugagggaauuguguuggcggguaaacuaaacaugacuauaaaggugacuacuucuugaggauuucucccauauucacuguguuuguaaagaaccccugacacuuacuagcuuguaucauguacugcugacacucuucacuaugauuucuagugggcggcaguuauaaaauguguauucaguuuuuuuuuuuugagauggaguuuugcccuuguugcccaugcuggaggacaguggugcuaucuuggcucaccacaaccuccaccucccagguucaagagauucuccugccccaggcucccgaguagcuggaauuacaggcaugcaccaccaugccuggcuaauuuuguauuuuuaguagagacgguuucuccauguuggucaggcuggucucgaacuccugaccucaggugauccacccgccucagccucccaaagugcugggauuacaggcaugggccaccacacccagccauguauucaguuuuaauuuugccacacuaauaucuauguggaggaauaauuacaaguucaaagugcaguguagggagaaguaaccaaguuucuauuaaauauugcucaaggagugaguaagucauuaaauucaacuccugauaaauaugugauuacuuaacauuaggcucccaggacacccccagugugggugcacgcacacacacacacacacacacacagagguaggugcauguauagauguguguugcuagagauaguuggagcuauaguuucagagaagaaggguuuuuuuuguuuuguguguugcauuuugguggguggggucagagguaugcuugauacugugauuuguuuuauuuuauccaaaaagaauagaugucuucuuuacaaaauauagaaaaaucaaguuuuaauuugaagagauuaggaaauacccauauucuguuucagaaaguaaaaucucccaauauacgucccauuuauucuaagaaauuuaaaauacaaucaggcaaucccuugccgccuuuucuuccuuccuccuugccaaaauggacauauguacuuuaugacauuuaauauuuaucagagucuucugaguauaugagucauguugaauuggagucagcaaccccuuaagaacacuaaaugucuacuuugucuuagccugguauuuuacuaauaaaaugcguggaguugaauuuaauccacuauauauaauuggugguguuccuguucagacaugccuguacauggcuuuguagaauaaaaaacaucugauucugcgauuuuuauuuguuuaggaccaaauuucaggaaacagcuuggccgugggcaaaacuauacaguugaaucagagacauaaaguuggaaggaauaaguaggugaaauuugucuugagggugugccucccuaacacacacauacacacacagacacacauccacgugucccaguuguaaagguaaagaaguuuuguagacccauaagguaugaaguguuugguucuuuucuggagauuagggaggauucuggaaaaggaccuuguggcugagaucauaggaaacagagagcaaagcaaaaugauaucugguaguguaaugaaguaguauagagauaaauguguguggacgugauagggaaaagagggggggaaaguccuuauuuucaugucugauucauuaaaggcaguucuacugaagaccugggguuguugagggaucuuauuuggcucuggguaccauguacuaccggaccuguuucaucucugcuucccaagccucaggccugggccucagggauucucuccagugcaugccuuaggcuacagcuauagggcagcugugguuagggaaggucccuauuuagaauaguuggucaaaaagcacaucacuucugucccuuucuugcagaacugguugcugcucuggaaugaaaguuugauuggucuguuagccaugcccaccuggauuugggaaagccaauagaaagaaucuucugcucuccuaucugcuguugcuuuuuaaccuguagccuagaaaauggcauuauacugaacaaauacgguaugaacagaccuuagacaaugcuggaacuggcgccggauaagcucaugaguccaugcugugcuacauaaggaccguauugcuacaggcuuacugccuacaucucuuagucacaaaggaccuggaauuggucuugcuugagagucuacaucuauaaaaauagcuaguuuguucccucccuuccuuuccuuucuuagacgauccuuucuccuucauuuugccccuagccuuucacauuugagacaaccagccuugcuuucauucuuucauacuuguuugugccucauucaucaucuucuauucauugaagucucaugaauuuuaaguugaauuugauuauaacacaaaaucacccauuucuguuuaauguucuguugaucauauaacuuuaaugccuauucaauaccucaaaaagagagaauaguaauguaguuauaauauugcuguuaguggguuuugacacugaguaacagaugacaugucuaaugaauagugugacugcuuagauugcauaauuauagguuuguuugacuuuaggaaaaucauacgcaggccaacuucacccauuuagagacuuuuuguauuauguaaauauuagagcacuucacucuaaaaagaaacccccuccuucagugauaaucauucuuuguuuuuccaggguuugccacucaguaggaaaaagcaaaaugaaauagaaaccaucuuuaaaggauggauuuaauucaguagcccuuccugguuugaauaacacuucaguccacaaugguuuggcauugugcuugugacuggggucauuggguacagacaugcagguuuauaggaugacagcccuggcacuggcauacuuacagaaacagcuagaauuuuauaauguaaaucagggauuaucugugcccuuuggacuugauuuugugggguggcagugcgggggggauagcuaguuauuguacuaacuucuugcaacaguuucuuaauugacguaucaggugacaggucucacagagucaccaaggccccacugugauacuucuccauguauuuauuggcuuguaaaugaauguucaaauauaucacuuagguucauuugauuaacgaaagcaagggcuggcuguaauaaauaaacgcucacagaauggcuuagugaaggaauuugaauauuccuagccucccagacuucgcuuggcagggcugggggucgggggagucaaauguguggcuaauaaaagugacuuuugacuuugagcucuauucagaaguaauucugcaacaugaagccuuccaguauucucccuucaccuugaacauuucucuccugcugcucuucauuugcugccugguagucagucuggagcugcuuucaucucuguugcugccggugcucuuggccuaguacaagcuugaccucuuagcagcuggaguugacuuaguuauucuccuagcauucucugagugacuugguugcucuuacagcacuucagauuagcuuugcugaugugaaaggucacuuuucaccaauauuaaaacuuauuaaucuucaaaaaggggaaaaauaauuuucuuuuuguuaucagauuucuuaaggaauuuggaaagagcuuuccagaaccaugucugauagccucugaguggcauugucuaguguccuccuuggaaguguuguuuuaugcuaacagauugccaacggagcugagcugaggcucugggucuuugacuuucuccuaccugaagguuuguucccuggauauucauggaggagucggaggugcuuguccuccuuguguuuaaauaccuuuuugcacaggugggcaaguguacagacuuggcaguuagaaagccagagugggaggccuggcgcugcugcuaacuaccuuuguggccuugagcaaguuacuucaguuuucucauauguaaaauggaaauagaacuaccuaacucuuuauagcagcaugauuuauaauccuuuggguauaacaugcacacauauguuuauugcggcacuauucacaguagcaaagacuuggaaccaacccaaauguccaacaaugauagacuggauuaagaaaauguggcacauauacaccauggaauacuaugcagccauaaaaaaugaugaguucauguccuuuguagggacauggaugaagcuggaaaccaucauucucagcaaacuaucgcaaggacagaaaaccaaacaccgcauguucucacucauaggugggaauugaacaaugagaacacauggucacaggaaggggaacgucacacacuggggccuguugugagguggggagaguggggaaggauagccuuaggagauauaccuaauguuaaaugacgaguuaaugggugcagcacaccaacauggcacauguauacauauguaacagaccugcauguugugcacauguacccuaaaacuuaaaguauaaaaaaaacaaaacaaaaaaaaacaaacuaccuaacucuuauguugcccugagauuugauguaaguuugaugugcuggcacauaacaguguucccuaauuguuagcuacagcuauuauauauacauauauaaucauugucauuacuuuccauguuuuaucaucugcacugaacuucccuaaugccagacuugcagaaguguuguacagcaaugcuuuucucucuggagucaucauucugugaauuugaacaucguugugugauuucuacccaccacuccagugcuggugccaucucuuuuccuauagaaaagucacacugaaaauauaaaauaggcaagugaaguuauaucauauguccucuuuuauguucuaauucaguugaaucucuuugauaggacaauuuauauuuuagugaaaguuuaauuuucagauuuaugaaauauaauggccuuagaagaauauugaaggaagaguugcuauaauucuuuguuggauccuaagaacacuaaggcaucauucuuguccucaaauggauuaaaaucucuuuggugaaaggaaacaaaugcagauaagaaaggaaagauuggugguggucccaagauaucaagaguguauguguuaaggcaaauuaggugaagaaggaaauccuucuaggcugguauaauuuaaaagcagguagggccugagcucagcccuugauggauauguaggauuuaauuugguauauauucucaaaaagggcuuucagugaaagagugggagaauuuugauggugggaagauauacuguggaaucaaguagcagggagccucugccugaucaguaccuccacaaccaccccaacccccagcaacuuuuuagucaguaacucuguguuucuguguuuaucccuuuuucccccuccaaagucaagagguuuuuacugcagucgggaaauaaagguuaacaagaagaacaaaaaagaauuacgaaaauccucuuaaaauugcuguggcagguugcuacuugacauggacguucucaugaccugucuuuaagaugcucuugugggagucccuucuaguucucaucguaggucucuggucucucagcccccugcuacagcugaccaagacccucugacuacaguuaucugacggcacugcuuccaggugugcugugauccucaguucuuuuuagaauuuccuuccugaucucuucugguguuuccuguucccuuuguugcuugggcugcaccagucuuuccuaguguucuucagcagcuugucccaacauucuugggcccuggagccugaacugaggcugccuguaagccaguuaggcuccagagauucuuuccuuaagcuucaugccaucaaaacugacccaagccuugcccauuuccuccuuugcaggaaggucucuuuggccuugaaccagcuuacuaucuggcucaggucuuaguagcauauaugggacccuguuaaugagaacuuaucaucucauuuauuucguuuugcagcucuuuuguagcauuuugaauaucuuaggcacauucugaaugcuuucagaaauuaacucauuuaaucccagagggagauugcuaacauuauaucuauuuccacugauuuaagccccuuacagacuuucauuucuuaugcuucagacuuuugcucccaacagauacuuuagugagugccuguuugguuuugggguaccccuaaucagcagaauuuuggaaaagcaguuuauacuguuagucuuuguucagguuaccagccuuacccacuuuuuugaccaguuccaguaucagaaucuaauacucauaaaauauacugauccauuaaggaaaacaaaacaaaacaauacuuuccuuuaacuagguaaggcuggugugaaaccaauagucuauuuuucauuauuuuaaauggaaaaaaauaaauuacagguuaacuaaaaccccuaaucaauuuacugaaauguaacuaaguacaguaaaaugccuaaauaaauuacaaaacauccauuacauuaggauguaaguuguuuaaaauucacuucuuuaucaugaaacaauaugauuuuuaacaaaugguugcuguauauauagcaacauauauauguugguaccaagccauauguccauuuuguugacuuucagaaauuuucacaacaacaaacugugacucuaauagucuaacaauuuuaccuggaguaugaccugagccuuuucucacgcaccauuuuguuaaacauauauuuaauuuggggaauguaaauacaaauuuuucuuauguaaacauuacacccuccccugacccccuaacuuacauugagauauuuguguauucuuugcugccuggauaguaaaagcugaagggucuucuaccagaagcauguuaacccaggagauagucuaugaaauauacuuauaaguaacuauuauaaaauuaaagcauauguuuuaaaagccaaaugugaauggacuuuacauuauuucauuacuuuggaaucaucugugguauuauucuucagaguagaaaagaaaaacugacauuugucugcacuaagauauaugaauggagagucuuugaguagguucauucccaaaugugaugaaagaaagcuuuauuuucuuuucauuuaguuaucuuaaauucaaaguuuuuaguugaaauuuuuauguuccuguguuaacuaucuuuuccuaaucuauuaaauuauguuagagcuugaagaaacaguuuaaaagcacuuguaacaacauuaccuugcuuuucuaauuugcuagucccuuuuuauagacuccuguucccugaggauauuuuaauuuuuuaaacauaguaaacauaguuguuucuuauucugacuaauauaaauaguuacaauaacugaaauauuuguggaucuguuucugcugauuguuauucuuaguggcuuguuuucuuguguauuauagguauguaagguuuuuuuguuuguuuuuauauuuauuuuuguuucagccuuuucuccugugaucugcucauucuuaaaaaguauuuguagggauuauuugacacuuagauuaagagugccuucuccagaaaguaguuauauuugcuucugccagacaccugugaguacuaucugccugagaccaccucccaccaagaucagagacuagggucucuggaucacucagguuaggggaacccaggcugcugcaaauccaggaggacugccuuauggccaguuuuucugaaaacaaguuuguuuucucuucccuuuucccuguucugcuucauggccaaggcuaaccucccuucggucccaggcagcagggagagauuacuuuugguucaucuuuauacaaagaguugggaucucagcuuacugugggauaguauguaacuuuggcauucuguugccccacuucucguuuuuguuuuauucuagauuuugcccugguuauuucuuauuaccuugugacucuuguuuuuaagauuuauuuuuuuucuacuguaucugauaucuuugguuuucuuuuuucuuuuuuucuuuucuuucuuucuuuuuuuuuuuuuuuuuuuuuuuuugagauggagucucacucuguugcccaggcuggagugcaauagcaugaucucagcucacugcaaccuucauguccuggguucaagcaauuuccagcuaauuucuguauuuuaauagagacuagguuucaccauguuggccaggcuggucuugaacuccugaccucaagugaucugccugccucggccucccaaaguacuaggauuacagacguuagucaccacgcccggcugcuaucuuugauuguuuucauuaggaagauugguccaaauaaucuagcucuguguuauuaaaagugagaaucuucccuauuugaccuuuaacaauccuucacaguuuaugcaacagauauaagacagagcugcuuaauggaugagggaacugaggcugggagagguguagugauugauuuaagaucauguaaguaagggcacagccuggaacuccuuaauacaagucuuuucuucuuuccaaccuaccacugccuuugagcugucuucuacugaguguauucuuagaauuuugaaugaagcaucauauggugaggagguuuuuuuuauuuuuuuuauuuuuuauuuuuuugaggagguuuuuuuaaaaagauguaauagcucuacaaaauuauuuagaccauugacugauguagauuguauugaugcaacuuuuuccagauauggcauuuuaaauggaaaauaauaauugcaauuuuuuuuucuuucagcugaagugaguagugaauauaguauggacaaggcaaugguugaauuugcuacauuggaucggcaacuaaaccauuauguaaaggcuguucaaucuacaauaaaucauguaaguuuauaccacucccugguuauauauuugguuacaacucacugaccgagaaguagaaacacaaaaucaaaauucuucucuaaucuuuaauguuuccuuauccuuaauguagcagcuauuaaauuccucuaaauuuggaagucucauaaaauuggaauccuaaguauuuuccuggcuaggccacuuagguugauuaacauauuaaaucuauuuuagauugcuugcaauuuuuugucucaaaauuuuaguguaagccuccuuugaaugugaggagauuuuuauaaaauccuaaaaauugcaugcaccuuguuuuuauuguucuauuugcuuaaacauacaauugagaccagguuuaguuacucauucucuaacuuuaauaugcaucuauugccaaauucuuagaaucagauaauauggaagaguuuuaagcaaguuuaaaaauaaagaagaucgguauuuugguuuuuccagaagccaaacuuaucuuuguugacuccagcugucacaggaacaacacauaaggcaguuaaggugggaacauagcaacauccuuuucaguaguacuguguugaguaagaaaugagcaauacgauugcagucauguuucugagaagucuuuuguccucugagcaguggaaacucccuguugaacugauuuuguauaccuguguaauaggaugucuuguauuucugguuucguuauuugccuuuucuuacuuacagcuaugggaaaauuccaaaaaucaaauauuuuacaagaucagugauuacucaguagaagauacauuuuuaaaucauguuuaauaccuaagccaaugaaaugagcauuauauaguuagaguaagcuuuuuuuaaugguuaguauuuaacuauaguauuugacuaacuuuaagaauaucaccuauauccaaauaauaaacucauucagcuuguaaaauuuugacguuucuggcuauugugacuguuaguccuggucuuaugaauauuucuuccauaggaaaauaugacagugccguuauguugacaucauauuugaaacuggauggcacuuagacuagaggcuuucaauuucagccgaacccuagaaccagccaguuucugaacucucagagauucugauuucauuagucuggagcaggacugggacacuaguauuuuuuagaaacucauucuaaugugcauucaagggugaaaaccacugacuuaaaagaacaaggcugacuuuauagaagaaagucaaguguuuacugccaaagauuagaguuaggcuuguuacauggaucaaucuugcuuugacccuuacauuauguggcacuuacuugauaagccuuucuaucuuuaacuuucauacugugcaaaugcaauagcacaguguauauuacagauaagaaaacaagauuuuggagucaaagaacguuauguugauuuuuuuucccuauuaaacucuaggauuugcagauacuuaagguauuuuuacaucaagaauugaacucuuggcugggcgcgguagcucacgccuguaaucucagcacuuugggaggccgaggcaggcggaucaccugaggucaggaguuugagaccagccuggccaacauagugaaacccugucucuacuaaaauacaaaaauuagccagguguaguggcaugcaccuguaaucccagauacucaggaggcugaggcaggagaaccgcuuggacccaggagguggagguugcagugagcugagaucacgccagugcacuccagccugggcgacagagcgagacuccgucucaaaaaaaaaaaaaaaaaaaaaaaaagaauugaacuuuucccccuucaggacauugagucacucauuuaaaaaaaaguuuaaaacuucucacucuuucucacauucaguaguuaacaacauuucuuucaucuugagguuucaucucauuauccucgaacagggaagauagauuuuaucucacuuuucagcccuaaccucacacuagaauagacuggaacaacuuggauuuagugauuccgaugcuuaucaggaaggucucuguucuuuuauaggaagaaaaaacauaguuauuuuucuuuuaugauacaaagguaugcuuucuaugcaagcuggauaccagaccaagaauaauaaaucacaauuucauaagguuucuaagacuugauauuauauggggauaugaccauuuugagggaaauguuuuacaucacuuuauguacuugaagcuaaggauacugcuaucuuauugcuuguuuuagugagcgauaagaaugaacagcagcuugggaggggccgggauaauauacuuguuuagaaauagcaauggucuagggaucugaagcuuuuccagcccugguucuucuacuuucuaaguuaugaucccuggucaagaaaccuaaccucuugaaaacucauguuuuuugucugugaaauuccugcccuguguauuucacagaaugauuaugugaaucagauuagauaauguauaucaaaaugcuuuggcauucaucaaauuugauggggcuguaagauaauauauuauugcaaacucagauuuccaaacagaaccccuuagagagauggaacaaaaucuucuaaaaagcaaguauuuuguuuugcucacuuuauuucaggguauuuuuuuggcuuugaccuguccuauucuggaauucaagagucauauaggauuaaguauaggcuacuuaaauuauugcacaagguguucauggccucugaaaugaaugaguuguuuaaaauaagauuauuuuuuuaaaaggcaauuaaugggaagccauacaagucccauuuaacccacugcucugucauagacuuuugcaaauugcgauacuuccguuacuauaauauuugccuagauucaaaucuacccuguggucuuucuguuuaugaauuuucacauagucauagaaaguugauuuaaaaacuuuuuuaaucauuaaagagcauuugaauuuauuauuuaaauagacaucucucuuccacucucaucuucucagaauucuaaagauuaugcuccuuuugaaaaguuuuggaaguuuucuuuggaaccucagagguaugggucaacuuaccaacaaucccugggaagucccuuuggcaauuagcagaaguucucagguuaccuuccguugucucucaagaaaacagggcuacuauacuccacagugcccaaagauuuuguuuggaauuggcaucuauuuuagugcucugaaaguuaaaaaaaaaaaaaaaaaaggacucauuccagcuaauuuguugagagaauauuaugcagugaacacuaaaaaaauucucagauagucucuaagucauuuauaaaaacuuucagguuaaauggguuuuauaccugucacaacucuuuaaaaacugcauuuagauccucagagaguucuauaugaacuuuuuugauauuuucagucauaagaccaacaugucauaaaaguguuuuuagagcuauaagacaguacacagauacacacuuuuuuuuaaucacuauuacugccacggaaaaacuguuuucucaguuucauauugagaacagaaugauguucugaacacuagacuucugaugaccugauguuuccucccuugcuuucuacgcuuuuauuaaguacauugaagagacacuauuggcuggcuuuuuguuuuucaguuuucauaaauaaaugaauaaauuuaugaacauuugaauaaauacucaaauaaaucuuugaauaaauauuuacugaacagccaugugccaggcacuucuaguugcaagaaauaggaagucaaucagcaaaguccaugugaccuucaccucaggauaugcgaaguccagaacagaagacaaauauuuuacaaauguuauuuaauuacugcuguggugugugcuacaaauuaaaaauaaagcauucagggagaguuaauaacccaggggcaauaaugucuucagggcagggaagaauuuggagacuccuucuggaggaaaugauauuuaagauucaagucaaaugagucucaacaugggaaauauauauucuguguaacuuuugcaugaaauggaagcaucuuauuucugauugucuugaugucagcuucagagugccuuaaucaauccaaagacuuauugugaaaauuaggccagagaaggccuaccuuuauauauagaaaguuaauguuuauagaauaguugaguaaccuaagauuggucagugauucauuuaguaauagauuuuugagugccuacuaugugccaggaacuaugcuuaguaaugcaagucauggcaguaguugauuuaagaauuauuuuauuaucaauauccuacuucuuaaacagggguuaucucucuuaaaaugagacuuuuuauugacuauuaaauaaacccagugguaguacuguguguuucugauuauauguuuaugauuguuuuaaacuaaaccuauaguuccaaacugugggcuucaaauugcucaggguagguuuggagagugaacaccaguuuaguucagggaauccucacguccauuuuuagguaugugcuuuuucagauaagagguaacaaauccaaccacuaucauggggguaguccuugcaauguuuuucuaaccuuaauucucacagggaaaaugaugggaauguagcuaaaugagaaugacccaacaaguucagagauuacugucauauauauuuagcaauugaugauaaaauauauauccucucagcuaggugugguggcgcacgccuguaguuccagcuacuugggaggcugaagugggaggaucacuugagcccaggaguucaagaucagccuggacaacauaguaagacuccaucucuuuaaaaaaaaaaauguuuuuggugaccaguauagucucagaguuuagcaaaaguaacuaaagcuugagagucacauuauacuucagcuuuuauuguuuuuauuaugauccuuaguuguguaguuuuaagacauuuuaccucuuaaaagaauuuucaaaaagauaaaaaaaaaagaauuuucagaauuuaccuguauauuguucuuuugguaugugcugcuucuggauguuaauuuauugaaaaauccaaguaugucuucacuuuccucuaauacccucuuuuaugcucuugcaucuuauaaauuguauaagauuuuaaagcauuuauauuggauuacagcuacauauuuguuuuuuuaagucaauaucuuauaacaauuccuacuagaagccuggugagggagaauauuuuucuucuuaacuggagcaaguaggugcuagguugguccauuuguauuguuuuuuauaaauucguucauggauaugcccuauguagugugguuuuucacuugauaugcuaaccugaacauuuuauaugccuuuuaaaacuaauguguugagaguuagaagagaagaaauguacuugauguaugcuauugaaaccaaagcaaucuuagauauaauaaaggaacaaugugggucaaagguauaguuuaucucagcucucucauuaugcaacuaguuuugacuguuuuugacauagcacuucccugugccuccuugcuguucacccuucaucaccugguaaguugugccuuuuucuuacugugcaguuaccuuaauauccacuacuuuaacaugaaauucuauaggguaucuugcagguuggaaguuaccauuuuaguuaaaccaaauuugggaagaauuucucccuuagaaagcuaauaauuuauucuaugguaccugagagcaguucuaggccacaggauguaaccuauuauauaugaccacuuacugacugaauauaagaauauaccccacucuauuaggcauugugaaucauugacaaaagaagaaggagggggaaauucguucgguggcuauaaaauuugaggacaggagauuccugagcaugagauaaauuacucuugucagcagaauagcaaaaaggcaggaggugacaggagagugaaauuagugaaaagcucuucgagccagaggggaaaguacuaggagacucaccucuucucuacucgcugcauauggcauucuacagugauagacaacucuuaacauguuucuuaucaaaaguuuucaaaugaguuauaugugagcuuuucaucuguaggaacauugcucagguguggaaauuaaccagagaaagaaaguugacuuuagguauucacucuucagacacuuggaaugugucuauuucugugauuacugguaauuaacuucuauuucggugguuuagaacucccuguacaguuauucucaaauuaagguuguguucgguaacauuuugccuaauaaacagagacagagacaauuaguucugaauauaguaucccacuaauugaauuaccucuauaagaaauaaucuagauauaaaauuucuuagguuucgaaguaacauagcugcuaauaggugaagauauguuauauugagacugauuuucaccguuaccucauagaaauccaucauaguauuuuggaguuauuaaauguuggguuuuaaucagacuuauaaaacuguuacugggccuuaaugugccucuagugcagcauuuucaagaguuugccccauaauacuaauuaaucaggaugugaauaaguauaauaggaaaauaggauuuuguggucaaauaaguuuggggaaugcuugauuaaaagaauuuccuuaaagacuccaaagccuuuaaugugcuuuuaugcaaugugauucuccaaaggaagaggauauucagaaauguuguaaacuuaguuaacuagaacaucucucuggaggagggacugauauucuucagaacccacuuugggaagugcugcugugguuucaacccccuaauuuuacgaaggaggcugugagauagguccagcacuuuguggcagaguuucuuguggcauccagaaaacugggaaguaugucgaacucccuuccaaaaugagccuuaaagauguuuccauguugaaggucaggaaagggccaggcccuuucuccauugcauuacuccaacagugaggaagggacaguuuuuaaaaacaugcggugaaugcuuagucuguguuugaagcaaagaagaccccucugugcagugaugauaugagaaaaaggagagaaggaaauguuugagaggaaaagaagagaggggcuuacagaagaggcaggagacacacaggagcagcagaaugggcaggaaacgcauauggaccuuugaagggccaggcugaccacagcacuccagguagguacugaggcgcccagugugauuauuaaacaccuuggccucaguggcaccaggccauccuagcagcuaauucuuugaauuacccaaaugauaugaauguuccuuaacacagcaaacuccugauuauuucugacauuguagauaguccacauacagcauuaaaccuuuauuuuagaugucaauuuaacuuccuuccaaccucacaauuuucacguaauuaauaaguauuaaaaagcuugagguuuaggccuuuccccacuaauuggcaguggugcugaaugggcuaacugcagaagagagauggggaaauagacugaacugggacuggggaauggaucaguaaauguuaaaauucaguguaaaaugaaugcauuuuucagcguggaguugaaagcacaguagucacugguugucuacaguuucacuuuccacuguuucaguuaucuguggccaucucugguccaaaauuauuaaacaggaaauuacagaaauaaacaguucaaauaaauaaauagcaccucauucugaguugugugaugaaaccuugugccuugcugcucuguccugucuucaucacaagaggaagggugaguacaguacaauaagacauuuugagagcaagaaagauuauauucacauaacuuauuacaguauacuguuaucauuauucuauuuuucuaucaguuauuguuaaucucuugcuguguguaauuuauaaauuaaacguuauuguagguauguauguauaggauaaaacauagucauacagucaugaaccacauaacaauauuucaguuaacgaggggccauacauaugaugguggugccauaagauuauaauaucauacuuuuacuguaccuuuucuguguuuacauauguuuagauacauaaauaguugucauguuacaguugccuacaguauucaguauaguaacaugcuguacagguuuguagccuaggaguaauaggcuuacuauagagcccaggaguguaguaggcuauuccaucuagguuuguguaaguacacuccgugauguuccacagcauugccucauuucucagaaaguauccccaucguuaagcagugcaugacuauacaggguuugguacuaucugggguuuuaggcaucuacuggggguuuuggaauguaucuccuguggauaaggguggacugcuggaguugcuuauuagucucaaauugcucaguugguggaucacuugcggucaggaguucgagaccagccugcccaacaugguaaaaccccgucucuacuaaaaauacaaaaaucggcugggugugguggcauaugcccguagucccagauacuugggaggcugaggcaggagaaucgcuugaacccaggaggcagagguugcagugagccaugauggcgccacugcacuccagucugggugacagagugagacucugucucaaaaaaaaaaaaaaauuguucaguuggugccaauaguauguuuaguccaauaaagaaacaaaagccucuugacauauguacacaaauagcuacaaaaaaauuuuaacggugaaauaguuugacagagacaauaaaaacgugcauaggaaauucagaguaagggaaaagagucuuugcuuaaauucuggcuuucaugcacucuaacucugagccucaguuucuucugaaaguagggaugauaauuuaggucacagaguuucauuaaggaugaaagugauagcaugaaagcaccuaaaacaguucugucacacuaauuuauaagguugccuagaacguucuguaaagaacucauuucucuggaccaaauucaaauacugucugaaagggaauuucaaguuaaaguuuggagaguagagugggcagcaggaaaccaucgggaaaggcuagagaugauguuccgagauaggcugaaggaagggccucuuuccucggaagggguuggggguggcuugggguauggaaguuagugcucauagucaguguugugaccagaaaggauuguucagaaucaggggaacugggccaaugcagaggccagugaacaaugugacauuuggccagcugcauuugaacuucccugauagucacccucccuaugucuauaacaaugaaaaagauaccgcacccuuuaauaugugaucauuaauagugaugagggggucauucuagagauaagaaccagacaacaaguaaacauucacaguuuuuaauucaggaauaacuuucaguguuuucuuagacauuuuauuuaaaugaagacugaggaaauucagcccuaaaauguauuucucucuguguacgaguacacaaucaugcuguuuauuaaacuaucuugcuuacaucuuuaaguauuuuuuauuuacuuuauuaguaacacuuauuugaaaaaguaauugggagagaaaaauguguuggauuuaugccucugauguaucacaugcagguugucagcucugguucaaguguguaaucucuauacauugcugacaagcgagagaacgagaaggauauaaauggagaguaugugaauggauuuuauuuuuucaagccccugugugaguuugcaacugugcugguaaggaaaaguucuuucauugugcaguggagccagugcccagugaacuguccuugggagaauggagaggauuucuuuccauuguuucucucucacagcaucaaguuucugguaaugguggcacuuuccuucuuuuguguuguggccagugugauauuuaaaccacuaaagcuuuaagaauuuuauuuuuuucuggacuuccuuuuuuaaaaaaaaagucuaauaauacagcacucuuuagugaaaaucauuauguuuauuuaucuuggguuagaguaaugcagucaguuaugaauaguuuuaaauuuaaugaucucuuuuauccuuuauuucaucuucaaauuaucauuuagucaucuucuuguggaagcugauauucagaaagaucaagucaguauuacuuaaaauuggaaacaguaaaggcugggugugguggcucacaccuguaauuccagcacuuugggaggcugaggcgguuggaucaucugaggccaggaguucgagaccagccuggccaacauggugaaacgccaccucuacuaaaauauaaaaauuagccagguguggugguacaugccuguaaucccagcuacucgggaggcugagacaugagaaucgcuugaacccaggaggguugcagugagccaagauugcaccacugcacuccagcuugggugccagagugagacaaugucucaaaaaaaaaaaaaaaaucggaaacgguaaccagaaauaguagaauaugauugcaccacaggauugauuuccagacauucugacuugcuugcuuuuuaccuuacccuuggcugauaccugcaaggucucacaugcuucucugccugccuuccaguugccucggcuauuugugguucuuggagugcuguugguaccacgaagcaaguccucucuacccaucaggucacuuucugucacccugagguuuauuuuagcccccuauauggaacagaagcccacaugaaauacuaaauaggaacuuuaaguggaauaaauucugggugugcucaaagaguucuucucuugcaaaaucagaaauugaauuugacacaugaaguauaguuaggccauguuuugaaaagcugcagcaauacuucucaggaaguugguaaaaaaaauuuuaauuguuugaaaauuaaaagcuucagcaaaaacaucauaugcucaauuuucucuuggaagaaauucuuguuacugcuuaaagcaccuauaaauaauguaggugaaacugaacauguuauacuacauguuuuauaauaguaauggaacugcucucagaauguagaauuaaaccguuuuggcuuuauaauguaaagugucauauaugguccuguuacaaucguaaauuuuccaguguuagaguuaaauuuaauuaaugauuuuuuuuuucugugccugcccacugaauagcuguguggccauaagcaauuuucauaggcucuaugcucgcuugcaaaaucagcuuaguaauaauaucugccccuccuaucuagugauuucuugauuaaaaaaaugagauaacauuaugugaaaguacuugggagguaagagugcuauauaagggcaaggucuuacuguucuguccuguuaacuuuuuacuucuuucucuuaccacaaaaacaccuaccacaggcugauuuaaauuggugaacuccucuaaaccaccuaaacuuggaauaaauggcgauaaacuuuccuuauauuuauuuucccaacucacagcuuaaacuggaaggaaaaaguguauaagauucacauuuaccuuuugacuuuagucaucuuuuucauaaagguuuauuccugucuaccauccugcccccucagaauuuugcauaaaucucauauaacaguucaacaagugacugguguagacugggccugcuuugucacugagucacuuuauuaugaaauacuuaaaguugaauaucuguauauagcaaugaagaaagaauguuaaacaguuuauacuuucuaaggccaggcuugguggcucacacuuguaaucccaacacuuugggaggccgaggugggaggaucgcuugagcccaggagguugagaccagccugggcaacacggaaaaacccugacucuacaaaaaaauuaaaaaaugaaaguaaauaaacaauucaaaaauuuauacuuucugaucugaugguuuucaugacuaacucaucagacagcaaugaaaagugaaauuaauaaaaauucacaaagccagauauaauuaguuaaaaauaaagucugaauaagccguaaucaucuuuacuucccucuucccauuuuguaagcaguugguauuugauugauaagcauguccagcugggaaauaaagaucuggcuucuaauccauguucuaccaggcugugaccuuggacaagucacguaacuucuguauuucagcuuccucauuucuaaaaugggguaauaauaguacuuggccuacauaccucauugggcaauuguagauaaaacgagauuguagauaggaauguuuugacuaccccccugccccacaaaauugaaaggugguuauauaguuaccacauacaguccucaucugacaacccauaucugaauggccacaagacugaagagugaaagaaacuuccugauucuaccaacaagaaugggaagggagucccuguuagcucuuagaggaggaaagauacauucccagugcuuagaucucugaaucaaauucuggaacacaguuucccacagaaaugacagucagugguuguguuucuggcuagccaauaaaaaaggaaaaaagagguuuaaccauaaauaguucauugugauccaauuucuauaaagcuguuaacaaagcccacuuguaguaugaauauuagcuuggaguuuguuucaaguauguuggaggccuuagcccaggucuggauaagauaaugaauccaccucucuucuagcuuccccacuuauuuaauauuugcacagggcuuacuuaagccagauuuguaaguaucaucaguucauacuccagucuccuggcccuuugacugaaauucugaaaccaacauucuuucccucagugaaagggugagaagcccuuucagguccccaaucccuuuaauaagcacagugaccuuacaaaguuaggaaagguggcuauuguugacucugagccucaagaagguuaagggacuugcgcagaucacuugguuagucucaagaggugagacuugaaccucaguguuuugacauguaauucaaggcuguuuucaugacaguucuguuucaagauggaugcuauucauugaauucacuuugaguuguaguuuucaguugagaguaagaauguuuuuagggagucuugguuauaaaguauauuuaugauuuuguacaucucuuauuguaaauuuuccaaagguaaaguuuugggaaauuuagucaaaacaaaaagugacuccccacacugauguggcguguguuagagagggauucuauuagaauuaaggaacuauuugaagcaaagaauacuguuauauguaacgguuauauuaaaaauaagaaaaacuuuugaagagccaguauuauuuacuucuuuaaaacuuuguguuauauuuuugaagugguaguggugugaauaugaaggaauuuuaggaauuuaaaguaaaauaaaaaugaaauaaacuuuuuucuaguuuuaaugauaugguuuauguuuauauuuauuaaaauauucaguucuuaccauaauaauagcaagccuagcuaacaugucuccagugcuuguuaugagccaggcaguauucaguuaucuccgguugaauaauuguuuucuucuugccagguuagccuacagauuuguucaugaucaauucuuagaaguagugagggauaagucuccaugauagaagacagugauaaggucuguauguggcauuacaugggacauguaaaaauguuucacugaauagugaaaaggauacugcaauuggagucagaagaccuagccuccuccuuguuccucccuggccuaacagugugacacuggguuagugacuugucuucauaaaccuucgauuuccuuaucuguaaaaagagaacagugauaccucauagggcuguggcaaggauuaaaugagauaacuuagguaaaguacuuaauuuaugccuucaaaagaugaggccucauguagcaggcauucagaaaauauuaauugccucuuuucaucuucaugcacaagguaguugugaaauuaaauuggaaaacaauaugaaagcugguuuaaaaacauuuaaaugucguucuaauauaagaugguauuuuccaaugaguggugccuucuucagcacuuucagaguaaaauauaugggagaauuaaggaaacuggauuauaacuagaaaaucuggauuuuacuggguggccaucacaucuggaaacagugguuuaaugauauuaucuuacagugcaacauguaauaguauuaucuauuugcagacuuggccacacuguagucucaguuccaucaccuauuguuuggcuuggagaaguaauuuaaucucucuaaucacugagaaucaaaauuauauacauuaucuucagaaguauucuauauguuaggaagcaucuaagugugguuuuuauuuuguuuauuguucuaauuuuucuauaauacagcaguuuuuugauuagacuugugauggauagaauucauuuucacuuagucagaaaaucuuucuaaauagaggagaauuagaaggcaaaaggcaauuugauaggugugcuagugggaaguaacuucaaaucucagggagccauauuaauuauagagaaagcagugccagagaauuugauaggcugcuagaugggagugaacagagcagguaaaggauaaagagcauuaauaaacugauggaguauuaauaauuucauaaucuuuauuguguugggugagaugugauaacagggaaaagauucagccucauauccuuggauugcccucauucugggcuguggacaugugguauaguguaaagacaagggauuugaaaucagacuuacuauuuauuagaaaagucauggcacuuuggaaauuaauuaauucauggauuugaaaaaauguuacgaucucaaaauagauguuuuugcuuaucuuuucaguuacuguagucauacuaaauagguuuuguuguuguuguuguuuuauuuugagacagagucucgcucugucaccaggcuggagugcaguggcgcgaucucagcuuacugcaaccucugccucccagguucaagagauucuugcgccucagccucccaaguagcugggauuucaagugcguaccaccacaccuggcuaauuuuuauauuuuuaguagagauggggauucaucauguugaccaggcuggccucaaacuccugacuucaagcgaucuccccgcuuuggccucccaaagugcugggauuacaggugugagccaccgcgccuggcccuaaauagauuuuuuaaaauggaugcuuagcaagaacagaaggaagaaaacaauucacauuuuccugucuuucuggugaauuaguucuuugauucuuaagauccucuaguuguggaggguaugaccagaggacccagggaagacacuucugcuaccaucuaguugggguacuccccaguggucccagcuauggaagacuggucuuccugguuuagagugccucaauaagaaaggacuuccaugagacuuagcacuauuccaucuccauucuccuccgaagucuuuuacguuccucaggauagauaacucaaaguuggccaggccugguggcaugcaccuguaguccuagcuacucaugaggccaaggcaggaguauaaggaugcagggaguuauaaaggugccacugcacuccagccugggugacagaguaagaugucucauaaaaagagcaccacguauguggauuccuccuccacugucucccaccucaucuccccuccacauguacucucacacaaagacuggagcaaggcagacuucuuucacuuucacugugccuuuaguagcuaacuguuucgauucuagugcaagauggcucuuuaccaccagauaagcuuugguaugaccaaccacuacugaguuguguaguaaagcgagguuuaucuaaauauguagaagaaaguugagauucucauuaguuagaaauuugauugcucgaaaucuugaauuugauguaaaacagaauaagcaguuagggaagggaacauaauauaggcuuuguguauugagaguugcauuaaaagaauugcaaagucaaggcccggcauggugguuuaugccuguaaucccaggacuuugggaggcugaggcgggcggaucaugaggucagcagauugagacccuccuggccaacauggugaaaccccaucucuacuaaaaauacaaaaauuagcuggguucgggaggcugaggcacgagaaucacuugaacccaggaggcguagguugcagugagcugagaucgugcuacugcacuccagccuggcaacugagcaagacucagucucaaaaaaaaaauugcaaagucaauccuaaggcaaagaggcuauggaagaaauuaugcuaaagggaugggaauaguuuaggcuagacuuggggggaaaaaucaguggaauucuuuuuuuuuuucuuguaagauuuuuuuuuuuuauuuuaggaaacauguuuucuacauuagaaaugcaagcauugggggaaguuuucucaguuccacaugcugugaugucuuugaggaggugaggacaggaaaggguagacagaacuuuaauccuugauaggaaaauauauguugagugccaucugggaaacuucucucugacucauuuugucaauguuggaaccaagcugaaagucaguuugguuguucaaaggucuccuuaaucauacaguucggguauuucauuugauaaacauuaccuggcuuaucauuucaaaaccuguuggaagaauuuuugaaaucacuaaucgauggguuuaauuucuaugaaagauuuuauuuuuuuuuguggacuacuuaugaguuuaagcugccucuuccuaagagcauaaugucuauaucacaagcucaugaagauuguagugaauggcagcgaaacacuguucuuuguauaaaugcugagaugugcuuaaauagauuccauugacaagcucuuggaaguuucuguguuauaagcugcauuuagaaggagugagaaaggaaacacugggaggaggauggaagaaaaggaagaagacugucuagagucuuuucugccaguugcccuuucucaaagacaaauggacauuugucuugguucauuuggccuacuguaauggaauaccauaaaccaguagcuuaugaacaacagacauguauuucucacaguucuggagucugggaaaucuaugaugaaggugcuggcauguucagcaucuggugagggccuaguuucugguucuuaguggcaccuucuggcuauauccucacaagauggaaugagcaaacaagcucucuggggccucuuuuaugauggcacaagucccauuaaugagggcuuugcccucgugcucuaaucucuucccagaggccucaccuccuaauaccaucaccuuaaggguuaggauuucaucauaugaauuuggagggcacacaggcuuucagacuauagguauaguuuggugcuuuucaacgcuuguucuuuuuguuacuuuggccugccugucugacaaacagaagauaugugguaauaagaaugaagccuauuuguagugccuaguaugucuaacacuguuugaggugcuuuauacacauuaccauguauucucaaccaggguauaguagauaauaacagcauuuuuguguagaugaggaagcuagggcuugcaguuaugugacucacccaggguuacacaccuaguaacaaauccagagaauauuguucaguuguucucuuauuugaccucucugcuauugacaacuguuccuuccuuccugaauuuuuauuuuccccugacuuucaugacaacacaucuguuuuuucuucuagcuucuggucacuccuccauaaucucuuugguagauccuacuucaucucuucacucaguaaagccugcuauuccuacccguucuucgauuuucuuucucacacugcauacucuuccugagaaauagcaucuaugcucauaacuugaauugcugucuuuaugcugcugagucccagaucuuuauuuccauucuagauuucucaucuuagaaccacacacauaaacuuaaugauagauuugacauucucuacuuaaaugugcuauaggcuccuuaaauucagugucccacagugacguuuuccccaugauuuucuccugggauucuguaacuucguaaaugguaauaucauccacccaguuucuccuaucagaaaucuguugucguccuuacuuccccuacuuagcucuucacauuuuacauuccaucuccaaauuuuccugcuucucaaauuaauucaccuaccuccauucccauguucacagucuucaguccccuugggcacacuggcugcacacaguugcugucuucuccuauauuucuuaucugguagcccacgagaucuuucuaaagugaacauuugauuuuuuuuuuccugccuuuuccauaacuuuaccuucuucaguuuuuccuuguuacuuucagcuuuaagcucaaauuucuuuacaugguguacaccccuccuuaccucucuagucucauuuuguacuauucuuuuacacuagcucuuugaauguucucuugccucuggccuuagcacacacuaucuacugggagugcuuuuuuuuuuucauuuccaaauagcugacucuuucuuacucuccacagacugaggcuagcuccuuucuuacagccugcucugauaucaucccaucucuguuugccaaguggauuacucucaugugcucucauaacaucaugaaguuaaucauuuuucauagcauuuguagcuguaaccuaguccucucuccaaaaccacaucucagacauauaacugucuucucuucauuuucacuuuauuucauucucauaggcauugcacauuuaaccuuccaaaacuaaacucuuguuuuucuccaaaaccagcuguuccuccugacuuccccaucuuagaaaauggcaguauuacuauuccauuuuuaauuagaccaaaauccagaguuguccuuuguuccuuaauuuuuucacagcccauauccaguccaucaauaaaccuuacucuuuauuucuuuuuuuuuuuuuuuuuuuuuuuuuuuuuuuuuuuuuuuaagacagagucucgcucucuuggccucuugggcaggcuggagugcaaauggcgcugucucggcucacugcaaacuccaccucccggguucaggagauucuccugccucagccuccugaguagcugggauuuacaggcaugugccaccaugcccgacuaacuuuuguguuuuuagaagugaugggguuucaccauguuggccaggcuggucucgaacuccugaccucaggugauccacccggcuuggccucccaaagugcugggauuacaggcgugagccaccgcacccagccaaccuuauuauuucuaccuacaacauguauuuagagucuaaccaccucucacuguuucuccuacugucacccuaauccaugccaucaucacuuuuuaccuggaugccugcagcagccuacugacugcucuccugcuucugcuccuccuccccuaaagugguucucauccucacagccagaaugacccuuuuaaaaagaaaaucagagguuuuuacuacucugugcaaaaccuucacacaucucucucagaauaaaagcuaaagcccuccgucaucugucccacuucgcacccugcuuugauuaauacuacugaccucauccccuguuacuucccaaacccuuuuuacugugacuccaacuauauggcucacccccucauuuucuuuaggucucugguucagaugucgucuuuucauugaagccugccuugaccguccaucacagaagagcucacucauuuccacucugcucaauuguucuccauggcacuuauaccauuuagcuaguuacguauuuucuuauuauucuucuacucaaguagaauacaaacuccacaagggcaggaacugguucucuugacugcuguguucccagcuccuggagcaguguguggccucuaauaggcucuaaguaaauaguugaagucuaggguuaguaguaugucauggacuuagcgauauaacagaccugcuaaugcagucaguccuagcuccaauacugagcucuucaaccccuuguaauuagaccgcuccucagcuucaguuccuaaucaauagcauaggauguauucauucuuaccuauaauguuauuuguuugggggaggguuaaauaaaauaaacaguaugaagugcuuaccucaguaccuugccaauaauaaauaguugagagcagcugcugcuacuaauacugcugcuaauucugaucagauuacagcauuuaaauugcuucugacuuguucaucucuucuaccagauuuugucuggcuacaucuuaaacuugcuauaauaauaauaauaacaacaaugugaccauaagaauaccaguaauaauaauagcagcugugaucauuugagugcuuaccaaguacuagagaguauucucuaagucagcacuucccagugccucuuccugcagugauggaaacguucuauaucugcucuguccagaguggugugguagucacuagccacaugcagagagagcucuugagcacuuggcagugugaccgaggaacucaguguuuaauuuuauuuaauuuuaauuaauuuagauuuuaaugaccauguuggcuacuguauuuuaaaacucuaaauucuuuaccuacauuaauucauuuaauacucaaagguuaaguagauuauagaugaagaaauugauugucugaguggugaagaaacuugcccaagauuacacagcuaauacaaggcagaacugggauuuaaagguuaaagaccuagauaaucugguuccagggucuguugccagccacccucugugcugcaccucccucgugucauucucaagaauuaaagucuuacaggcaaaggacugagguggcauaucuguauucuugcugcagggaaagcugagagaauuucugguucuuacugcagugcaauaucacuccuaaagugagaaauucccagauuuaggauaaauguucaaacaguucuagacagguaagcuuggcuacucaaccucuguguacacuuuuuuccaagacuuaaauuuacaaauauaguggcagcaacaacaaaauguuuccuccuaagguguugcagcuauuuuucuaaaagcgaaaaauaugcucucccccuccccaaaagggggaaugauacaucuuaccagguaccguuuccagcuugaaguccaagauaucugagcugagcuuauuccuuuuguuaagguugccuuaugucgcucuacaacuagugagccagcaacuuauuuuuauaaaacauuaggagaaaaagagaaggggaaauugguuaaaaacauaaauauguuuaugucagaccaaaaaauaaauaugaauagauacuuuagucuuagcuuuugcuauugguucugaauccaaaguugguauuuuuaauucccuuccuccacuacucauuccauguucuuuuugcccucagccagcucucagcuaauuguagauuuuuaucuguagauuuuuaucugacugacguuuaucugacaacacuuuagacugucauucacaggggugaggaaggaggcuuugaguuguuggugguccugccuauauggaguuauuucuaucuuccauuaucuuucaccgcuagauguggucaaaccaacagguguuccagguuccagacacacaccucccuucucucauccuguugcaacaaucuucuuuacccuugauaaucaagauucauuaacacaaccaauucugucaccucccuuuuugucccuguucugugucaugaggaguucagaauugcuagguugcaguuuaagcuuccaaaucaguggagguauuguugagucccuuggugaaaucauucuucacuugggugcugagacuguuaaaccagcagaaccagagucgcagugaugggggaauugcaaguuggucauuaggugugaugagggggaggagaagauguguaacuaauucugcuucugucccuugguuacugggcccuguauuauggcugugggagaaacaauguuuuguauuauucacugguucugagcaucuugggagacaccacccuaucuaauuuuauuuggaacugaaucuucagaagaugauuucagcauucugaaagaugaucuucuagaugauaggguaugugguaagaagagcaauccauuagcaucauaccaucauuguacucuuucacuguuaaaucuugagugagauaccauggugaugaaugaggcauucagucauucuguggauggcagagguaugguggacaggaaaggcaguuucauauucagaauaugugucuuuucauaugaagacugacaagugaccacugaaaguuaggauguaugucugaaaucauguauguuuucauaaaauuaaaucuauucuguguuguuacuuggaggcacaagcaaaguaaaacauuuaaggugaacggggguuugaguaaguugaaacuggcugacacugacucacuaugaccuugggcaagaugcugaacuacugcgagcugccuauuccucauaucugugaaauugggauaaugauauuuuuguguauauaaggcuuugaaccacucagacgaaaggugcuguguaagugcaaaguguuguuaacaacaauacugauaauccucauuucaccuugcccucaguaugaccuguguuuaaauugagcacuguuaaaaagauugccugugaaaugguauccuguauaguuauguugcuguauguucucccagcacuugauauauuuccuucccaacacuuuuuauaguuugcaauaaucugcuugauuauuugaauauuuguuucccccacuagauccaaaaaccucugagcacaauggggaccacuuuugucuguuuguuauaauaucuccaaggccuagcaugguucccacaugugguagauguucaguaaauauuuacugaaugaauaaaugaauaaauaaauaaugcauguuucugugaauuucugccaaaacaacacaaaaagccagagauguaaaaucaguuucguuucuuuuccaccaguacgggaauucuaaugcuguauucuguguaaauaaaucauuccgguuggucaucguauuauagugggcauggugccaugggaaauuuauuggaguaauuuuuaacagccuaaauguuuaguaacagaugcacauagauggcagguugccucauucagcuuccaucuguuagacaacugucuauucuaauaagacuggucuauucaaacuagacaaauaacauucuuacccauguuuaagcuuauucauuuucacaauuuuuccgaaaggcucgaaggaggaaagguguuuccauguuugguuggcugcuacuuaauaguaguguauuacaacaccuuggcaaaccgugaaguccacuugaugugucguaaugcucaacaaggaaguauucucucuuaaguguuuugucaaaagucaaaaccaugcuaaauaauggcacuaggaaacacacucagcuacagauaauuugguccaauagaguucaguguagguugugcaacuggcaacagaaacuggcaugagaugaagggguauaauccaugcuggucaucauuaguaugugugauuuuuaaauaggacagaggcaauauacuaaacucuagaaaauauaguguguccauauguacaugcaguuagguuauacccagugaaagcaugaugauucucagcuugggcaugccuuuuaagaacaacuuuaccaaguuuuuuuuugcuauauaaagguggagacaguguuggccuauauaaauuuacccugugcaugacgaauuggguugguggugugucauuaagugugggccaacuuccuuaaaugucuuggugcuuagcauaaugccuggcacccaacugggacucaguaauuauuuguugaaugaauguucuaggaucaguugaggcaauucccucuggauuucuagcaugaaagcagucccauaaccuuagaucacuaugaauuaaaacuuggaauaaaaaguuggcauacuuagaguacuaguacuaagcagaacacaaagcaaacugcuuaucacuaguaugugucugugauaaacuucugaaggcugugucauuuccuaaauguaaaucacuggguauguguuauuuugggaggcagacaucuaacaauggcuguuuuggagaaagucaaucuaucugggucuugguucaguuacaggaaugacuaauuuuauacuagauucucacaugauucaaaaagugugugaaugacucagcucauuaauauccuuagcuccugugaucuccccucccagugaaacgaugguuauaaggcaauaaugauaauuggaagaggaggagacuuugacuuugccccguggcaauaaaaugacacacuuuaaguaauuacaugugcauacaauauuguuugaaagaaaugaguuauauuaucaucauauaaauacauuuaauauuuguguuaaaauauggugaaaauaauauguaguuucagcguggaugaggacugaguucugcuuuuuguuucuaccauuaucuuuuuuccugaaacaacaagccucuauauggacagagccauuuggagcccuaacuuaguuccuaacagucaacucauugauuaccuucuccuugcugacauagagaaauguugcagucacagggguguuggguucuaauuacauguagcuaaguauucacaagugauuuugagcuaaaaugagcaauucguugaagagucuguggaauuucuggggauuugcguguuucuuccuguuacuguuucuuucuuuuugcagcaauuuauuaaacaaagaccuggauauuuggagucagccuuugcgcauaugucugcucuugcuagagucucuagugacucaaaaaucuaaugcacacuuuucacuucuuauuuaguuucacuucucugcagcauuugacagaucucgaaauuccuuccuaaacuuuguggauauuuucuuuugguuguuucuuaacucuuacacuuuuucuuuuuaaacucuucuagccgcccuuaaaaugugauauccuccagaguuuggucuugguccuuuuuuuuguuucuauuuauccagucuccuuggugaucccauucauuuccaugguuuccauuaaaauccauacacugguugcuccaagugggugucuuuaugucagucuugaugagcuauagaccuguguauucagcaacacuggagauauguauagauagauaauaauaguaacaacaauacuaacagcuacucauuauugaauauuuucugcaucagacaggugagcgcuuuauugcuucauuuauuuaccucacagcgacacuauacauugucuuaaaaaccagaaaaaugucucauaaagaucccgauuucuaaguguccuggaaaagccugggcuugccuucuuaccuggcagcagacaucggcagcugaguaacagcuuuccucuuaccugggacuuguaccauuacuucacacaguccucaccacuuccuauuggccugcacuuauugugaguuuccucauauccuugcuggucuagccccauaggcauuucugacaccuguaaggacaauugacaugcuuucccagcugguugcagacuucucuauuuuuugcccuaguacuggaaugguuuucucaaaugaaauuuguuacuugcuuucucuuaauaguuuucuauguauguuucuuuaucaccuccuccucuacccacaacuuuguuaaagucucuaugcugaaguuagaaggaaaagaauaaaaguuuuugaucauuuacuaugggccagaguuaaacacaggcuugguuuaguuaagucuucacagcacugaaguggguguuccugauuccuaauuaagagaugagagaauuucuggguugaagaauuucaacccagaguggauucagaucugucugaucccgagcucaaaguuuuuucuccucuaucauaacaacuucuagcuccuguuccucuauacaaauaaacaaguaucuuuagcacucucauucccaugaucugcuucucaucuuguuccuccuuugccaucaaacuauauucauugguucacacagaacucuguuaaccccuuuucucaucucaacacaguguaauuuagccuucugauaauuuacucguucacccacaucaucugagcacccacugugcaacaggcagcgggccagacacuagggacauaauccuugucugagagaagcuucauggagccauaauuccagcgcugugugcagaaugccuuauaauuaaauccaguggauuuaaggauuagcccuuuucuuacuuaagcucacuugcaucauuuuccccaaaggacaagcacuucucuaauggaaauuuucucuuuccuuucuucuguagcauuccucacugcugguuuucuucuuuaguuuuucagaguuccuuuugcaucucucuucuuuuucuuccagugcccucauuuuaaauguuucuagcuucguacuagguaacuucacuucaaagucuuacaguuucagugauuugugcugcuuuccucaagacaauagcauuugacuagcuguccacauuaaauaucuuggaggcaucauuacucucuugucuuccucucacaacaagaguuggugauucugcuucuaaaacagcaucccaguugccagccccucugccauuaguuaacauauggcagcaacugcccucucccucccucucaguuguguguccuccaggcauuaacaauaguaaucauuuuuuuuaaacucucauuaucacuuuaccccuugaaaucuuguagugucuuucucgcugccuguugggucaggucucaguucuauaaccuggccuccagagcuguugaccgucugcuccugauccacucuucuggucuacucucauuuuagcuacagugcuuagcacacagagagcacucacugaauacuggaugaguaagcgggugguacagaaaaaucugaccuuuuguugucaaagggcagaauuaaauuuuuaucauguaaguaugguaccuacuauuuacuucucaguaacuucucucauuuuuaaauuauaaugauauaaacauuaauccaguguauuguguuucucuuaaauucauauguugaaguccuaaccccuaguaggaccucagaauuugacuguauuuggaaaucagguauuuaaagaagucauuagguuggcugggcgugguggcugacgccuguaaucccagcacuuugggagguggaggcgggcggaucacgaggucaggagaucgagaccauccuggcuaacacggugaaaccccguuucuacuaaaaauacaaaaaauuagccgggcauggugacgggcaccuguagucccagcuacuugggaggcugaggcaggagaauggugugaacccgggagguggagcuugcagugagccgagaucgugccacuacagccugggcaacagagugagacuccgccucaaaaaaaaaugauaauaauaagucauuaaguuaaaaugaggucaguaagugggccuuaauccaauaugacugauguccuuaagaggaaauuuggacacagaccuguguagagggaagaccauuugaugccauaggacccagcccugcuuggacuugcccugaucuuggacuucuuaauuccagaacugugacaaacuaaauuucuguuguuuaagccaccuaaucugugguacuuuguuauugcagcccuaguaaauuaauauaccuaguaucuuuuaauucacugagauucuaaguccuguaucuggguagacuuuauuauugggaaaaggauggaccuaauaaucuaguagaucucuccaucucaaauuucuuugagguauuugaaauuugaccaaggaaguuaaaggcuacaguaaacugugaucaugccacuguacuccagcugggugacagagcccgacccugucucuuaauuuaaaacaaacaaacaaaaauucuccuaagaaaagaggggcaucuuuaucuuuuucaugcuacaugauuagccacucaauuuuuuuuccuuucauuaaucugugucucuuagauauucaaacaaagcaagaaaccauuaaaaaauaguuagugcccauuuguuuuauugauuuaaagagauaaugaguugaauguuuuuaaauuucauuuugauagcuagaguacagucaguucucuuugcaauggauggccaugcagacucaaacuuucagagaagacauuuacagcagugaauuuaugugcuuuacagcaguuuucuaaaaguucugguuauggggggaaagcacagugaaucacuaaaaauuugguuuauucagcuuuuccuagucauauuucagguugucauguugucagaccucaaaaugccucuccccuccauccucacugcccccacucagucuucaccuccucagcagugguuguaguggaacugugggaauuaaguagguugacuguguuagagacuuuguuggaaaacaacauucagauuuuacuuauuaucugcuuagaucaucccagauuacauaauaauuucagacugauuacaccuugacaaggcucaccugaaugucuuccuauaauguuaccauuaacaucuuagguggaugugaguccauuuuauuuuauaaauccagaaagagcgccuauaauccuuuucuaagaaccagcaauuuauuuucuaggucugcucucaauucuucaugcuacaauuuugaacuucuugcauuuuguucuauuauguagagguagaggauagcuagucaccguguauaauagcucuuauucuugagauauaaggcacuauuauauugccuuucuaucuucucuuuuccaaauugagcuuuauucguucuuuagccauacaguacuucuguuaaauccuuaauuacauauaacacuugucauuaaagccucuccauguuuucuaaaacucucuuuaauggugaauccagcacuuggggguuagcaauacaagaagacaguccguuccuacacuaaaauauaaauuuuacacauuuugguuucaugcuuaauucucauuuucuauuuaguaaucaaaaugcauagcaauuaagcaaaagaagauuaugucuuuucucugugacaaaaguuaaagcauauacuuugcagauaaucuuuugaauucauaugcauugauaacucagauucagagagauuagaaguauaugcuacugacuagaaccaauaucaagaauuuucuguaucuaacuuguagucuuagcauuaccucugacuaguuggauguagaagauaagucauuugacuucuuucuaaaucauuuuauuuauuugugaaacuggggggaggagaucaagauuagauuaucucuaagcugucuuccagccuagaaauuguacuauauacuaauaauaauggcagcuaauaaauuguggcuuuuaguggguagguauauuuggagcuaauaagauuaacuuauuugaaauacauguugaguacuaccuacugugugcugggcacugguaauaccgugauaaaucagacaucuuucaaggaguuuauuaggggaaagaggcauaaaaauaagcaauugaauauuccuggaguggugguagaaguccgucuaaaguguauggggcacaauagagaguuuggugaguuuugcuuggcagcaggagcaucaggaaagggccagugaugaaagggagcgauuaugaaggccugauggagagcagcugcagcaaagugauaaggcagcagcuugacuauaguggcuaaagcuggaggaugagaagguggaaagaguggcuccuuuuuucccccaaggagguggaauaugaacagaaaauaacugggggcagggaguugggauuauaagagguuguuuguuuuaaaaaaugggugugaagagccuguguaaagguucuugagaaaagagcccguugagaggaaaguuuguugugaaggagaugaagauguaauaaagaacaggguugagaauggauagcgagauagauagaugaauagauaugugauaacauacacagagcagaauguuaauuguggcaccuaggaaguagaugaaugaguguucauaauauacuuccuucaaccuuucugcauauuugaaaauuuauaauauugggaaauaauuuuauaauauuggggauggaggagaacauggguugagaauuuagccuugaacagaaccagggggcacuuauuccuuggcauggcaggacauuauggaaggucaaggcuaaagccccagccacuuuuguaaagcagaagugacucugaccugcuaggguggagggccaaaaaaaaaaaaauguugagcaugaaggauggaauaaccacuugugagugugagagaggacugagcagacuuggguggugaugcucaggucuggugaaguugccacauuugugauuuucccuggcaguuaucagaagacaacaaguuaguaggaucauugaagggccacuagcuuacggaagccaaaauagaaugaguaguuggcaugaaugagucccuucaguauuugccagcagucuguccuagaacaugucccaaccucucuggugcuuuguucaagagauuguuuucaaccucacuaucuuuugcuuugaauuaucugagauaaaaacaauguugcaaaacuuuguuaacacuauuauuauuaacauuuaacucagguaauuuuguugucucccuuaggugaaagaagaacguccagaaaaaauaccagauuuaaaauuauugguagagaagaaauuuuuggcuuuacagagcaagaauucugaugcagacuuucaaaauaaugaaaaauuuguacaguuuaaacaacagcugaaagaacuaaagaagcaauguaagucaacaugcuuugcuuugguucggcuuuuugaaauuagggaacugacuugaugaacagccccaguuaacugauuuuauaaaguuugcuuaucugcuuggcuugauccucauucuaaguugcguuuuauuguuguugcaauucuguauuuugucuaauuuuugguucaaaucagccugcucauuucugaaagccaacaguuuccacaaagugcucagaaaauuucccagcagcuaguuauguguauugucccauugcuggggagggaaauugggaaaacaaaauaaaagugaaaacuauuuuauuuaaauaacaaugguaucguucaaguuuuaaacugcugugccaugcuuuaaaauaaccauacuuugauucugguuuugccucuuuggaguaauauuagcuauguuuucucucagaagaccacuuuaucuucucaacuauagaccaaaaucuccuugauccauuuuagcauugugguaguauaaauuccaugugguuuuuaaauuguugccuucuuaauaaacuauuacauucaaguuuuuuaguggacauaauuuugacuuaagaauuggagcaggcaauguaauuuuuuauaccaaaaaaauuuuuuagacaguauuuaccagaaauaauauaucauuucugcacaguaaaguauauaugcccuuucuuuucccauucuuccauaugguccacauaccaauuuuauauaaauugauuuuuucacauuagcaucuauuuaguccuguagucuuugcuucuuuuaggauugagacgcuuguauuucuuaaagaagugaauagugaagcaaauaaccuuuucuaacuuuagucucccaacaccuucauuuacacacacauggagcaggaguguuguaugauaugagacauaaauuuaccucguguccuuauaugugcuuaauguagggauucguauuuugaaauaggcuuucuuuuaaauauaagcauuuucuuuaaauugaugcugagaucucaaaaaaugacugaggaagcugccucacuuuugucuauuuuacaaauaacuuaaguuucacaauuuggaauguuuugcaaucaugaugagacuuuuguuuuuacuguagacuuaaccaguaagcauuuuccccauauuuuaaguuuauuuuuguucuuuuuuuuaacaucacagcucccaacauucuucuaauguauuuuucacucuucccucaaaugauuaauaauuucccaaagagauaauaauuugccaauggcuuucugaucuuaaagaugcuagugaauuaauuguauagccaugagaauuagacauuauuccccuuaaauauacaugggccauauagucuuuaccuuuuauccaugauauuuauuacucagugguguguguguguguguguguguguguguauaguaucuggcacauggaccugugauuaccagccugaggccaacaaaccccucaguugggauguagagauuaaacaaagcuuuuaaaagcucacauuauaugaccucaaguuuguuuaccuggucaucucaugguaauuagaaacucugauuggcagcuuucgauuucuugauuaaaaaccuaaauaaacugauuguuauaggcauuuuuucaaaggcauucucagugaaaagaccgagaacuauucuauuuggugcuuagugaaaauauuuugaacuaauauauguaccaguuauuaacaucucuuuauuaaaugcaauaguuuuuugucaaauaaauagcaauuuuucaaucuugaaaaaaaaaagaugcuaaugaauuucaguuuugguguuggucuaaguagccaaauguauuuuauuugacuauuuggagccaguacucauaaacuguggcagacuuagcauccaaucacaauuccugaguuuuaaguaauuuuauaauacagguugaaggacaaauauucaaaaauauaaauuguuccuucuuuuguuauuguuuacaaaguuauuauuccacaagguaaaggaugaagacuuuuagaaucauacucauggagaaacacuuucuaauuaagaacauauaauucaaaaaaaugauaaauguugaaaucauggcuauuacuucuuaaaucucucuaaaauggaguuggaaaaagaaagaaaauguuuccucaggccaccaguacacauuauuuggauagacagucaaaccuuauguauauuuauauugaaagaaauacuuccuuauaaaguuucccuguauauuguaacacuggaauuaaaauaacuuuccccuaaaauaauuaaaauaaaaauuuccccuagaauuuuauuuuaaaaaguuuuuagauuucaaaugacagaacaagcaaaauauuaauacuuuugaaaaauacucuauaagaucuguauaccuuacuugcaaaauguaauuuuagugcaguauuauuaauauaauacuuguauuauacuaauacaaguugauacaaguauaaacuuguaccaugucuaguggauuuucuuucuuuagauuuaacacuguugugaggguucuaauuaggaucaggcucccacaguauuuguguagccaggucaaagguacacuaugauauguaaaugagcuaaugaaucuguuuugagauauguucuggcggcaaggaauuacaauaauaauuuuuuuguuuuuaaagauuagaaaauagaggccagagagagagacuugcuucuagaugccuguuuugacagaguaaaggcugaagugcuuuuauggucuacauagauccaaagaguucuuuuaugaaaauaaccaccaugucuucacuaacuuuauuauauaagaacauaaauacaugggauuacauuugacaaaaucaggaucuaaucagagaaaugcuaggaaucuuuuagguggggagaggccaagauacagcuugcaaugaaguugucucccaggugguuuugucucaagggcaggccuagguacacucugcuggcagugcaccagcuguaaguuaaucuaucuguggcucagcagcugguucucaaaguuuuuggucuucugcucccauuacauuuuaaauuuuuuuuuuucuuuuuuuugagacagagucucgcuuuguuacccaggcuggagugcaguggugcaacccuggcucacuucaaccucugccucccagguucaagugauucuccugccucagccucccaaguagcugggauuauacgugcaugccaccaaacccagcuaauuuuguauuuuugguagagacgagguuuugccauguuggccaggccggucuugaacuccugacuucaggggauccacucgccucagccucccaaaauguugggauuacaggcgugagccacugcaccuggucacauucuuaaaauuuacugagagcccccagagagcuuuuguucauugguuauaucaacugacauuuaucauauuagaaaucaaaacugaagaauucuaaaaauauuaacauaugaaaaauaagccuauuacauguuaauauaaacaguauuugauaugggauaccacuuuacauuuuauaaacauaaaggaaaaauuauugagaagaguggcauucuuuuacauuuuugucaaucucuucaauuuuuggcuuauuuaaauagaagguaacuagcuccucauauuugcaucugcauuuggucuauuuuguugacguacacaaagaaaauuuugucucacacauugguaauugaacuugcugaaaagaucuugcagaccaccagaaguucucacuuugacaacucuagaucuaggccuggggucaguaaacucugggccauggaccgaauucagccugccuccugauuuucuauggccugcaagcuaacaaugauuuuuauguuuuuuaacuguuggagaaaaaaaucaaaaggggaguaauauuuggugacuugugaaaauuauaugaaaauucuauuucaguguccauaaaugguuucaugggaacauagucauacucaccuguuaauguguuuucuguggguacugucacacugucauggcaggguugagugagugcaucacagaucaucugguuagcaaaacuuaccguauuuauuaucugacuuuuuacaguaaauguuuacugacccuugaucuaaauuauauucagaaguaacggcaguuuuuauuuuuuuaauuuuauauuuuuucccugaauaccauccauuugucucaaguacauucagaacacuuugaggauucacuguguaugaauuacuacaguugaggcucugaaauaaauaaaaagcaaaaagcaggaaucuguacaugcagaagacaguguauacaaacaugauauaauaugacaaccauuaauaacaaauaucaacucaaaagcaaagaaaacaucagaaacaaauguuauacaaugugggaccuaagugaggagagucaaaacaggaaugccaugccagucaacugauauggggcucucuggagcaguagguacagaaagauuuugaggcuggguucagccccaguaggaaagaaugugcuaaaagauaacagugggaaaggagagggcaguacagaugucuaguauuuaccauccccagaauacaaaccuaacagauauacuacacucauuuagagauacuguuacucuaaagauaauauauuucaguuacacacaaugauuuucccaauaguuaugucuuauagauauuacuaggcauuagauauaacaucuuugaacaaagaauuuuauccuuuagauacccaguguccuguauguuagaaauaauuaggucugccucagcuuacaucucagggucauuaccaagauuaaaugagauacugacucugcuagcucuaaaagcuuuagauuuaaguuauugaggaagagcuaguacagcauaauggaaagaauguggcuuagcagacggaagacuuggauuugagucacuuaauagcagccuacucucccuucagauaccgccuaucuuagauacuucuaauucuuggagucauagaaucaagauugaucgaagauaacuucuacacuucuagacaagaugacuaggauagugaugguggugauaacugaguuagggaacaauuucacagagaagaauuucuuaaacaguaaucauauucucacuagcccaaguugugaaaugaaacaauaugauucgguuuaaggcagacauaaccagacuuucuugggugaaauaauuuuaauuuagcuagacaauauggauaauuuucucuucuccuugccuuaaacugccuucaauauuacagcucaugguuucuugcaguuuuaacaucaggagaacuuaauuagaaugugugaacuccucuguauagauacuucuucaagucaucaagcaaucuuucuggcgucuuuuauucauuuaccuguuacgugacuaucaggcccuguagauuuuaguguacaucagcaaaggcagaaauugagggcaguugucaaagcccuuauguuuugaaaguuucuaagauugagauuuagaaacuuucaaaauauaagggcuuugcuuuauguucaaaaacagaauugaaugugaaucugaaauuuuaaguguuaauuuaauaugcaauauaauuuuguuaguauauuuaaaugcuaagcuuaaaggagaacguaucauauuaucuuuuaaugaaaaaaaugcuuaucugaaaagguucaccacaaauuuagacaguauauuuaggucacuguuacauauagaauauaugguauggagauaauugcagcuacaagugaagguuauaaaucauuuugaaugacaaugauauuuguaucagacauauagagacauaggaauucacauuguaaucuagcaauuaauauggauucauuuuaagcacacccaaucuagaucucaaaacugauaaaaggagggagcggccauucacuuuacaaaaggauucucugaaggauacuauuaagucuucucaggaacauuagaacaccuucgcuuuacuauuuuuaguugguggcuuuuccgucuccuucagcaucuacucaaaaccacaguguaguugcacaaggguagugguuuuuauguuuugcuuacugcuguauuccuugaacuccagcaugaggccuagguacaguguaguauuaccauagcacagguccuugauggucacagcagucuuccaaaaaaccaucaugugcuugagagcuucugugcuacugaaaggggacaccugucaccccugccagccuauuguugcugugaguggguguggacccacuguugccagaucuucagguuguuuuagaaaacucagaaaucuaaguuacuagauuuuucuguuuuucaguuacuagauuuuaaaaacacuguucaaacaaaacuguuaguuuguaaccuuugccuuuacuuucucauaauauaauuuuuuuagugccuuauuaggcacuuuaaugagagacggcagccguuuaauuuacuguuaauuugugaugucuucagaagagugaaugguuuugcuuucaggauacugcgaacuaaggccaaaaugugcaguuugcuucauuugggaauguguauuguagaaaccuguuggguucuauugaaaaagcagauggggguuuugugaugggggccagguaugggagcccccucauccagaugcaggugaacagugugguucuagagaagacuagugauuggaaagguaugugugaguuuugaaacuuggaagaagacagaugagaaguaaaccaagguagugccaauagggaaaauauuugacuuuuccuagaaacauauugagugcauuuaaacugggcaaaguauggaccaacuugccuucauccugauacuauucaacuuagaaauguuuuacuuugucauaagguauaacuguuguuagaaauagauaaucagugucacgaagaaaagucagcacagagacaaaggaccucucagcaaggcaaucuuuacuuucugcagaaagggugcuccacacagauggaauaaugacaagagcacaccugaacaaaggaaaagcagacauguuuaucccuuaugcauuugggucauccuuacugcucuguccugcauccauuggcuggagcugaaccucacaaucuuaaacugauacucgauuugcuaauagccuaaaacuuuccuaaauagguaagugcaacgaagaacaaagaaggagaggaaguugcuuaugaaagguuuaaggcuaaaacuugccugggccuguccagacaugccuaaauaagccaaagcaacuaacugggcuaaaguguaagaacuaauaguugauaggaggcuuuagaguaaggaacuguuauuccuagaacagauuuauucaacugaucagauaagcugccuagaaaaagagggucagaacauaguuaaggcagucugaugauaaaaauccuuuuccucucaauacaucaucaguaaggaagagaaaaauagaggacaaaaauuagcauuuauaggguugagaucuaaaaucaguagaaaagguuaaaaauuuauauugucuuugaaaauuccuuaaaaugcucaacaaaaguaaauacauaauuuuguguauauaacccuuuacaaugauauguuggcacaaacauauaguauauacagcaauacacauuuuuuaauaucacagaauauggcuuuagucacuuaagugugacugcuuagaacauucaaacaaauugaugaaguuugcuggcucuucuaugguuuuaccaucucugugccucucagcaggucuucauuuuuuccuuaaagauguugaugaagccauugccauuaacuugcugaauaauuguugggagaugcuaaaaaucuuaaaugucacaaccaagauggacuuuuucaggcuggauugcauccugagagcuuauguucauugagugaaauuucugcccuacacaaauuuuuuauucuuugaguauuugccucucuccucuuuccuccucucugagucagcaucugucugacucuuuucugugugucucuuuccucccuguugcuuucuuugugucucccacuccauaaguuuucucuuuucuguaaauuuugacuuacaucauugcagcugaagagguuauccccaucuucauggugaagcagccucagagagaucaagugacaugcccaagaacaacaaagcuagugaacaguagaaccagaagacagacggugccaaggaugaagagaaaacauuggagagaaguguagcuacucucucucuucucuuuuguaaagcuguuacuuuuuaggaauguuuacauuuuaaaguagauuugggggaccaaauaaauaauuaagaaaaagauuaauucaaauuaaaggauugauuccauagugguggaguuuuaaugaggucauuaagcuguccaggaguuauuuuguagugagaaauuaacuuuuucuacauguccuuuauauuguauaguaaaagcacucaucuacucugcauucaucuuagguuugcccuauuccuauuggaugauaguuauaauacaggucauaggcaugcuuuguauaaugccuaguaccuaaaguacugagugcugguugaauuaaugaauaacagccgacauuguuugagugcuuaccucugcucaggcuauuguacuugcagacuuuauguacauuauuaugauuauuuuuugagauggaguuucgcucuuauugcccagguuggagugcaguggcaugaucucggcucacugcaaccucugccucccagguucaagugauucuccugccucagccucccgaguagcugggauuacaggcacccgccacgccaccuagcuaauuuuuuguauuuuuaguagagacgggguuucaccauguuggccaggcuggucuugaacuccugaccucaggugauccacccgccucggccucccaaagcacugggauuacaggugugagccaccaugcccagccauuaugugcauuauuauuucuuucuuucagcucuauuagauggcuguauccauuuuauagaugagaaaauaagcaaagagauguaauauaaguugccuaaaauccugaugcugaaauucauacccagguuuaggugauaccacagcccauguucuuucccacauaccacaccaauucuugaaaacacuuuuguguguuuuuucuuucucucaauucaagcauaccauucauuucuuggaaaaaaaaaauugacuuuuaauaggacucuugaagagugaaucaucuguuuggaucuuccagaucauagaacugccuugauguacuuugaugacgcuggaggaaucugcuucaucuagcugagagagaaucuuuuucggucacuugcauuuagagauuagggaguaguaaugauaccagacauuacauagcaguucuucuuuuccagaucuccaugguuuuggcaauucauuuagaauacagugccuaagaauuauguuucugguggaauaguugguguguuauggcagagaggaggaggauauuuauggcaucccaaguuuagaacaaauuccaugaaauuuauuucaaacauaacaacaguaaucucuugcacauacaucaucucgcguaaucuuuacaacauccacacgcaggaaaggaaugcaugaaaaguacaaguucuguuuuuagcagacugaacaccauauaauaagaaucuuggaggugacauauuuacccagugucucacagucaagaggccacaaggauagcaaauacguucacaaggaaaggggaaguuuuaaaaugacagauagcuauaauuaaaguuagugaagaaagguucaguuaucaagggacaaaugagucagcagcaaguuuaaacacaaacugugaacucuggguguuucucucauugugacuuauuuuaagagaguaugaugccauccacacucagaaaguagccugaaucuagauuaggaagaccaagucuuaagugucccagagaugauguuacauuauaccuaagaaaauaauuaucuuguugaguuauaauuccugaaguuagaaugauuuaaguguuauauuuguuagauauacuggaaguuucaggcaaaguuauugagcauuucugucuacuucuacuucauuuuuaaaagguuuuuuuuuuuuuuuaaagaaaguuuaaguagaauuuuggcaucuuagugcgugguguguuauuguguguauagcaaguagacaugguuuacucauuaacuaucugaaauuuugaagucaaaugaaauguuucaaguuaauauuguaauuuggcuuuauaaagcagcuauaauugaauauuauauguauaugguagcaaauagggaaaaaacugcguauagaaauucagagcuacuuguauagaaaugcauuguuggugaacaacauuugaaaucgagcacagucauacaauuuuacacauucaaauaauacuaaugacuugcuacauuucauuucaauuuaagauuuuaggagcauuaaugugguaucacaaaaagggcacaauaauggaaaucgaaagaccuaacuuagacauuaaugaauggauucuacccacucuggcaauucaguuucugucucuggaucucauguccucacauaggggaaaggcuucaucuguaaggcugccugccagaugaugauagaugaugaugacgcgcucuacugcuaacaugugcugucuuuucaguaucauucuaauauguuuucuuuggaauuccauacuuuaaggagauguucugaaguaaugaagcaaaaguuauuuacaaagauauccuuuaugauauuauuuguaauuaauauauuaacaacguauaauaguugaaggcuaguuauguaaaauaugcaacaucaauucaaugaaauauuuugcaaucauuaaaaaugaugugaggaguuuuaauaacaucaggaaauaaaugcuuaugcuauuaagaguuaacaggguauaaaguugaguauucaguaugauuacaaguagguuaacuacacauuuauguaaaguagacuucaucaaaauuaaaaccuccaacuuaucacgacagacauuaagguagugaauggacaagcuacaacauaggacaaaauauucacaaaacauguaucuuacaaagaauauaguauauccagacuguguaaaaaacuggaacuaauaauaagagacaacacacuucuguuuaaaaauuagcaaagguuugaacagacuucacaaaagaagauaaacaaauggcuaauaaacauaugaaaaauauuuuuuaaaccacauucauagaauaaacacugcugguuguagcauuaugcuucuaccuugucucuuuaucuaccuucauuuuuuaaaauguauuuauucuucacuaguuuucuauaaagagucuauauaguuuuauaaucaagaaaccaaaaucccucaauuuacugagaaagaacuauugguuaggagugacaagcaugcuugggaggauauuuucuuagaaaagagguaaguguuguaaaacaaaacaaaaagcguauuucuucuucuaagauuucagaagaauugaaagaagaaagguacauggcugcuuuaucuucaccccuaguuuuauccuaagugugccccuucagucucugccuaucacugagacagucugguggacagugagaagcagccucauaauuacccuuuguuauucucuguuaacucucaucauccccauuaacuguaugucguugauuuauuugccagguccuugucacuuuguccuugaaauaucagaaaguguuagugguucuuguggagaguguugccucuuuguauauguugaaagaggaggaggaaugcuugcaaaauguauuguaugcaugacuguauuucauaaggcauauuuuagcuuacaaagcacucucccaucuauuaucuuauuuaauuuucacaacaacuuagugugguagguagauaguauuaaucccauuuuacggaugagguucugcacaaucaguuguccugcacaguucuaucaaucaacccccaacaaaaaauucuccugugccacuuuguaguugacuccuccccccauucccagccccuggcaaccacuguuuuguuuuuucuauauauaauuuuaauuuuuccagaauguuguauagguagaauuguacaguguguagccuuuugaguggcuucuuucacuuaucagagugcauuugacauucauuaacaguauugcuaguuaucugcaguuuguugcauucuauugcugaguaguaucucaucgcauggauauaccauaguuuguuuauucauuuaccaguugaagaacaucucaguuguuuccagcugguggccauuaugaauaaaacugcuaggauucauguacagaguuuuaugugaauaugucuuaauuucuauugaguaaauauccaggcauaagauugauggcuuugguaagcauaugauugcugggauuaguaagcauaugauguuuagcuuauaagaaauggacauuuugucgauauuauuuauaaaauuuuaaaaaaaagaaauggacaaacuguuuuucaaugugcagucuaugagaauugcacccucaccagcacuuggauuauuuuucguuuuguuuuucauucugcuauucuaauaaguauguagugauaucucauugugguuuuaauuuauguuuuucuaaccuuuuuuauauuuaaauuuuucauauaauguucauguuugucuauuagcauaucuucuacauuuauucuuuaauucauuccagaaacacuauaggugaccuguagcaaugguucuuagagugauucucauaccaguagcaugagcaucaccuagaaacuuauuaaaaauauaaauuuuuagguucuacccuagaccuacugaaucugaaacugggagaguaagacugaauuuucagcucuccaaaugauucuccuguaacccaaaguuugagaaccacugguuuacagcggaggugcucacccaucccuaggcgucaauaucaacugugaacauuaaaaaaagaaaagaaaaucagaguucagucucuaccccagagauucagauuaaguuugugucugguaaguccacaggcauuuuuuuuuaauguucuccuggcaaugcuaauguacaaugaggguugaaaauaaucuacugaaaguuguuuacuaggcgcucuaaacgauacaaaucugacaccaauuccagaucugaugcagcuuauuauuuaaaagggaggauccauacaaacauaucuuagcauagucauaagcacauacauauaagucacuuaguaauuaccuaaugaauuaaauuguacuugguguccugguuuuaaauauaaaugaacuucauuuacccauaucucagagccucauuuugaaacucgauguuguacuuagcauucauucauucaacagauguucauuuaauaugcugggaauauggcagugaacaaaauagacaagucucuaugcucauggagcuuacauucuggcacugaccaucaacccacuuuacaguauuuugggggaaauauauuucuuuauaacucuaaaacaaauaugccuauuuauugauagucuuaaucaugauauuuguguuaugcucaaguacugucuuucagaguuauuugccuuguauuuguuaaaguuuauguuagucauuacauucuuuuuccugaauaacuuuuuuuuuuuuuuuuuuuuuuuuugagauggagucucauucugucacccaggcuggagugcaguggugugaucucggcucacugcaaccuccaacucuuggguucaagcaauucugcugccucccaaguagcugggauuacaggugccugccaccaugugaagcugauuuuuauauuuuuaguggagacuggguuucaccguguuggccaggcuccuggucucgaccuccugaccuuaugugauccuccugccuuggccucccaaagugcugggaucacaggcaucagccaccaagugcagcccuggauaacuuuuuuuuuucuuuuuuuuuuuuuuuauacuuuaaguucuaggguacaugugcacaacgugcagguuuguuacauagguauacaugugccauguugguuugcugcacccaucaacucgucauuuacauuagguauuucuccuaaugcuaucccucccccagcaccccuacucccugacaagccguggugugugauguuccccgcccuguguccaaguguucucauugcucaauuuccaccugugggugagaacauguggauuugguuuccuguccuucugauaguuucccaagaaugaugguuuccagcuucauccaugucccugcagaggacaugaacucaucccuuuuauggcugcauaguauuccaugguguauaugugccacauuuucuuaauccagucuaucauuguuggacauuuggguugguuccaagucuuugcuauugugaauagugccacaguaaacauaugugugcaugugucuuuacgguagcaugauuuauaauccuuuggguauauacccaguaaugggaucgcugggucaaaugguauuucuaguucuagauccuugaggaauugcccaacugucuuccacagugguugaacuaauuuacacuaccaucaacaguguaaaagcauuccuacuucuccacauccucuccagcaccuguugauuccugacuuuuuaaugaucgccauucuaacuggcaugagaugguaucucauugugguuuugauugcauuucucugaugaccagugaugaugggcauuuuuucaugcgucuguuggccgcauaaaugucuucuuuugggaagugucuguucguauccuuugcccacuuuuuaaugggguuguuuuuuucuuguaaauuuguuuaaguucuuuguagauucuggauauuagcccuuuaucagauagguagauugcaaaaauauucucccauucuguagguugccuguucacucugaugguaguuuccuuugccaugcagaagcucuuuaguuuaauuagaucccauuugucuauuuuggcuuuuguuuccauugcuuuugguguuuuagucaugaaguccuugcccaugccuauguccugaaugguauugccuagguuuucuucugggguuuuuaugguuuuaggucuaacauuuaagucuucaauccaucuugaauuaacuuuuguauaagguguaaggaagggauccaguuucagcuuucuacauaugacuagccaguuuucccagcaccauuuauuaaauagagaaucuuuuccccauuucuuguuuuugucagguuuaucaaagaucggaugguuguagaugugugguguuauuucugaggccucuguucuguuccauuggucuguauaucuguuuugguaccaguaucaugcuguuuugguuacuguagccuuguaguauaguucgaagucagguagcccacagcuuuguucuuuuugcuuaggauuuucuuggcaaugugggcucuuuuuugguuccaugugaacuuuaaaguaguuuuuuccaauucuuugaagaaagucauugguagcuugauggggauggcauugaaucuauaaauuacuuugggcaguauggccauuuucacuauauugauucuuccuauccaugaguaugaaauguucuuccauuuguuuuuguccucuuuuauuucauugagcagugguuuauaauucuccuugaagaggcccuucacaucccuugcaaguuggauuccuagguauuuuauucuuuuuguagcaauugugaaugggaguucacucaugauuugggucucugucuguuauugguguauaggaacgcuugugauuuuugcacauugauuuuguauccugagacuuugccgaaguugcuuaucagcuuaaggagauuuugggcucagacgaugggguuuucuaacuauacaaucauguaaucugcaaacagggacaauuuggcuuccucuuuuccuuauugaauacccuuuauuucuuucucuugccugauugcccuggccagaacuuccaacacuauguugaauaggaguggugagagagggcagccuuaucuugugccgguuuucaaagggaaugcuuccaguuuuugcccauucaggaugauauuggcuguggguuugucauaaauagcucuuauuauuuugagauauguugcaucgauaccuaguuuauugagaguuuuuagcaugaaaggcuguugaauuuugucaaaggccuuuucugcaucuauugagauaagcaugugguuuuugucauugguucuguuuaugugauggauuacauuuauugauuugcguguguugaaccagccuugcaucccagggaugaagccuacuugaucgugguggauaaguuuuuugaugugcugcuggauucgauuugccaguauuuuacugaggauuuucacaucgauguucaucagagauauuggucuaaaauucucuuuuuuuguugugucucugccaggcuuugguaucaggaugaugcuagccucauaaaaggaguuagggagguucccucuuuuucuguugauuggaaugguuucagaaggaaugguaccagcuccucuuuguaccucugguagaauuaggcugugaaucugucugguccugggcuuuuuuugguugguaagcuauuaguuacugccucaauuucagacccuguuauuggucuauucagagauuccacuucuuccugguguagucuugggagggcauauguguccaggaauuuauccauuucuucuagauuuucuaguuuauuuguguagagguguuuauaguauucucugaugguaguuuguauuucugugggauugguggugauauccccuuuaucauuuuuuuauugcgucuguaugauuccucucucuuuucuucuuuauuagucuugcuaguggucugucaauuuuguugaucuuuucaaaaaaccuggauucauugauuuuuugaaggguuuuuuuguguaucuccuucaguucugcucugaucugaguuauuucuugccuucugcuaacuuuagaauuuguuugcucuugcuucucuaguucuucuaauugugauguuagggugucgauuuuagaucuuuccugcuuucucuuaugggcaucuagugcuauaaauuuuccucugcacacuacuuuaaaugcaucccagagauucugguacguuguaucuuuguucucauugguuucaaagaacaucuuuauuucugccuucauuucguuauuuacccaguagucauucaggagcaaguuguucaguuuccauguaguugugcgguuuuaaaugaguuucuuaauccugaguucuaauuugauugcacuguggucugagaguuuguugugauuucucuucuuuuacauuuucugaggagugcuuugcuuccaauuauguggucaguuuuagaauaagugugauguggugcugagaagaauguauauucuguugauuugggguggagaguuuuguagaugucuauuaggucugcuuggugcagagcugaguucaaguccuggauauccuuguuaaccuucugucuuguuuaucagucuaauauugacagugggguguuaaagucucccguuauuauugugugggagucuaagucucuuuguagaucucuaaggacuugcuuuaugaaucugggugcgccuguguugggugcauauauauuuagaaugguuagcucuucuuguugaauugaucccuuuaccauuauguaauggccuucuuugucucuugaucuuuguugguuuaaagucuguuuuauccgagacuaggauugcaaccccugcuuuucuugcuuuccauuugcuugauagaucuuccuccaucccuuuauuuugagccuaugugugucucugcacaugagaugggucuccugaauacagcacauuguugggacuugacucuuuauccaauuugccagucugugucuuuuaauuggggcauuuagcccauuuauauuuaagguuaauauuguuauguuuggauuugauccugucauuaugauguuagcugguuauuuugcccguuaauugaugcaguuucuuccuagccucgauggucuuuacaguuuggcauguuuuugcgguggcugguaccaguuguuccuuuccauguuuagugcuuccuucaggagcucuuguaaggcaggccuaguggugacaaaaucucucagcauuugcuugucuguaaaggauuuuauuucuccuucacuuaugaagcuuaguuuggcuggauaugagauucuggguugaaaauuauuuucuuuaagaauguugaauaucggcccccacucucuucuggcuuguaagauuucugcugagagauccgcuguuagucugaugggcuucccuuuguggguaaccugacuuuucucucugccugcccuuaacauuuuuuccuccguuucaaccuugguuaaucugacaauuaugugucuugggguugcucuucucgaggaguaucuuugugguguucuuauauuuccugaguuugaauguuggccugccuagcuacguuggggaaguucuccuggauaauauccugaagaguuuuuuccaacuugguaccauacucccugucacuuucagcuacaccaaucaaacguaggcuuggucuugucacauagucccauauuucuuggaggcuuuguuucuuuuuacucuuuuuucucuaacuuuucuucuugcuuuauuucauuaauuugaucuucaaucacugauaucauuucuuccaguugaucgaaucggguauugaagcuugugcaugcaucacgaaguucuugugccuugguuuucagcucuaucaauucauuuaaggucuucucuauacuguuuauucuaguuagucauucgucuaaccuuuuuucaaguuuuuuagcuuccuugugauggguuagaacaugcuccuuuagcuuggagaaguuuguuauuacugaccuucugaagccuacuucugucaacucgucaaagucauucuccguccagguuuguuccauugcuggcgaggagcugugauccguuggaggagaagaggcacuuugguuuuuagaauuuucagcuguucugcucugguuucuccccaucuuuuugguuuuaucuaccuuuggucuuugauguuggugaccuacagaugggguuuugguguggauguccuuuuuguugauguugaugcuauuccuuucuguuuguuaguuuuccuucuaacaaucaggucccucagcugcaggucuguuggaguuugcuggagguccauuccagaccuuguuugccuggguaucaccagcggaggcugcagaaucacaaauauugcagaacagcaaauauugcuuccugauccuuccucuggaaguuuugucccagaggggcacccgccuguaugaguugucugucagucccuacugggaguugucuuccaguuaggcuacacagcgcucagggacccacuugaggaagcaguguguccauucucagagcucagucguugugcugagagaaccacugcucucuucagagcugucagacagggacguuuaagucugcgaaaguuucugcugccuuuuguucagcuaugcccuguccacagagguggagucuauagaggcaguagcccuugaugagcuguggugggcucccccaaguucaagcuucucagccgcuuuguuuaccuacucaagccuuagcaauggcggacaccccaccgucccccaccccauucccccgccuuccugcgaagcuucagccucgcagguucucaggcugcugcgcuagcagugagcaaggcuccgucggcaugggaccugccaagccaggcacaggagagaaucuccuggucuguugguugcuaagaccaugggaaaagcacaguauuuuggcgagaguguccuguuuuuccagguacagucugucacggcuucccuuggcuaggaaagggaaauccucuggccccuugcgcuuccuucgugaggcaaugccccgcccuacuucaccuugcccuccaugggcugcaccagcuguccaaccagucccagugagaugaaccaggaaccucaauuggaaaugccaaaaucaccagucuucugcgucgaucacgcugggagcugcagaccggagcuguuccuauucagccaucuuggaacggaccagcccuggauaacuuuuuaaacucauuuauuuagucaccuauauauguugauaacagugguacagauagagacugucuaaaccauggaaagauaacuggaaucugaaaugagaaaauguaaguucagauaguggcacaaccaaguaauaguuugugguuuuuaaagcacaucaaugaaauuauauuuuuaugcaaaguauaguaauauaauaauaaugcuaacuagcccacagaguuguuuauggguuaaaucaaauauuauaugugaaaaguguuuuauaaacugucauauacuccccaaauauuaguuaccugauauuuuugaacuuauuagaggcauuuacuuuaauaauuuucauuuauacauauacuuaaauuguauaaggauaaacauuuuaaaguuauuaucaauuggcaugaauucuuaagcauaagcaauguuuuaauaauuuuguuaauguguuaaagaucuuaaugaaggauaaaauauugcuggacuuucaaguaguuaaggaauguucuguaauuggcaagggugggaacaaaaaaauguugacaagguaacacaucauuuuucaguacaguauugguuuugacaaccuuuucuugauaggaagacagaaacugaagugucaggaauugcuguauucaccaugaaccuuccuaugcucugaugaaaacaugaauauuuguuauaagcaaaugaaauggagcugcagcuaucacuauguacucugugggccuuuaauacaguagggauuccuuuauagauauacauagauuuaaauugaaaaaaauggucuuugcuguuugagcucaguuguuuaguuagccuuuaaaaaaaaaaaaaaucaccagauaacuuaucguaaauguugugugugugugugugucuguauguauauauauaauuuuuuuaguacccucaucuccugucaaccuguuugccagauuauagacuguaucauacccauggaccuugcauaacuaauaucuagaaagaggaagggaaggaggcagaaauggcuuccuagggagaagcuuuuacugagaaauaagccacauggcuccacagccagcccauaggucuuugagauauauacagcccaugcuucauccuaccccuaccuuguaaauguuaauagacuuuauucuuaaauaauuauuguuaacagacucuuuuuuaagaacaguuuuaaguucauagcaaaauugagcauaagauacagagauuucccauauaccccacaugugcauagauucccccauuaucaauauuuuagugaguaggccccuacuauauucagagcacugcuagucacuaggaauguaaguaaguaauugaugucuuggaggugagaagaaaaggagacuagucucuugagauuacaagguccuagaaauuuaacaugcaaaaucuggagaagauagagaguagggugggguuguugaaagguuuuuaguaggguuuuccaaaguaaacauagucagguuauuuuaaaaaauaaaauauaacuuguuagcuugaaaguaggagaaaaaaauuuaaaaaaauaaaauuucaguguuagauauauuagucaguuuacuuuccuaugggauucccuaguccuuaucguguaauuuacauuuggcuagaaugucauugcggugagacagaugcuugucugucuuaaucuguuauaucccuagugccuaaaacaguaccugucauggaaccagugcuuaguauauauuugggaagugaauaaaggauuauagaaggggguuaugacuuaguucaugugaccuuuuuucccccaugggacaaauauuucaugacaaauacuuugacacauaguaguccugggaauaaaagauaggucaaggcccuuuuugcgaagguuaccuuggcagaccugggcaacaacuacacucuuaagcacaaaguguggcugccuguuuguuggagguguucccagacuuccuggcaaccuuccuugcccaguuugaccauuggguccuuccuuauagaagguacuuccuuucucuuucccgagaggacacuauacugugacuucacuucaguugccuaagguaggaaacuuacaaauuagacucaagaacuuuucauuccuuccuccaaucaucagccuuaacaaccuccaucuuuccuuuauauggaagcauuaauuuuuccccguacacaaaguauuaaguugaccauacuucuuauauuugauaguuguauggagucaagaaaauauaguaguagcuuguuuauguacauuuuccuccugcuguagagcacagggguuuuacuuuacauuuaccaaaagcagaaaauuccuacugcagagauggguaagaauuaugccauucaauaagauacgcugucuagucccauuccuaaaagucuagucccauuccuaaaaaucccuaccaguccccucuccauuacuuucugcccccacuacuauugcugcucuacuucugaucuugcugucagccuccuauaugcucccagcucuaacuagauccggccaguuucuaccagaaugaucauucugcagcauauaccuggucaugcuugcucacaggaaacuggcaagagucaaguagggcaugggcuuuccauggcucccuucagcccuucuggcuccaggcuccuauuucacuuucucaccgcucuccucucuagcccuuggaauccaaacacuuaacauuccuagaaaguacuguguucucuuuaccuguagacuuucacucuugcugaucucuucauggacuauucuaccccucuuucucuucccuugguuaaggcaagucccuccuucugccucaaugcagaaaucacugacuucagggagucuucccuaagguagagcaagugcaugucuacaaugugagaccuuuaaagaagcuuucaucuggagaagaguaucuaauuacaaagauuaggaaaaaguaugugcuuggcaggaagagggauuugaggcaaauuuuaugguggcuuugaaauauccuaauuauuucauuuaaauaguguacuaaauggaaccccaaacugaaauauucaacucauaaucuaauauuugacaugcauuauacugucccuuauccaucaguaaaauguucuguaucugcugcuuuuggugauggugcaucccaggagacacacugacugaaacacauuaaccuucucucuugacuggcucauuugauucaaauaacaaguucccccauaacccuacuucaaaaacuagaaaguaucuuacuccauuuucagaauaccaaguugugagaagcagcgagcuauucuuuguuuuuguuacucuuuguuuaccauuaaccuaguaaucaccucggcuggaggcuggagauugaagcaggggagugggggaggaggaccugaaggagcagaggguugagaaaaaaugguuagaauuauagguuguaaauaccaguaucguacuuaauaaaauaugcuaucucugauggucaagcuuaagcuuuuauaauacaaugauuuaagauaauuauaaucaauugaauuuuaaagauauaaaaugugugccaaaacucuuuaauauauuguccugguaagugugcuuuugggaaucacuucuaauaugauaguccaaaauuuaaguguuuuauauacagagauuucugugugauguucaacaagaaacuugggaaacaaucaagagcuuugugaaaauuaucuauaaaaugacguguucagaaaauguuuuaucauauaauauuaaauguuaaagcaguauaaauauuuauauguauucugaucaccgugaccagguaaggaaauacuguaagccaugaacagaaauagaacagaagucacaggacuugaggaacagcaaauaaaauaauccaguuagaucagaucauauguauaugggagaaaagauuacaaggguaaguugggacagauuuauggaguuacuuguugccuugaauaggacaguuugauuaauaaguaauggggaggguuacagguuuuucauuagcugagacaucugauuagauuugaacuuuaggaaagcaagucugguugugguauauaggauaaguugguaugggaagagaucuuguuacagggguuuagucaaguacugaugauaugcugaacugccaugggcuaauuggaaaggagagaaugaaugcaagaaguguuguagaaguaguaucuauaggauuugucaaauauuucaaauaaaguagacuuaggagaacaaggaguugaaguuggccaugaaguuucuaguuuggguaacugggaaaauggugauaccaucaaaaaguuguagacugucucauggaagaacuggucuuuagguggggaaggugacuuucauuaaugucaagcguacugaauuuaaggugcuggauuuugguauaaaucuucaacaagugguuggcagugaaaacauuucguguaagaccauggcuaaagagagggggagaaaggcuuuucacuugcuuccaggugauaguuggagcucuaggagugaagggaagagagagccuagggagaagaagaagaggcagagccagcaaggagugcugcagugaggggagaaggaccaaggggcuuaugggccaaaaagcauuaaagggagaaaguuugucuucuuaguaucauguucuuauuuuaguugaauuuccuauuaccaaggaugcacacauuucugaguccuaaauaaaauuauucauacuuuucauauucaaaaauucaaaaacuaaguuccauaaccuaguaagauuaugggggcagagggauggaauucaccaguuuuuuuuuuucucugcuucuacuucauugguaguauugguuaagaguuuucuucauagcuucuuuuuccucucccagaaauugguauuuaaagcaauaaagaguaaaggucacaccugacuucucuugucuaauuuuauaagcaggaaacacacuguguaguuuaaaaaaaauucucauagcacauaaagugauauaaaugagguauacacauuuauuagauaauauuuuaaaaaaucaguucaucccaaagcuagcaauuacuuuuuauuuagaaauuuuacuuuaaucauaauuugauuuuuaagguauuuuaaaauaaauauuaaacauaaaagaaugauuuucaguggcuguaguucaaaacugcuguggaauagaaauuaguauugugacaccauuuaaguguccaguuuuaaauuaaaugguguugaguuuccagcucucuuaguuuuuauuguggaacaaaccaccccaaaacguaguagcuuaaaauaaccauuuauuuggcucgugacuauuuggcuuugucauuuggaugggguuuagcugggugagucuucugccgguuaggaggggcuuccucacacugccagauuggcugggagcuucugcgccuagaaugucuucagcugugacagcugaucccugcuccaugugguugcagccuccagcagaugaguucagauuuguucacaugguagcaguggguaggcaagagccucuagagccggagcugaagagcucuugaggccuggacuuggaaaucucacaguguaacuuuugucagacuuuuggucaaagaaauuacaaggcagcccagauucuaagggugggagaauagacucugcuucuugaugggagggugguagaaaauacuguggccagauugucagucagccauccagcucauauucauuuguucauuuugaauacucaaauacgaguuuuuaacugcugaaacaucauugacuguauguguguguguguuucauucauccucuuuucucaguacauuaccccugcaaaacaaggagguauuugaaguaaucucacucuucugauucaucuguuugaugaaagacauguuuguuuauucagauauuaaaacaacuugaaaagagaguguaacauaaauaaaauaaaacuacagcugguuuaccuauacaguauuuguuaaguaucuuuaacugucuguuuuugccuggcacuggacuagauguauaggaauagagaaaaagaaacaugggacauagucuuuacuuucaagaaguuuauaugcuuauagcauggguaaaauuuauacccaacaaauaauuuauuaauguaccaaggacuaugcuuuaaucaaagguaguacauagauggauaugaccuaguccuuuuaguggaaauagauauuuaaaauaguuauaauucaaagcaugagagaaauauaaacugagugcuguugaauuagaaaaagaauaggaggagacaaaugauugagugccagcguaaguguuucauacaauuaacaccugagaagggagacaucuuugaaaccagagggugauggcuucauacagaaaaugagucuugaacaagacuuugaagaagagguagaauuugaauaaguggagagguaggaauccuacucaauuuagaauugaguuguuuucccaagaagguaauuaucuaauuagagucuuuucaaguggcaaguauuaaagagcaugcaauaacaugacuauagaaagacuguagaaaacauuaugcugggaagauugcugucaauguuuuuuuccucuccaauggugccaaggcuuaauuuuguuuucuuuuucucuuaaaacuuuuuuagagauggggucuugcuguguugcccaggcuggucuugaacuccugggcacagaugauccccucgucucagucuccugaguggcugggacuacagccaugcaccacugugaccaauuugauuuucuaucgucagcuauuuguguacuuuaauuggaagacugaguaaagaaugguuauuuuauaagggaaaugcacauuuuguuuuuauugaauaguacucuguagccauguauugauugaaaaaaaauagaaacaaauaauguguaucucugcugacgaagaaguacaacauagacaaaaguaaggaaacccccauugagugaugucaacuggguacuuucuacaaguauaucuggcuuuauuuagggacuaaaccgguagaaauaauugggggaauuuccuuuccuaaauuugacagguaaauuugcuuuucauacuuucuguuuuaguugcuuauauuuaaacuauuuugagaaggagaaggaucaauuaaaauguauuuuauuuagugcuaauugaauaguaccauauuuaaacuuauaccaauuuccaaaguacuugauguaacuauauauaauuaguaauagaauauaggaaucaugauuuuuauuuugguaaauuaaagguaguuuuucucuguuaaaaugggauuuaaaacaccuuuaugaaugaaucccuuuaucuaguuuaucauugccuuuccuaugaaaguagugauacuugacuaauacugucuaacuuaauugcuaccauguggugaauucuagagaauucuuuaggggaaauuuuucuacuacauuuauuuucaaugacaagaaauugggagaauuuauaauagcucuuaucauuucauguauuuuaauaucuggacuauauguucgguccaaagagaauauaucacagagugaucauaaguugaaaugagauaacacaugaaaguauuuuguaaacugcaaaguccuaugcaaauaaauguuaggugauacuauuguucugagauuagcauuuguucuuucaaggucucuacagaauagucacaguucauagcuuagacucuagauccacguguucuaagaucaagucuagguucagccccuuacuagcucuguaacccgggauaaguuucuaaaccucucuauaccucaguuccucugucuguuaaaaugacauaauaauaguuuacccacuucaaaggauuguuguggagauucaaugaauuuauauaugaaagucauuugcaacagugucuuggcacacaguaaauguuauguguuagcuauucauuacugucauuauuacuacaucauguagaauagauaauugcuuucugauauaugcuaaucauguuuuucucuguggaauucuuccuuuacucuccuaguuuugcauuuuccugaaagagagagcucauugagggugaugacugaaucucaucaauuuuuauguccucagcagcuuaugauagacauucaauaagugcauggauuacauuauacacacaugaccacuuaagagagaaauacauacuauagaagaacuguagaaagggaaguagcauucagcaucugcacaauguuagucucuuucucuuucugguccaucuuacccuuuucagccuaaaaauugccucauuuuguuccuuuuuuuucucaccgaucuggccucaagggugccuucccaguuuuaccuagccaucucuuccccagguugauuucuuuauuuuuuuauuuuuguuugagacagggucucacucuguugccaaggcuggagugcaguggcgugaucucggcucacugcucacugcaaccuccaccucugggguucaagcgauucuuaugccucagccuccccaguagcuaggacuacagguaugugccaauaugccacuaugcccggcuaauuuuuuuuguauuuuuugguagagaugagauuucaccauguuggccaggcuggucuuggaccccuggccucaagugauucaccugccuuggccucccaaagugcuaggauuacaggugugagccaccaugccuggccucccagauugauuucauucccacuaccuuuugugggaaaccuucauuaaccacuccugcccaagacagucucuucuguucuauuauacauuuuauauguguauguauaauaacauuauuauauauguauauucucugcucuucuuuaaagguuuuaucuuuuuuauuaggugauacaugcacauaguacaaacuucacaaagugcaaaagacuauggugaaaagugggccucugccucccuggaaacaguuacucuuaccaguuccuuacauaucccuguggaaauagucucuguguugcacagcuugcacauguguuuuaaugguagcauauuggauacucuguucuacuuugcuuuguucacauaauauauuuugaauauuccauaucaguacauauagcacugccucacuuuuuaauggcuauauaaaauaguacuauaauuuuuaaccagucaccugauggugggcuuaguaguuauucuguggcuguuaccaacaucacugccaugugcacugguacacauacagaaguccacacaaguaggccuguaucuguaagguaaauacuggugggauuacugagucaaaggagacgugaauuuuuagauuuuuacuaugaaagacaaacugcucuuuauggggauuuuauuaaucuacaaccccaucaacaauguaugagagcccauuuuucacacacuugccaacucaguagguuauuaaaccuuuuggucucugccacuuguauaucccagaucaacuucuaauucugcuucauauuguuugcuauccuuuagaauauuucugucccaccucccuucauuacaguagcucuuugcaaucuuagauaaucuuauauuuucauugacuuuauauuccuuaacuuccaggagaguucuaguuucugauauucuguuccauuggcauguacuugucagaccagguauccucauuuacuuacaugucauagugcucuguaaacguuuauggauugauuagccuaagugggcaaaguccaucugucucuauaauuuugaauaagagagagccauugcuuccuaaauauuuuuuauuaguuucugccuuuguguuaauuaguguaauuaacauugucaguaucuguugcuacacgugugaaucucaguguucaaacucaggcucuuugcuaccgacuuuuaccuuguuagcaaggcgaacacauauucauuuaaagguaucaauaagauuuuaugaccuguuuucugguagcccaggauagagucuuucuggguucacucugcagagcugggugaguuaggugggaagaaucucaaaaaagaugccauucugggguaauaggggaagcucagggacuugguugaguuuaaaguaugaccuccuagagcugaggcagugagagcccgguaugugcaggaggcuuuguucauggccagacuauugugggagccucuugaacaacaaggugaaaagagcaaaaugggcaaggaaguugugagccaggcugagguuugaguggaggguucagguacguguucaguaccaaaccguuggaagucauugccagaguauuaauuaaauugacacuuuaaauaguuucuaaauuagggaugguugaucagaugaagagacauggugggccagaaagcacugacuuggauaaucuaaauaauuuauuaagauaacauuuuuuaaauguaggauaggaucaguucacuguauacaguugcacaguuuguuauguacuacauaaaagcaccucacuaaggaggcagagggugacuagauuucagcccggguucuaaucaccgaggcauguaccugguaugccuggaggaaaguguaccuuuuucugauucaucugcuaauucaaauauuugggguaggcaaguagaggccuuguucucuuugucuuauauguuguagacuuaaugugaagaauauccucuaaucuguuaaaaaaaucaauauguaauaauauuuucugauccaaaaauuauauugagcaguaaaugaugauuggcuaccauuuaauucucuuuuauaaaaugagaauagggaaaaagaaaaaaagaaauuaaguauuuggcuuugaaagagucgaccuguaugaaaaagaaauguugaacauuuguacccuuuuuucuuuuuaagcuuuuauucucuguugugagauuuuccccuuugaggacacugaaagcaaaaugaaucgugccauuggaaaaugcccuguagaucuucaugggguuaucuguagccagcagcguacaggaaacuagucacauuauuaauugcauucucucuuggccaaagguuuagcuguuuuaaaaugugauuucacugcccauauugcucauaugccuaagcuucuuuguuacuuuaguaaauauauguuuguguggagugauuuagcucaaauuuaguguauuaaaugguagucuaccuaaggcacccaugucuccucuccucuccucuccucuccucuccucuccucuccucuccucuccucuccccuccacuccccucccccuuuccccucccccuccccucuuuccuuucuucuccucuuuccuuuccuuuccucuucucuuauuuucucuuucucuuuuuauuucucucuuucucuguuucucucucuuucucucuuucucucucucuuucuuucucuuucccucccucccuuccuuccuuccuuauuuccuuccuuccuuccuuccuucaacuguacagagaccuggaggucgccaggcuacccauucugaaaugugaguuuuguuuggcucacacaguguugggauuuguuggguuucaaauguguuuagguaagaguugugccuuucuauuagucacuauucugaccauucccuuuuguuuuauaucugauccacuucaacugucuuuccugcuggcauuccaguuuguaauucuuacuuuauaucuggauacucugugaacacagaauuaaggcaggaaauuagaagguagaauaaaaucugcuuuuaagaagcaguuuacauuaaacaaauaacuuuuauuuauaguguuaauaaauguuuucaaauauuauaauuguaucccaauaucauuccccuaaguacucuucccauuuaauugcuauuaggcugggcugugccuuccagcaagauaaauaccagguugguaggcaaaauuagggaacuguaucaagguuuagaauaccaagggucaauagcaggccagucguuggaaggcagaauauacacaaacaguaaggucaagacaagucauaagucagagcaagcuggacagacuagggaauagcaguagcauccaaggcccaugggaguaggaacaucagguccaagccucuaagaccaggaaauccaugagcauuaaaggaaugagaucagaauuggcaggcaaggaggcugagucaugggggcucacggucucaacaaggaaaugggucacuggcggggucaguacaggacccuacgugaaagaaaggaguuugccacagaccaaccccuuuugccucugcuuagaauuuuuuaaaauuaauagacuuuauuuuuuagaccguuuuuagguuaacagaauggaacagauagugcagagaguucccagauaccaccuucucccccaauccccuacacaccaguuuccccuauuuuccuauuuuuaauauuguacauuugaaugauauauuuguugcaauugaugaaccaauauugauacacuauuauugaguuaagcccauuuuuuacauuagguuuaugcuguguauauuuuuaugggguggguguucguguauuaacauuuauauuacauaaaacuuacuauuuugaccauuuuaggugugcugcucagugagauuagguacguucacacugaugugcaaccaucaccauuagccaccuccagaacuuuuucaguaacccugauggaaacuguacccauuaaacaguaauuccccaugucccuacccucaccuuugguaaccacuuuauuuuauuuuauuuuauuuuauuuuauuuauuauuauuauuauacuuuaaguuuuagggaacaugugcacaaugugcagguuaguuacauauguauacaugugccaugcuggugcgcugcacccacuaacucgucaucuagcauuaguuauaucucccagugcuaucccuccccccucccccuaccccacaacaguccccagagugugauguuccccuuccuguguccauguguucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauauaugccacauuuucuuaauccagucuaucauuguuggacauuuggguugguuccaagucuuugcuauugugaauaaugcugcaauaaacauacgugugcaugggucuuuauagcagcaugauuuauaguccuuuggguauauacccaguaaugggauggcugggucaaaugguauuucuaguucuagaucccugaggaaucgccuauguccugaaugguaaugccuagguuuucuucuaggguuuuuaugguuuuaggucuaacguuuaagucuuuaauccaucuugaauugauuuuuguauaagguguaaggaagggauccaguuucagcuuucuacauauggguagccaguuuucccagcaccauuuauuaaaucggguucuaucucuauguauuugacuauucuggguaccucauguaaguggcauuguacaauauuugugcguuuaucacuugaacccaggaguucaacaccagcuugggcaacauaacgagacccugucucuacaagaauuguguguuggcacacaccuauuguccuaguuacuugggaucacuugagccuaggaggucuuggcugcagugagccaugauugugccacugcacuccagccugggcaguagagcaagacuauaucugucucuuaaaacaaacaaacaaaaaauuguccuuuugugucuggcauauuucacuucccacaguggcuuuaauguucaccuauguuguagcauguauuacuauuucauucucuuuuaaggcugaauauuccauuguauguaccacauuuuguugauccacuuaucugucaauggacauuugcguuuucaccuuuuggauauaaugcugcugugagcaucaguguacauguaucuguuugaguuucugcuuucaguucuuuuuuguguauauaucagaaguggaauagcugaaucaaaugaucuguggguccgggcgcgauggcucaugccuguaaucccagcacuuuggaaggccgaggcaggcagauuaccugaggucaggaguucaagaccagccugaccaacauggagaaacccgcuuucuacuaaaaauacaaacuuagcugggugugguggcacaugccuguaaucccagcuacguacugaggcaggagaauugcuugaaccugggaggcggagguugcggugauccgagauugcaccauugcacuccagccugggcaacaagagcgaggcugugugucaaaaaaaaaaaaaaaauggucuauggguuuugggcaaaugcacaaugucauguguccacuauacagaauaguuucacugucugaaaaaucuccugcuucaaccauucuucacucucucaccuuugccucugcuuagguuuuaauguucuuuuuguagacauuuaaauacuguuuauacuccaaccuggaauuuucggguaaagacgaguuagugaaaucagugaucaagggaaaguaagauguucugguaaauuauuuauagucccuuaggcuuugagauuuugaaaguuacuuacacaguuagcguacagguaacaaacagagcuuuagaaugcauuggcuucaaauaggaugauuuguguggaugcaguuauauauugcauccauuuauuccacaaagauuuauuaagcaccuauacuauaugccaagcccugugcuagaugcuuucaauaggaaauaaagauuccauaagauaaguuagacuauuuuaggaguuuccaccuuuuuaccaccaagcuaccccuuugauaguuguucccuaggaggcauguguuuugaaagauccugucuauuacauauuaugcuugugcuaggcuuucucagaauauugaaaauagcuuuugaaucuccacuguaauuuucagggaguccuagaggucuagagaucuucauaagaaaacugaucacuuuuuuaaaaaauuuuauuuauuuauuuauuuauuuauuuuuuauuuauuuauuuugagauggagucuugcugugucacccaggcugaagugcaguggcaugaucucagcucacugcaagcucugccucccagguucaugccauucuccugucucagccucccgaguagcugggacuacgggcaccuaccgccacacauggcuaauuuuguuuuuuuguauuuuuaauagagacaggguuucacuguguuagccaggauggucuguaucuccugaccucgugauccaccugccuuggccucccaaagugcugggauuacaggcgugagccaccgcgccuggcccugaucacuuuuuaaauucagagcaugagucuucgauuaggcugguuugugugacugucacugugcucaguccuguuauuacagcugugcugagguacuuaguguggcuguuuuccagacuugacuugcucaaauuaccauuucucuaucuucuccaguugcuugcugacccagccuuuuccacuauacuuaguggcagugaccaucuaaauaugaaaaaaaaaaaaaccaaaacaaaaaccguuguacuaggauagaaaauaaagagacaagaagggcaagaaggcucagguauuuguggucauuaaagcagaagucucuacgcuauuuuaauuguuacugucauaugagccuccugauaauuuguuuauucguguuuguacauauucugcauaauaucaguaugugcauuauuagugaaaccuaauuuuucuccuuuuuaaaauaaaaguuaauuauaaauagaaguucugagauuuugcauguacucugagcugcaugcaucccacuuuagaaaccuguacugagaaagcagacugauauuuuuuacugaccaaaauacuaaccaccaugucuacuguagcuuagauuauucuacagauaaugcugaggauucugacauacaaacagacagguagguuuaauuagggaaaaguucuagaagcaauuccccaagucacugugcuauucaaauauaaaaacuccacaugcauuugggauaaaaauagcauauucugaaaaauugaggguuuuuuuuuuuuuuugagacagagucuugcucugucgcucagacuggagugcaguggcacgaucuuggcucacugcaaccuccgcaucuuggguucaagcaauucucaugccucagccucccgaguagcugugauuacaggcaccugccaccaugccuagcuaauuuuuguauuuuuaguagacgugggguuucgccauguuggccaggcuggucuugaacuccugaccucaggugauccacccgccucagccuuccaaagugcuaggauuauaggugugagccacugcgcccggccaaaaguugagauuuguaaaaaauaaauuaguauagagaguuucaguuuuacuagauaaaguuuuagagaucuguuucgcaacaacaugaauaaacuugacacuaaugaaccauacauuuaaaaaugguuaagguguuaaauuuuauguuacguguuuuaaacacaauaaaacaaucaguuagauauuggugauuuauccccuguaaccaauauuuuaacaucuacuauauaaggacuccauuuggucucugcagaccaaauuuucugcaguuuuugcuagguacuuuaagcauuuuaguccccugugguuacauuaucagaaaaaugugagugcuugugauucuuaauauagagccagauaaaaucccugaacaccaguccacuaaaucuacuuuaaugggauaaacuuuuaaaugaaccauuaauaauauacuccacauauuugcuauuuggggucuggggaggcagauagacagaaagagauggaagaaaagccugaguugacuuucguacuuucaguguuccaaagccuggauauaaaugaaagaugagcauuucuacuuaauuuaucuggcuggauuccugugccuaauggcugcauauauaccauaaacacugugaagaagcaaccauggaaacacuuguuuucuuguugggcuaaauuuacucuggauugaauauuaacacagugccuggcaguacuuuaaaagcaaaaauagcuuaagugugauucacucugagucauuuacugcugcugcugcugcugcuauacugccuagagcuugacauugaacaaguuggcagccuguauugcuacauuuuuucuaggaacucugaacacauuucauucuugugaauucgcuugugcaacgauauuaaauagaguaauauguuuauuuuguuucaaagucaaaugaauuugagaauggugaaacugaauuauuuuucuugggcuuucuggaaaagcuagauucucagaauucucccgugguuauaagacuuacucuauuuuauaaagaauuaauaaaaugucacugaaguuuuguuuuagacacuuugggcuucgcugauugaaaacaccacaccaacugaaaaaucacugugaaaaagaaccugguaguacugucaauaucaaguaggauucauuaauuuucugacauuacuggacaagaugguucgugccauucagaaagcucuuuuucuuucuucuucuuuccuaauacagugaggcauacaacguagccugccuuaugguuaaguuggguguaugacuuguaaacuucccucuugcuauuaaagauuauauaaugggaaguucauugguuuugaaaggcagaccaaacccacccaugggauuucuauuggcuuuuuagauguauugcauuucucugaguaaacccauguggcugagaaauagugaguagcuuguuggcugacugugggaaaaccuaugaaggaucaguugaucucauuugggcaggagucagaaauggcugagaaucuaaaacuauauauaugaggaugguuuucucuugauguugcaaucuuuauuuuaacauguuuuuguguuuagcuucuggaguugccuaacaguauaauuucaaaugagguuuaguuucagcuguuuaauuuuaaacuguagggaacaugauuaaaaaaaaauuaaggcauuaucauuugccuuagaauuuuaaugguuuguauagaaagaguuuuccugugacaaccuaaaacaaaaaugagccuaaccuaauucuugauauuauuuguuuuaccauaaaauucuuacauuagaacauguaacucugucagagaauuucaacauaguugcauaaauuguguuucauauuacaacuuguucucugcuugacuucauugaaaguaauaaaaugacucuuucagaaggaucuggugaguuaacaucauuauuuaaaaaaaaaaaaaaguaaagaacuuacucauaauguauccuguguugcuaaguuuucaaaguuagcuaucucagccacacccaaaagcccuuucagaagauugaaauccacuuauucauuuaugcuggcuuagaauuuucuuccuaguaagaucugagaucgauauaaauuuuccaugaaauauaugaugaaugcaagaaaaacuaacauuuggaauuugaguugcugccaagucuuguguguaauauauaguucuuuauucugugguuaaagagauuucuuauagcagggcuuucucuaacuugggcccugugugugcuaaaaauaucucgaagguauuuuuuauguuccaaagggauacuaucacccuuccucagagcuagaauauaggauaccaguccugcaguagcauuccccauaucauggucauacccacccucuacugcuacauuuccaaggcauauaaaugaguuuuucauauggcuugaaaauuagcucaacaaaguuuaaauaaccaaccaugucagguuguaaacuaaaggggauagucuaaaugagucucagcauagcccaguacccacuguguuauuaaugccuuuacauagauguaucucuuuuauugagacaagaucucacuuugucacccaugcugaagugcagugacgcaaucauggcucacuucagccucaacuucccucacucaggugauccucccaccucagaccugaguagcugggauuacaguuguguaccaccaugccuggcuaaguuuuguauuuuuuguagacacaggguuuugccauguugcccaggcuggucuugaacuccugggcucaagcaguccaccugccucagcuucccaaaguucugggauuacaggcaugagccacugugcccagccagaugugucuuauccauagacauauuauagguugcguaucacuuacgugaaaugcuugaaaccaaaaaguguuucagacuucagguuuuggaauauuuguauauacauaaugaaauauauuagggauaagacccaagccuaaaugcagcauucauuuauguuucauauguagcuuacacacauagccugaagguaauuuuauacaauguuuuuaauaaugucgugcaugaaacaaaguuuugacugcauuuugacugcaacuagguguggaauuuuccacauguggcaaugugucaguauucagaaaguuuuggauuuugaagcauuucagauuuugggauuaaggauguucaaccuauaaaugagaugaugugaaagucuucacacagggccuagcauaaaguagacacucaauaaaaaagcucauuaaaucagaauuuauauuauaaauauucaccuuauuuggccuggaaguuuucuuucuuucuuuuuauuuauauguauacucauuugucaaacuuguauuauaugccagaaacuauaggauauuugagacaaauuaauaaaccuucaagaauuacauucuuaacuugaaaaagcaggcaugcaaauuacuaaauauauuaaucauaugcuuuuuaaaaagauuagguauaaggaugucauugccuuaaaguaggaacgauuuuuuaaaauuuuuuaauugagaaauaauaauuauauauauuuauggaauacagcguguuuugauauauguauaccuugcagaauaauuaaaucaaguuaauugacauaucugucaccucauuuccuuuuuuguggugaaaacuuuugaaaucuccucuaaguaauuuugaaguauacaaauacauuauuaauaaugugauuuucgugcugugcaauagaucacuaaaacuuacuccucccgucuaacugaaacauuguaguuuggccaacaucuccacauuuucccaaccccuucccccuucccccaaccucugguaaccaccaugcuauucucaaagucuaugaauuagccuguuuuagauuccacguguaagugagaucauacaguauuggucuuuaugugccuggcuuauuucaccuagcauagugcccuccagguucauccauguuguugcaaaugacagaauuucuuuuuaaaggcuagcuaguauuccauuguauauguauauaccacauuuuuuaaaucuguucaucgaugagagacucuuagaggcggggugcaguggcacgaccuguaaucccagcucuuugggaggcugagguggguggauugcuugagcuccggaguucaagaccagccuaggcaacacggcaaaacccugucccuacaaaaggaaaagaaauagccaggugugguggugugugccuguauucccagcuacccaggaggcugaggugggaggaucguuugagcccugaaggucaaggcuguggugagccaagauuaugccagugcacuccagccugggcaacagagugagacccugucucaaaaauaaaauaaaauaaaauaaaauaagcacgguggcucacaccuguaauaccagcacuuugagaggcugaggcaggcagcucaggaguuugagaccaaccugagcaacauggugaaaucccaucuguacaaaaaauacaaaaaaauuagccagacauggugguacacaccuguggucccagcuacuuggcaggcugagguaggaggauugcuugaaccccagaagcagagguugcuaugagucaagauugcaccacugcacuccagccugggcaacagagcaagacccugucccaacaaaaucaaaaauaaaauaaaauaaaaguagacacucagguugcuuccauaucuugacuauugcgaauaaugcugcagugaacgugggagugcagaaaucucuuugacauaccaauuucauuucauuuguauguauacccagaagugggaucauaugguagcucuauuuguaguuuuuugaggaacuuccauacuguuuuucauaauagcuguaguaauuuacauucccacgaacaauguaccaggguugccuuuucuccacauccaaaccaauacuugucuuuugucuuuuugcuaauagccauucuaacagaugugaagugauuaucucuucgugauuuuaauuugcauuucccaggugucuggagaaguugagcauuuuuuccauauauuucuuggccacuuaugugucuuucuuuugagaaauguguguucagguccuuugccuuuuuuuuuuuuuuuuuuuuuuugagucagggucuugcgcugucacgcaggcuggaguauaguggcgcaaucauagcuccacuaugcagccuugaugcagaaaucaugcagccuugaucuuccugguucaagagauucucccacuguagccucccugguagcugggacuacaggcacacaaaaccaugccuggcuaauuuuuuuaaauuuuuaguagagaggaggucuggcuguuuucaggcuggucuuaaacugcugggcucaagcaguccucuugccucagccucccaaagugcugggauuacaggcauaagccaccaugcccaguccuuugcccauuuuaaaaucagguuauuuguuuucuugcuauuuaguuguuugaguuccuuauguauuuuggauguuagcucauuaucacauguaugcuucgcaaauuuccucccaacccgugaauugucuuuucauucuguuguuuccuuuacuaugcagaagcguuuuaguuugaugcaauccauuugucuauuuuuuuuauugccugugcuguuggggucauauuuaggaaauuauugcucagcccaaugucguggagcuauuccuaguuuucuucaaguaguuuuacaguuucaggucuuaaauacuuaagucuuuaauccauuuugaguucauuuuugcauauauugugaguuaacagucuaauuucauucuucugcauguguaucuacaguuuucccaacauuauuuauugaagagauguucuuuccccauugugugcucuuggcacauuugucaaaaaucaguugaacauaaauucauagauuuauuucugggcuuucuauucuguuccagugguuggugagugguaacaauuuuaacuaauaucgacuguugaccuuugaguacuuccuauguacccagcucuauuuaaggugcaauaagguagguagauaguguuauccccauuuuacagaggaggauauugaggcucauaagagguugagcaauuugccaaacuuuauauuuacaauucaaacucaggaaaucaagcugcagaguccaugcccuuuacuauuacguaaacugccucuuguugauugacuuuauugaggaaaaagaaaaaaucuuagaaguuggaggaaaugggaagucaguacagcaaugauaaugugaucuguuuuguaggacauuagauuuuuucaaauuagugauuauuuuggaguacuuuugcuaaagucuguguuucuaaaacaaagugccuucauccagugggcuaaaucugagaauaauuuaucacauauuuggcauaucuuucuuaggcuauaugugcuaaucccuaacaugagcugaguuugagaacuuaauguuuuuacauauuaccucagagacugaaaucaguucuuaaaccaguauuggguuuugccauucagagaggcacuguggggccaugccaagaaacaaauuagcuaaaaguaaggcuuuccuucagucgacagcagugggucuccuuucaucuuguggcucuuuuaagcucucuaacaaccucuuucuguccuuucgacuccauucaccucaaacccaacaguucuuuuuuguagucaacacugcuaaauaguuauucagagcccugcagcucucauuucauucuuggcuuugucuaaguuccugagagagcugcaaaaagagguugaagaagugaaaaucaucagcucacccuguuugcauauccugcaguuugccagcacccccugagaaaguucaaagucuaaggguacagugagcagagaagccucuccagggagauucccaauagcuuguuuguuucacauugugcucugggguauauuuguuuuuauucaggaagguauugccuuuuuauuucuugauauauuuuauaagaaaauguuuucucuuaacaugagagcaaauuauacuuauuugcugaacaaagcaaagcuaucugcaaggacauuuuaguuuucacuucaagcaucauugcuuuuggcaauuguagacaaauuaucguacuguuugaugagguguaaaauaacacgcuuuaacuggagaaugaacacauuuccagauacaauauuaucguucucuucuuuuucaaguaauaauuuccaaaagaugaauuuuaauggacuuuuugccauuuaaccaaagugaauccuugagucucugaaguugcccccacuuagcaccugcguauauaacacuuaacaauuauuuacacuuuugauuaaauucaaccuuuaugucuguuugcaaaaaagaauacauacaauuuucuucacaaaaaccccagugucagacauuuuguuuugaucuuuuucuuggcauauuaaacugacauugggcaccaagaugaugaauuauggaaauacugcauuccucccagagggccucaugacuuuaacuaaauauucucauggcccagucauuguguagauuugcuuuuaaacauguccagucuuggcauuuuaaaauaacauuuuagaaauucaccaggaaaggaaggugaccguacaguuaucagaugauaaauucuaaucaugggacauucgcgugggucguuuguaauugaagacagugcauccuuuguaacugaagcuagugcaaaugaggacaggaguggagggacagaaagcggagagguguacagcugcucuucuugcacuguaccccucauaucugcagccgggaucagucaagaucucauucgugaugcuugggugccuugggggcuugggaagccagcucaggccuugugauccacucggauuaguguugucugggguucucacuuucugacuccuggaggacgaaacgccacuugucugagagggagugggagugauucuugagaaugaaaacaugauuuggguagugaagagguggagaggagaggcagaggggauguggaaaagagguagaagcagggaaguaagcaugaauaaagaguaaauugggcagggagaacaaggaggaagacacuuucuuccccuuacuccucccuguuugacagucuggcuauuucugcuuucucccuuaguuuccucuuuucucuccccguuucauggcacugcucuccaaaacuuguucuggcaacccucugccucaucuuuuuguguccuuccccaaccccuaucuccacccaccagcccaguucacuuccuuuaguugccccagcccccuuugccuagggacucaccagugagugccacauucacagccaugucuggugcagucugaaacaccugaggccacucagggucuguauuagaauuaaccuuuacuaacagguuuaaccagacuuuucagguuccuuuuaagucagaaugaaccccugccuugaccuugcccauccucaaauuggggggcagccuccagauccacaagacaugagaagcaggagcaggccugccacgucccugacauggcaguagagauuuuaugaaugguagcucggugucuccaucagugguagcugaugguagcuuagugucuccaucaguccuucagauagcagugagaagaugugggcaacagcagugucccugacuugucaguagcgugacugcagcucagagagcaagucaugccaaccagggccuuccccuccagagccacugcuuugcugccuuaccgaauaacgaaucaaauguuucuuuccuuuacuuucuguuuagaauuaaggacaacuuuuauuagcaucuuugucuaagcuauagcauuaacucccaguuuuuaauuacaucaucuuaauugcaaauguauugcaauucauauuaaaaaucaggaagccuuguacuuugcuaauaaacucugguguuugcaaaucugauuaagcucuaauuagaauuccuuuauauucaaucuguuucgaauuacuuuucugacuauaaaaauguguauauuguaaaagauucagguaauauagagggcaaaauaaaaaucaccuguaaucccguuacccagagauaaccacauaauaacauuuugugguuucuuuuagucuuuuuuuucuguaaacuauauauucgcaaaacugagaucaguuuagugucauuuuuuuagucaguauagugugagcucauuaaauauuugaaaaacaugauuuuaaauugauuucuaauauuucauguuaugcaugugccauugauuuauuccucuuugaaucauuacccucuauuacuguuacaugcacugguugucuuucaguggauagcaguugauauugucaauuuuuaaagucaguuugauaguuaaaaaauaguaucuuauacuauguauugagucuuaacuaucaaaauugccuaauuuuuagaucauuucuuguuacuuuuauuuaugaauuauaaagauuaaauaaaauuaugguauauuuuucagguaaaaauuauuucaaaaguugaaauaagugguguuuguuuugguaaaauuuuacuucuuucuaaaguguuuugaugcauuuauucauucagucagcagauauuuauucaauuccuuccaguacaagguguuaauugguuagaauaaaagaagaaaaguaugcuuucugccuucuagaagcuuacaauucagugaugguaacauauguaaauaugugauaauguaacacaaagaaauaaauauuaaaauaaagcugcaagcugggugcugagaaaacacaaaaggaaagugaugaauuuugaccagcagaaucaagggaagacuuccuggaagagcugacauuugagcugagccuugaagcauggauuuaauuucacuggggaaggcaguacagggcauuugaggcugagaguauaguacauucagagccaaagagggcugagagcauaugucauauuugagaaaagugaaugucccagagagucugguguguuacaugccauaugguggucaaguguaaaggggguaaggcagagagugguuguagccagugaaccuacagcaagauaaucaauucauacgugccuggcucugugcuaagcuccuucucauaaguagcuuagcucauugaauucacguuacaauccugugaacuauguauguggccacucacagacggaaguagaaacucagaaagccugagugauucccucuaaguuacaaagcuuauaagagacagaaccaguccugaaguccauuccuuuuuucacuauaccagauugagguaagaugauagccuugaaaacuguuaggguguugggacuauuuuguauguguugcuguuuguuuguguguuuauuuuuauucagugcuagcauaugauuaaugaagauacuucuagugguagaaugaaggaugaugagucagaaaaaaauguugcaggaagcaagacaagauagaagaccacaacagaaguccaagcaagacauggagaaccugaacuacugcagugauaauggaaaugggaaagaaaagagagaugcaagagacugggagaaauaaucuaagcacuuaguagaucgaugaacugaaagcagugaaggcaaccuauguuacauuagauucguagucucaacuuuuuuuuaaaucacacauccuuaauaguaaaauauuuuugagcauguaucccauacaaaauuuuuaauauuuuaaccuccuuuccaguggauuuucuugugacccauuuuagagagcacuggaauuauuuaagaauaaugagggaagggauugccaggaagaaaggguggaagagaaucugaguuugguuugggucauacugaguuuaagauagcuaaagaaguaccgacauuugaagaugcuucauacaaaguuggaagugguauuaaagauuuuaggaaauaaaaugacaccaagcuuauguucuagaugaaauucagucuuauucucaaaauagagucugguuuccccaguucuacuuuguguauaaggauaauuauggauuaaaaagccaggagucuguuuuauauuauuuuuagcuacauaucuuuaguugauuguuuuaguguuuuauuauuugauagaugauaaaugaugacuuaucauuugauaaauuuuuaaaauguuuaauuuuauuuuaccuuuauuuuauagaauuuuugagggaagaaauacuuaggauuguuaacuguagaauaaaccauauagucucagacagaagcauuaauuauauauuuuaaaaauuuaauuuucaagaucuguaaauauuuaguugagaaucaaaugauaaaacacuaaaacgauuuuaguuuuaauuuugaaaauguuaaagaaaacucuuaaaauagaucuuuuguguagcauauaacacaaauaucuuuuugaaaaccuugcagauuguauguaguucauugacuuauucagauuucuuuggaacauucagaguuaucaagccuaaacgugucuuccagacaaagagauucauccagauaucagauaucuuuacaaaaggcucaugcuuuucaguaacuuuuucaaaaugucauucuuauuuccuccuggccaacccucucuuacugaacuaauacccuauaaagccuuacccagaacccuuucaauuuaacaaggcccuacaauuguaugauuaaagacacaagggcugauugguguuuuggguuugguucaauuucauuugauuucaauuaagaauaugauuuuuuaaaaaccuucagccaccaaaaucauuauugauguucaaagcgugaacaucccuuggggaagugggaaugagaaacagcuguaguuccucuguaucucaugaaauccaauuaacuuucuuccuuuugucucuuuucuguucaguuucaacacuguucaguaucuucagugaauuuuuacucaacaccagaugaauaguaguacuauuguaagcuaaucguaugccaaugaggaaaaacaccuuuucuuuuuuauuacuuaauggauaaaagguacaaagaaauuaccagucuaggucaaguucacaaacugggcaaaauagauuugcaaaacaaauaccuaaaaauggaaaacauuccuaauggaggaaauggcaaagaaaaaucaucuucaagauuuugccccugucuuucuuagacagcagggggcagcagcaugagauacuaguacagguggacaggucaggguuugcuuacucuucacugaacucuacguaguagguacaacugccuuggaucaaaaacaauuuuuagagacccugauagaggauuaaugcauuaaacaaaaucacaauauagauuggugguugauuaaaaauucuaguaucugauuuucuaucuaauauauauuauucugguuucuuacuggcaagccuuuauuuuacagaauuuuugagagaagaaauacuuaggacuguuaacuguagaauaaaccuuacaguccuagaaagaagcauuaauuauaugauauauuaguaaaagaugcuuauaguuguuuuacagguagcaguagggugaccuaauacacagaaagugcugugccacauaaugaggauucaguagaugugauuaaaugguugcugacaucccuucaagacaaugacuugucuucauagcucaucagugaguucacagucuauuguuccuuuuuauuuggccaguguaaaauagcaguuauugcaagaacaaagggauuaaagcaucugaagaccuuuguuugaguucugccacuuuaguagugauacaucucagagaucaaccucuuuaaugccugucuuuguucccuggaacagaguuuguguuuccuuuuguguuacaacagaacucuggucauuccuaccauagcacuuuugcacacuauagauugcaacccacaguauuuuacuuaaaagauucugaaaaaguggauuagaaaacaccaguguguaucaugcauaggaagaauacuguuucaugaaauuuuuuuucacuuaaacauacaguuguauauacuggguuaugauaaaaauauauauauauuucuugcugcaggucauaguaaaaggaauuugggaaaacacuuaacuguagcauggaugacaucaucagguaguuaucaguuuauaaaucuguucucucuaccaugcaccucuugaaagaaggaacacauuuucuuuaucucuuucuuuuuaacacuuaagacaggucugccugguacaugguaguauucaguauaugcuggcauacugaauaaauaaauuaauuaaugaaaugaaagucaccugacuccucugaaccucguguuucuuuuucauaaauuagaauaucacccacuguaucucacaguaucaucuugaacaucaguugagaugaugaacaugaaagugcugaugccgggcgcaguggcucaugccuauaaucccagcacuuugggaggcugaggccgguggaucaccugaguugggaguucgaggcuagccugaccaacauggagaaaucccgucuguacuaaaaauacaaaaaaaucagccggaugugguggugcaugccuguaaucgcagcuacucgggaggcugaggcaggagaaucgcuugaacccaggaggcggagguuguggugagccgagaucgugccauugcauuccagccugggcaacaagagugaaacuccgucucaaaaaaaaaaagaaagaaagaaaguacuuucuguaagcacugugcacaugauaagaauuauugucuggcauaguuuuuguuauuguugagcaaauaagcuucaggugcuuuuagaaucuuaacucaguauuuuaaaggugacacauuuauuaccauacuauuaauaguacuguaauguuucuuuuuagguguagaguuaggagacaaucuugaaaaauuagguaagaaggaaauuaugauggaaaauuucaaacauauauaaaguaggcccaguagaauguucugcguacucauccccaccuucaacauugggcaacucauagccaauuuuguuucauuucuacacucucaccuccccuuucuuauguuaucguaaagccaacauguauuuauuuucuucuucuuguuuuuuuaaccuuuuuggauauguagaaauacuuuuaauauucuuuuaaaaaucuaauuauaaguacuaaaaaagauagguugguaguugagacuaaaggacuguuaugugaaugaguuauucucugacaggaacuagcagguaaacaggauauuuuauuucucaagauuuucauaugauggugaccaacugcauugcaaaagaauggucacauuccaggguuguaacuaguucuggaggcuuaguuacgcaauugccggcucugucaucuucuacagggaugugaccuuacggaaaaguaaggaaucugaagcguggcagaucacuuugaagcuugcccaguuuuugcauguuaucauguaauagugcuaaaacuuuuuguccuccagcuaggcaacauagguauguaauuuagacuuugggaauacuguagagcugugauaaacccugcuuuaagcuacauucugggaucguaacauguaauuuagaagucaaaauccacuuagaagaaaagaauuuuuaaagcacgguaaaucagaaccauuuuugugauuaauuuuuauugaucuuuuuaaauuuuucauaauuuuauguucugguucucauaagaacaaauacaaauaauuuuaaaccuuaaagauguuuaaaucuguuaaauauuuuauuuauguaggauuuuuauuccuuaaagucacauguggaguuuuuuauuuuuaacaagguauuaguacuauuagguaauacuaauaugcaauaaauugaauauauaguaauuuuguaugucucaauuauuuuaagguuuuuaugcaugcuugaauuuuuuuccgaaaugaaaugaauguaaaugcacuuuuguuuuaaaauauuccaagacaucuuuguauuaauacaaggaaguuuaugaguuggggcagggaaaacagagauggaggagaugaaacucgugauaagauugucauaacucccaaauauauuguaaucacagaucuagguugguuucugucagagacaucaccauuccaccagucucccuuccuggaaaccuagaaaucuucacuuuuuccgcugucacuuucuacaucuaaugaauagaucccuauugauuauuuauuuagaaaaaucucugaccgggcaugguggcucaugccuguaaucccagcacuuugggaggcugaggcaggcggaucaugaagucaggagaucgagaccauccuggcuaacauggugaaacccugucucuacuaaaaaaaaaaaaaaaaaaaaaauacaaaaaauuagucggguauggugucaggcgccuguagucccagcuacucgagaggcugaagcaggagaauggcgugaacccaggaggcagagguugcagugagccgagauccugccacugcucuccagccugggcgacagagcgagacuccgucucaaaaaaaaaaaucucuggccuuuaucuuuuccagguccuugaccaggcuauaaguucugauuuuugucaacauucaucuagacuaauagcaguugagaagaaaugaacaaauacauuuuggccauaccauuuuauguauauuuaauccuuacaguaaucuugugaguuaagacaguuaucuguauuuuucagauugugaaaacuaggcaggcuuuuucaaauauauuacccugcaaagguaucuucuugcucugagucuuucuugcucugaaucuuucuugcucuguaauacauuucauacaagaaugccaggauaaucucccuaaaguguaacuuuauuauaauaacuuaauaaaaccuguaauuacuggcaaauuaccagggauuuucacauguuuugucucauucuauacaaacuaccccaugagguuuauauuaucucauauacaccuuguaaaaugaccuguaaugacuuuucuuucccaucaaaccaguuauaaacucuuaauguugaugauguuccacauuuucugcuguggcuuuguuaugcccuuucaaucaucucucucaauguaaacuuggagcuagcuuuagccagcuuccuuauggcccucuucagauaccauuuuuauuucuucccaaaggucuacucaaaacacaacucuuguccgccuaauccccaccccaucccccgccaccucuguccucuaauuuaaacacugccaguccuacagagcccauuucaaguccuggcuuuuaccaaaaaacuuuucccuggccaggcgugguggcucaagcaaccuagcacuuugggaggcugaggcgggcagaucacuugaggccaggaguucgagaccagccuggccaacauggugaaaacccaccucuacuaaaaauacaaaaauugguguguuggcacacgccuguaaucccagcuacucgggaggcugaggcgggagaaucacuugaaccugggaggcagagguugcagugagccaaggucgugccacugcacuccagccugagcaacagagugagacuccaucucaauuaaaaaaaaaaaaaaggaaaccuaaaagcuuuucccaagaguuuauauauuccugcauuuuuuucuucuugauuuccauuaucauaucuauuugcccuugagcauauauuucuuaauauguuuucuuccuaacuacaaaaguuauauaugcuuguggcaaaaauauuauauaggauauuugaaagugaaaagauaacuccucugaccccaaucccaguuuguagcauaugugucauuuuucugugcauaagcaagaauaugcauagccaugcauacacccacaccuguguacacgagagguuauauauagauguauauauagauacauggaguuauauuuuauacacauauacaauucuaugucauuuguuuuuacuucaaaguauauuggaaaucuuuccaugucagugaauacaaagaauuguguuuaaauauaccuuuuuauuuccucaaauuguuucaugucaaauuguuuuauucauacacaucuuaucuuccuuuggaaaagaaaauggaaaguccucaagagcaggaaugguuacauacucauucucuuuuccauuccauuauucucuacucuuggugcauuuauugcauauuucacuauuuuugcugugggaaauaaaagaugcuugccuucuaaucccuaaggaguuaugaccuaguagguaagaguccacauuuuacauauaauguuaacgcaggaagaaauugagaggcaacacagauuucuauuccuggaaauauggcaguuagguuauuugaacaaucuucuugcugaaaaauaauugaaacuguugaguauguauaagaaaacauccucagagcagcaaagggcugaaaagagaaggaauuaaaggcuaaagucugaaggcaagugaaaauucagaaagaaguggagaacugaaacuuuuugcgcuuaacguagaauucagcacaaugauuuggagguggugaggucagggaguuucuagggugcucagaaguuucuaguuauagaccuggugguagcuguacgggauaauuauuuucuaaauuuaaaguauguauuuugugcacuuuucuauguacauguuauaauuuacaacaaaggauuaaauguaaaaggacgaguugcaaaacuauauauauauauaucauaugaucccauacauguguauuucauguaaaugaguauguguguguguguuauguaaauaggggucuuaauauauacauuuuacauaauaaguauauaaauuuauguguauauauaaauguguuuauguugggaauggaaauguuugcauauguguguuucauauacuuagaaaaagaccuggagguacucacuaaacuacugacugaggccaucucugagagacaggaagggcauggggaaggaacgagaaaggaacuuagacuuuuugcuuuauaccacucaaauuaaauuuuuaaacaauugucaucauuuaauguguuuuaaaaucagauuucuaaaaagauuugacuaacaucucugcccacugauagaaaaguacucccucuaccaugcucuauaccacuugguacacuaucuuucuuuucuuucuuucuuuuuuuuuuuucugaucuugcuccuuugcuagacucuuaaaaggaacaagaccugucacguuuauuuuucuuguaccuacuaaauacugguacauaguagagggucuauaaauacuagugaaaacugaaugaguaaauguaccuuaaguagaacaaagggcuguaggcacucaguaguuauacauuuccucugaggcucuuguuacauuuuuuaauauucuucuguaccuggcacagcagugaacauaaaguuggcacaguaaauacagguugauuugaauuuaaacaacacuuuguggaacuguaggcaaauguggaguccaccauguggugccccucuugaucccaggcagcagggacaugaaauuacccccugaaaaguaaacugagaagugaacaccuaauagauuaaggucaagagaggcaacauaaucuuaagagacauaaagacucuuuggggaguaagguuuuuacuauaaccuaaucgagggcauugacaucuuaaacacacucacacagucuccaucagaauagcaguuuuucugucucuaaaacagagaaaaaguaaagcuauuaaugucacuguuacgguuccuaacaaagcacugucagaucaacaacaccugccagauugaggcaagcauucaguccaccuggcagaugucuaaccccuguggcacuggaauccuacauaauuaacuccacuugcugugcuuccacacacaccaagcuucccucuggaaacugccuuuucaaggagauaauucacuaucaggcugauagaguaauucaguuaugcccuauucuguuguucacugugaauuaauaaagucacauucuuuuuuucucaguacaucagugucuugugaguuuuguuagcauaaaucugcauuccugaguccagucagugagaccggguaucagagucugcaaggcuuaucaggguaaauacuaccuuguggccaucuguuggcacagacugcuggauuccccaggugaugcccaucugcaucguuuugugccauguuuccuuuccauuccacacuggaguucucagaaguuauuaagaacucccuaauaaugugcacauuccaguuagagaguacuaagcuauguuaccccaugacaguugaccucuucugggugaauauuaucugauugauuuugcaaauuccacaccuguauggaugaagagaauauauauuguagaugcuagaucaugaggacucccaacaccucauuucuaguccuggcuucacagccucuucugguccucaucucacuaucagcauugauccuggcaucauauucaaguccccuccuaacccgggucucucuugagacagugagaacuaaagaagauggaagacacaaugauuucaacaagauuaaggauaaggaugcaaguagagcaggcagggaacgagguuauagaaacuuuuuauuccauuuccaucugucucucuuuccucacaacagucccaauagcauuucaaaggguuucaaguuccauguaaguuauagaaaaaaauaaagcacaaguucucugugacauguucagcuuaucuaugaauauaacggaacugaaaccauauuucaauaaauuauuaacagcaaucccuugccaagaaggauaucagcacagauaacagggcaaauccauuauaacucuuaagcaaauccuggaauuuuaaaaaaauugaauaguguaucaaauaagugcacuguuagcugggacuucauuaaacagcauuuuuuuuccuuucuuuccuguuccucccccuuucccaccagcuuccagccagaauaauugauaacuaaaucucaccaugaauuuguugggaauuuacccacaauaguucucaauuuauuuuaagauuuaaaauaauauauuuuuaaauaguagauuaagacuuuacagaaauuucagauaggauaauacagaaccuugaaaagacuuauuuuuuacaaacuuccuuaaaaauucuuaauuguucuaacagucacaguuuuguuuauguauacaauuggaguucugcaguaagacacugugggguuauuaguacauauaucaaauucaugaggcuccuauuccuguauauuguuacagagcuguucuuguauauugauguuuaaugauauggggccgaauuguuauucaaauaauuacagcccauuccugauuauuuagaugcugauuaacuagucaaugacuuauucccuuugacaaaauuucccacccucuggcuuuccuuugauguuaaugaggaagaggauccaguuuucaucccauuuggcaagguugguuucauggacugagccacucuggauguaagaucaguagcuacucuguagacuuuaugguaauggaaguuagguuagguugcaucagaacacucaaaagucaagccuaucaccauauuugagaagaaacucacaguauuugauauaccuuaguggauuugaaacaacaucuuauguuacaaaaaaauagcauuuuaaaaauuggguggggcacuguggaucacuccuguaaucccaacacuuggggaggccagggugggcagaucacuugaggccaggauuucgagacuagccuggccaacaugauaaagccccaucucuauuaaaacuacaaaaauuagcugggcaugguggugcacgccuguaguaccagccacucgggugguugagacaugagaauugcuuuaacccgggaggcagagguugcagugaaccaagaucaugccacugcacucuagccugggcgacagagcaagacucugucucaaaaaaaaaaaaaaaaaaaaauucaaaccaggcacuauuaaauguuaugugcugauacaaaaaauuacaaauuuaaaaagaaaaaucauaccacuuccuucaauaaauaauuaauuagaggcugaacauaacauuuguaaaaauauacccagaauuugcaaaacuaccuggauuuuucagaacuuacauacauuuuaccaaagugcaugagauaguaucaagauuccugcuaauagaaaaguauauaaccugugcuguaaauaaagauaaaagaguagagugagucagagaaagauggucaccugagaaguaaguaagugugucgcccacucugaucccugccccuucuugcucauugcugaggccacugucagccuuuguuuucucuuuccuacuguugagggucagggucuaaacagagauucacuggacugaacugaaaagacaacuagauuauagaacagaauucuccugaaguugggcagcauuagggcaagcugaagugugcaguuuuucuuuuucuuuuuuuuuuuuugagacggagucuugcucugucucccaggcuggagugcaguggcagaucuuggcucacuucaaccuccuccucccggguucaagccauucuucugccucagccucccgaguagcugggacuacaggcacaagccuccaccccuggcuaauuuuuguguuuuuaguagagaugggguuucaccauauuggccaggcuggucuugaacuccugaccucgugaucagcccgccuuggccucccaaaguguugggauuccaggcuugagccaccacgccuggcuuacagcuuucagaauuacauuacugucuucagacacugacauacuuuauaaugaagccaaucuuucacauacuggcagcacagggaccuuguauaaauggcugaguaaacagagguaacuuuucuccuucuauucugccuuucugaauucuuuuucugcaucaccuguucuucaaucuuccugcagcccuuuaacucuucuuauuuuugucccuuugggcaauuuuaccauaaggcuugauagcauuaaguaaaucccugcaugugugucugugucuuguguguaaugguuauuuuuuuuuuguuaguuuguaaugcacuuagcauauuccugucuaaucaaguaaacaccaacaguaauauuucuuaaauuuguagaauuauugguuuuugacagccugaaaaucauccucaaaaaaaagguauauaaacacaaaauguuaggaacaacugcaugguauucaugcaccccugguaucuauuuauggaucccagcuggguucagaucccuuucccauuuuguaguuucaaaauuagcagcuuccauggucacuggugguacagguugaguaucccuuauccaaaauaccugggaccagaaguguuuuggauuucagacuuuuuugaauuuuggaauauuggcacuauucuuacggguugaauaucccuaaucugaaaaucugaaguccaaaaugcuccaaugagcauuuccuuugagcacgaggucaguccucaaaaagcuuugaauuuuauggcauuucggauuuuguauuuucagauuaaggauacugaaccugaauuuggaaauacauuuauucaucagauacucaugggaugcuuacuaugugccagaaaaugugcagggcacugaaauagagugaaaaagacauuggcucacccaugaaaauguauaaugcaguugaggggagauaggcaaucaaauauacaauuauaauacagaauacauucaauaauaguggaaguacauauacuuaaaagagcaugucagaugaguauuuaagucagccuuagggcaucaagaaauucuccuuacaguuauaucugggucguuuguuuucugaagaagaaggaaugcuacguuuaaaguuaagagaguuacagauuuaugugucauauugagaaauuuggauuugauuuuaaaggaccuuacauugaagguuaauaagaauugaucuguaacugaaaaagauaacuguaggauggagguggguuggaggaagcagagucagagguugggcccauaguaagccagguaaacaguaguggugauuuuaacaaaaguacucauaguguaaguugaaaagaagugaaugaguugaaaauauaagaauuggaaaucacagaauuuaguaauugaauuuauuccuuccacaaauauuguugagcugcuauguguuaggcauucuguuagauaugguggggaacaagagagacacccugucuguccucaagucuagugguguugacuucagggcuuuuagaguggacaauuucagugggugaugaugccauuuaccagaaauggaacagacaggugucucagaccaaagaucccuagaugugagaacugcuuccuuaaugccccuuuugagauuucaagauguccaugugauugagaaucacugugucuaauggaaguguaucucuauguaaacaauaacuggggggggaguuugagaaccacuguuacaggugacaguugaagccaggaaguagauauuacccaggaaauauauguagaaagagaggaaaggauggcugaggauugaaccuggcaaacccauggagagaaaagaggaagcugauggggaaacgagcagaguauaaagaaucuaacauauuugaucccguagaaucaaagggaagaaaagcaauauggcagcaacagacagcugaagggcauauuggaugggcuccugguucaagguguugaccugagcuuacauaugagacaccacauguucaccaccaccuccaccaucccacuccaguuguaucaccucuaaaguguccaaaugaaauuaguaggaaaaagucuuuaucacugcagaccaccaagaaaagaugccaugcaaaugccuagcuuaacaaaacuugguuccagcaagaacuguuagcuuaugguucaucccaugcuaaggaggacccugccuggaaaguaaacagagggcccucugaccagugcucacaaauacccuucagcuuacaacagcaggagcuagagaccugggugaacuacagaguaguuguggaagaggaggggggacauauuuugaaaugucuggagccucugguaauuacauagguacuagagaacagagucccccacucacagcacaaacgcauacccaugcgauggcucagaauucucaccugguuuacucucagcaaagucaggcuaacugcagaagagacagugcuagcugccugugggucacagugauagacaaggagaggagagucaucuuuaagcugcagucacuuuuuuuuucuuuugcuggaaccuaaaaguuuauaucaaaaacccacaacauuuuugauagaacacucacaauucucaauauugguuacauguagacucuaucuggguaagcaauguggaaaaaaaaucaccagacauggaaaugucugugccagaaacuaugcagggcacugagauagagugaaaaagacauuggcucaccccugaaaauguaugaugcaguugaggggagacaggcaaucaaauauacaauuguaauagagaauacauucaauaauaguggacguauauauacuuaagagagcaugucagaugaguauuuaagucagcuuuagggcaucaggaaauucuuacagugacaggauuguucucugaagaaguagugcuauguuuaaagucaagagaguuacagacuuaugugucauaucgagaaauuuggauuugauuuuaaagggccuuaagcugaaagauguuccaaaaggaagauccaaaaggaucuguuccaaaaggagaagauugugagcaaccauagcaaaugggcuccuuugaagcaaccuugcaaaaauaauaauuuuuuaaaaaaaaaaaccucuaaauuucuaauguguauugucauugaaaauugaggagugauuguguugauaaaaucaagaaucauaucucaauguuauuaaauagaaaguaaugaugauucacucuuaaacauauucuaacaaaauuauuauauuuuaaggaauuauaagaacuauaaagaacuauaagcauccagaugugugagagucagguaagguggagugagggaggcgauaguuaucucaaaagaaagagaauuacuuuguauccaauuaccuaauagucccgcaugcuaaaaauaauggagcauccgucaccuuaggcauuagaggggaaaagccucaaauuuuacagcuugcugaggcaucuuuucuucaaagagcaacaggaagaucaucuuugucacugaaagacucacaacauaucccacuucuguauaaaucccccaaaaagcaaaauuuauaaagacauucuggagccacauaaguaauuagucagaauaaagaacucaagaaagggaagauauuguaagaguuuuuuuuuuaaguagcauagaauuaauugugacuagcaguuguuaacagaguggugugccauaaagcuaaugauaaaugauuccucaaaaaagaauaauguaacagacuaauagcagggaucuacaauuauagaauguuucucaacaauuaggcaggaggaagacaaaagaguccaaggagaguaaaaaauggcuguuuuauaauuagcauugauuaaaaaaauacaggauaaagaaaguucaaaguugagcaguagcagaguaaaaauaggaugaauaauuuccuaaguuacucauucuguucauuaaagagaggaggggaaaaaacuuaaucaauauggcuaaggggagagggaacuucuuaaccuauauggcuaagggagggggaaagaaaccauucuggaagcauaaaaaaacaaaauguagcuuuaaauuaaaaccaaacauuuauuaccaugcagugacuacccuauguuguuaaaagacaaggauucgaauuggcuuuuaaaaaaaauucagccacuauaugauccaaagguacaucuuuaaaaauaucauaauggagagguugaaaacacauaccagacaacaaacuaaaaaauuuggggugcuacuguugaauuagaggcaaaaguauuauacugugcaacuuuauuauuuuuugcuguuaaaaauucaguaaacacugucaaagcaauccucauaaaacuuucguccuaucagaagacauuuagaaguacaaggauuggaagaaacacaacugcugcugcaauuuggacuuuuuuuucagaguaaaugaacauucgcacacaaaaaaagauauagaggagcgacugcucaaagcuuaaacuaauaacuacacacuguacuuuguaugcuacagaaaguaauuuacaagaucaauuaaauauuuauaagauuuauacuggccacaaagugaauuuuaagggauuuuaaacauugaaauuggccaagcucuguggcucacaccuguaaucccaacacuucaggaggccaaggcagcagaucaccugaggucaggaguucaagaccagcccgaccaacaugguaaaacccuaucucuacuaaaaauacaaaaaauuagcccggcguggugguggacaccuguaagcccagcuacuggggaggaugaggcaggagaaucacuugaaccugggaggcagagguugcagugagcagauauugcaccacugcacuccagccugggcgacagagugagacucugucucaauaaauaaauaaauaaagguaagcauugaaauuggacuugccacauucucucaccauaaugcugacaaauacacauuuacaucaaauauuaacugaaauaauaauuugaaauuuaaaaaagaaacuuaucuauaacacaagucaaaggcuacgucaaaacuauaguuaaaaaugauucacaaguuaauggcaagaacauacauaacuuaccaaaauguguaggugggaagaggguuuaucaaaauuagaggaaaauuguugccuuauuaagcucgauagcauaaacauaagugaguuacacagcaaugcaaggaaaaaucuaaaaaaaauacuaaggauagaaaaaugaaagaauaaugacaauagcagcaauuaaugaauuagaaaagcagaaaaacaauaaaaugaucaaucuaagagcuggauuacugaaaauugaaacaaaauuaagaucaaaagaaaauaugaaggccagcucuguggcucacgcauguaaucccagcacuuugggaggcccaggcaguggaucaccagaggucaggaaucagccuggccaacauggugaaaccucgucucuacuaaaaauacaacaacuaacuagguguggugaggcaccuguaaucccagcuacucgggaggcugaggcaggagaauggcuugaacccaggaggcagagguugcagugagccgagauugcgccacugcacuccagccugggcaacagagcaagacuccaucucaaagaaaauaugaaauuaggaauaaaaagagguauauaaccauagacguguugggaauuuuuaaaaaacauauuugaaaaguaauauuuuuaacucugugacaauucaguuuuaacucugugacaauucaaucugcaaaaugaaucuuuucuuuuuucuuuuucuuuuuuuuuugagacagagucucacucacucuaucacccaggcuggagugcaaugucgcaaucucggcucacugcaaccuccgccucccagguucaagcaauucuccugccucagccuccugaguagcugggauuacaggcaugcgucaccaugcccgacuaauuuuuguauuuuuaguagagacaggguuucaccauguugguccagcugcucucgaucuccugaccuugugauccacccgccuccuccucccaaagugcuaggauuacaggugugagccaccaugccuggccccaaaaauguuucuuaaaugaccaaaaugagcuucaaauggcuaacaacuauaaaugacauugacaaaaacagaauuuaaagaaagacuccucccucccccaaaaugcaaauuccagacauauuuaucacucaauacugucaaacuuugaaggaacacaaauguccuauguuaucuaaucuauuucaaagcauggaaaugucuugugaaacuuugcauuuuauuuuaugaagcuaggguaucuaugaccaaauuauuuuuuuccucaucuuuauugagguaugauugaaaaauaaaaacauuauguacaagucuacaacuugauguuucgauauagauauaaauuaugaaauagucaccacaaucaagguaauuaacauaucugacaccgcauaauuaccauuuucuuuuuuuucuuuuucucuugugugguuaaaauacuuaagaucagcauucuuaaguauuucaaaccaaucuccaguauacuauauaauauuguuaacuauagucacguugcuuuacuaugauuaaauucuguauuuuuuuuuuucuuaaaauauuaagaggccuggcauggugacucacaccucuaauucuagcacuuugggaggcugaguggggcaggauugcuugagcccaggaguuagagaccagccugggcaacauggugaaacccugucuccaaaaaauaacaaaaaaaaaauuagcugggaguaguaucguguaccuguagucccagcuacucaggaggcuaaggugggaagauuaccugagcccaggaggucaaggcugcagugagccguguucaugccacugcacuugagcauaggugacagagugagacauugucuccaaaaaaaaaaguuaaggacacuuccacuaaaaccacauauaggaaaucuuaagucaaauagcaaauauuaauaaaaucuggcagaauauugaaagauuccuaaaugugaccaguuaagauuuggcucacgccuauaaucccagcacuuggggagcccaaggccgguggauuaccugaggucagcaguucgagaccagccuggccaacacggugaaaccccgucuccacugaaaauauaaaaauuagcuggguaugguggcaggcaccuguaaucccagcuacucgggaggcugaggcaggagaaucgcuugaacccaggaggcagagguugcagugagccgagauugcaucauuguacucccacuggacaacaagagcaaaauucugucucaaaaaaaaaaaaaaagauuuguuucacuaauguagcauuuguucaucauuagaaaaauccauaaaaugguaaccacauuaagagaucaagaggaaagccauuuucagucauuauuacuaagacaaguuguaauauuacucuagaguaauagagugcuagugaacaaguggugaacuaaagugaccacuuuccuugugaaacuuaaguuccaaugggagaaugacaguaaacagacaacuauuauaauaagugcauggaagauuuugguguauguuagauuuucaaaucuguagagaaaaguuggcucauucaauaaaaauuuugaaaccauugauuaaugucuuaauaacuauauguuaaaucuaaaauuuauacuuuagauuuaaauauguuacaaaugaauugaagauuuuaagauuaaaaauugaaacuaaagugugaaaagaaacaguccgggguguuuauauuaccuuauguucuguuugaccuuuucagucaugucagaaggaagcaugcuugggaagauuuaugagcugaaggauaauauugcccuacuucugagacaauaaagacaaaagcaauugcuucaaacuugcaagcauucagcaaagcauaacaugguugcaagauguauuauauuugaagauuuugcauauaaagaacugaaacugcaaggggcaaaauuaauaucaucaggcuaaggcaggcagaucacuugaggucagcaagaucagccuggccaacauaguaaaaccccaucucuacuaaaaauacaaaaauuagcugggcaugguggugcaugccuguagucccagcuacuugggaggcugaggcaggagaauuaccugaaccagggaggcggagguugcagugagcugagaucacaccacugcacuccagccugggcgacagagcaagacuccaucucaaaaaaaaaaagucaacaucauuccuugauacauuaaguuuuuucagagaaaguccagcuaugcuaaugagacucacuaacauuuuucaaguguauucuauguauuaccucauguaguacugaagacagucauuggaaguaugcagauaggguuuuacagggaaggauauggagacacagaggaucauaguagcuugcccuagggcacucagguauaauaauuggcagagccagcagccaggcacgguggcucaugccuguaaucccagcacuuuaagaggcugaggcaggcggauuacuuguggucagguguucaagaccagccuggccaacaugguaaaaccuugucucuacuaaaaauacaaaaaauuagccgaguaugguggcacaugccuuuaaucccagcuacuagggaagcugaggaacaagaaucuuuugaaccagagaggcagagguugcagugagccaagaucaugccacuguacuccagccugggugacggagcaagacucugucucaaaaaaaaaaaaaaauaggcagagccaugagugaaauucaaucuuguaccagaguccacuuuauuauacuguuucgaacaugguucugaauuuuaaagaucucaaaaaacagguuccuuaagaugaauucagagaggggagaaauuucacuuaaucugcuucaagaguaaguuuggaugauagcauccccacaucacagcugacaguccauuuggagcuuauaagaaucccuuucucaccuacaugcagucuuugucagaaagauguucauggggaguguucgggacucaaguuucauucagcugacaaaauaacuuccagaaaaucacuuugaaaaaauuuugggcaaaacauuucucuauuuacuccaaaacaaaugaguggacuuugaaugccaccuacucacuucaccaacauacauuuuuagagcugguuuuucuccauuugugacuauaaaaggaaagcagugcaaucagccuggcccacuuugaguucucuuucccacacccaguuugauugaaggacacaagauuccuucaagcaagaauacucagugcuuaugugggcaucacaugaucaaaguuucuaagcaaaaauguuuuuuucccaaaaccugacauuguuuuagguuugggaugauggugaucauuauuauuauuauuucaaacauuaaaggcagaccugagauuuuuaaguuucuuuaagguggugugaacuuuugaaaacauucagaaauuaccagcugcuauugggaggaauuaaaaauaaaaaaggaaaaaacauugggaaacaguauuuuauuauuuauuuguuuacuuauucauuuauuuauuuuugagacggaguuucgcucuuguugcccaggcuggagugcaauggcgcaaucucggcucacugcaaccuccgucuccuggguucaagcgauucuccugccucagccucccaaguagcugguacuacagucaugcaccaccaugccuggcuaauuuuuguauuuuuaguagagaugggguuucaccauguuggccaggcuguucuagaacuccugaccuugggugauccgccugccuuggcuucccaaagccaccacgcccagcaacacuauuuuauauguauuauuuuugguauggaaacauaaagauaguuauaauguuuuucuuuuuaaaaaaaaagcauccuuucauccacccagauuuuucuagcccucuuacuuuaauuaauccaaaaaagauguguuauagccuauuaagguuagacuaccucuauugauauauugcuguggaaauguucauagcauuaaacaacuacuguuuccuuacuguaaguaaacauuuauuaacuaaaaacaaccugcuuuuacuuguuucacuuauauucucaugaauucagauuugucuuaaauuuuuauagcuauaauuucauccaauucuuauuuauuuggucauaugucucuugcagacauuucuucggauuuguuuuguuuuguuuuguuuuuuaagagauggaaucuuguucuuucacucaagcuggagugcaguggugccagcauagcuuacugcagccucacccuccccagcucaagagauccuccaaccucagccucccaaguagcugggauaacaagcgugagccaccacacccagcccauuucuuaguuuuuauguuuuaaaucagucugaauccugaucuuuacgcaggaagauuuauguugacaguugauaauaauguugauuauaacauuaguauuaaccuacauucacuaaaucuuuacuaggugacaguaaaacaacaugcacaauaugauccuauuuuuauaaaauauauuuuaauuuaugauaugccgugcagaaaaauuauauagcagcuguuaaaaguaguugucuuugaugguaggacugcaaaugaucugaauuuuuauguguguguuuaaaauuucucuaguaaaagcauagugguuccauaauuuaaaaguuuaauaagggaauaauauagucagcuauaggacaaagcagauaaaugucaauagcuuucuuauauacuacccauacccauuagaaaguuucagggagacgcagggaacagaauaaauaagcaaacaaaaauuccauucucaauaaugacauaauacagaaaaugcccacaaaugaacuggaaaaaaaaguauuuucaaaaagaaaacuuaaauuuuugagagaucuuugaaacaauggaaaauuauaucacgggucuuaaugggaagacagugauuuuuaaaugggagagacuugaauaugauuaaauauuaauguagaagaggaaacuuagaguuuacauacaacagaaggaauaguuuuucaaguagacucagugaauauggguagacauggaguuugagugagagcuagaaaauagauuuuuuucaaaaccugacauugacuuuuccaaguuuccagcauauauuccugggcagaagaucucaauaauagcaaaaauagcaaccacuuauuggaugcccguuaugucuuagacaauggaauaguuauuuucauaauuagcugacuucaucuuuaccaccuucugcaagcuaucuucauuaacuccacuuuuuaaauaaagaagcaggcuuuuaaagcaaaguuaaaucauuugcucaaggucuuacaggagcuaaaugucagagcugggauuugaaccuagaccuguaaucuaacaucuuuuuucccuacaguauacugcauuauacugccaccauaagaccuggaccucagaaggggaagcaggcuuaggguuagacuuuuuaacaugcuggaucuaagagauuuacacaauaucacuuuggugauaaaccauugaaauauggucuggagucugaggaaagaaucagcugaaaauauacuuacagaugucaucuggagaugguugaauccuuguaauccuagcugagauugcccaggagaguauagucagcaaaaagaggauagcaccaauucugggaacacgaacuuuuaagagacuaguaaagagaagcuaauguaugagacuggaaagggaugacagaaagaagagaagcaaauguguaaaauaacacaccccuaccggccgggcacaguggcucacgccuauaaucccagcacuuugagaggccaaggggggcagaucacaagguaaggagauugagaccaaccuggcuaacacggugaaacccugucucuacuaaaaauacaaaaauuagcuggaugugguggugggugccuguagucccagcuacucgggaggcgagacaggagaauggcgugaacccaggaggcggagcucgcagugagcugagaucccgccacugcacuccagccugggcgacagagcgagacucugucucaaaaaaaagagaaaaacccuguuucaucaguauuaagauuuauauuuucuugcauuugacuaucucaaaaauuggcaugugucuuauuaucaaugaggucuuguaauuggcaguacacaaauuaguaguacauaaaugggacaucuuauaacugaaggaauauuuuaaucugguaguugaugguuuaaaaaucaaucaugcuuauccauuucuaaauuauuuuagaaugaaagcauaccuuuaacuuguauaagucuauuuaagcagugcauagauuagauuaaaugaaugguuaucuguuagauggguaguuccggaguuaagagcgcaagcuccggaaagagccaagguuauuuaaaguguccucaccuaccagcugaguccuuugggugaaacucuuuacucccuuaagccuaaauuuucuuaccuauagaacacagauuaaaagucucuauuucuuaagauuguuguaaggauuaaaugauauaguacauguaaaguacuuagcacugugccuggcaaaugguaagcucucagucaaugauaggcauucucaugauuuccgauuggaaagaaauuggugcccuucccauccuaccccaggguacugccauuucucuuuaaguaaagcuagauuauaucugaaauaggcaaauauggaaguuuauauacacuuaagggagcuaccuguucccuucucuugaaggauauuaaacugugguauuugcuagagaauuugaauuagcagguguauguagauucugagccuuuuuugugcucagcucaaagccuugaccaugcugaauacauaacaaaguacugauugauaauguuuaaccccuaggggcaggcuuucuuuucgcccugagcaaaaaagaugcaaucuuuguggauggguguuuggggaauuccugcaauauaccuuagaugcagaguuucggguggaguuuuguuuuuauguuuguuuguuuuguuuuguuuugacuuuccauuuuccacuuuaacugugauccauuccaggggauuuuguaguuucucagauguuauacuggaugaaaaguaguaacugcauaaacauuaguuugagaauacagauaauguuauaaaucuucaucuugguuuguauuguaaaggcagcaucucaugugacuuaucuuuauauggaauugcuaaauuaguauugugccuuuccuccagaaagcuuaaaaugaagucguauaggcagccugauuuaaaagauaauuacuauuccauuuccuaaauguucuaccaugcaagaagaauuuggaggaaaaagaaaaaguuuauuccuuuggggaaaauuaauuuuacuuugucuugguaaaaugcuaccacauaugcaguuaaaugacaauucccccuccaaaaaaaauuuuuuggcagucauagucaucaugacuucuccuauaagauuauccuaguguucaggaugcuucucaaaaggccuagaagauaacaaauauuugucuaaguguguuucuaagggcuguaacuaagcaucucucuuaauucagcaaacuaccuuuuuuuauucagucaaaauuuaccuuuuaaauuaggcuuguaauuugauuuucauugguaucaaagaauucucuuuugacuccaauauuacauuuaauaauucaaacucuaauaucucuauugaaacacucuguguuucagucguguuugaagaugucuaaaaacaaaagucuuuugcauuuuucauauucuauuuaauggcuggaugcaugucagugcauaggauuugagucauuagugugccacaaaacauuuuaccaagaaauggugcgucaucaaauaguugaauuacaaugguagcuguaaacgggacccaauuuacaaaaguaaauaguguccccuuuuacaagaaagaaaauuaaccaugcucauucagauucugaaguuuaauuagcuuuaacuugcuaaaagaaagaaauugaacaaguaaauagcauguacuucaccauauauagcaaauccugaaucacugccauuuuuuauauaacugacccacauggguucuuugcuuuuucuuuuaucuguuuaccucagauuuuuuuuuuuuaauaaaggacuauaauuugauuggcuuguaaauucuucccauuucuaacaugcuauaagacuuuaagccuaauuuccuuugagccuuaauccucuugcuaauugaugugacugaguugucuggaaucaaccuccuuggugcaaaugacugagacugugacguucuauggaagcaguuugguccgggaaugaauccuuucauucagcaaacaaaugccaugccagcugaguccugaaagagcucaugggcacguaaaggaauauaguuguuuuacaacaugucccccaaaauuauuugacacucuucucauuagcaagugggacucugccccuuccacuuggaucugagcucuguaacugccugccaauagaauauggcagaaaugacgcauuguaucaguuucugggcccagaccuuaagaaccuagcagcguccacuuccugucuccuuguaugcucacucuuggaacccagcuaccaugcugugaugaagccuaaagacccaagcagagaggaaccaacuugucagcuguaugaaugagccaucuuggagguggauucuccaguuccaggagagcugccccaguuaaugcuacaugaaacagagacaagucaucagucauccauccccacugugcccuuuccaaguuugugagcaaaauaaaugacuguugaguuaagccauagaguuuaggaaugauuuguugcuggaacaaggagguagacacauaaacaauuuugaagcaauguagauuacaaugacagugauauuuacuacguaucacaggaacacugagucgagacaccuaauccuuccuucaucaucaaggaagacucccucaaugaaugagauggcaacugaacugaaucucagguuaaccagguuggagaauaaaggguggcguguucuaggcagaggggacaacagugugaucacaagcagagaggaaggaaacaacauggugugcagaaggaauuaugagcacuuagguguugcuggagcuuaaagcuggaauaggaaguacuaauuauguagccagagauaauuggcaaagguugaaucaugaaggcccguguuugccaggugaagacauauuguguacacacagcuuguuauuuucauuauuguuguauugcauuuuggauugaagcugucugaucagguuuguguuuuagacaaauccuucuaucagcaguggggaagguggauuucaggguaugaauucugaagcaugaagaccagucagauggccguugcagcaguucaggcaaggacaaugaggccuaaauuaagacugcgagggugaggauggggaagagaaacuagagucaagaaauaggugguuuuaaaaagaaguauuuagaggguaaaaagaauacuaacuggccggaugugguggcucacgccuguaaucccagcacuuugggaggcugaggcagguggaucacaaggucaagagaucaagaccauccuggccaacauggugaaaucccugucucuacuaaaaauacaaaaauuagcugggcaugguggcgugcaccuguagucccagcuacucaggaggcugaggcaagagaaucacuugaaccugggaggcggagguugcagugagcugagauugcaccacugcacuccagcuuggggacagagugagacuccgucucaaaaaaaaaaaaaaaaacuaacugauuauagggaggaaagagacagugaaagaggacccucagauuucuaaguuaggugaaagcuagaugccagugccaccagaagggagugagggggaauauaaggaggaggauaaugcaggggcaaagcuagagaguacagcuuugacgugcuggauauguaaagucucuggcauccauguagcgaugucagugaggcaguuggaaauacaugucaaaaauuaaaggagauuuaagcuguaagaaaagauuuggcagccauugucacaaaauugcuagcugaaauuaugcauagacaagcucacccaggggaagaauguucaguuaaaaaagaagaggacuguugggugcgguggcucacgccuguaaucccagcacuuugggaggccgaggcggguggaucaugaggucaggagaucgggaccauccuggcuaacauggugaaacccugucucuauuaaaaauacaaaaaaucagcugggcgugguggcacaugccuguagucccagcuacuaggggaggcugaggcaggcgaauugcuugaaccugggaagugguugcagugagucgagauugugccacugcacuccagccugggcgacaaagcaagacucugugucaaaaaaaaaaaaaaaaaaaaaaaaaaaaaaaaaaaaagagggcugaaggugaaacucugggagcacccugacauguagaaguuaguuaaaggaguccgggccuguaaucgcagcgcuuugggaaaccuaagcgggcagaucacuugaggucaggaguucgaggccaggcuggccaacauggugaagccccaucucuacuaaaaauacaaaaauuagucaggcgugguggcacgugccuguaaucccagcuauuugggaggcugaggcaggagaaucacuugaacccagaaggcagagguugcagugagcugagauugugucacugcacuccaaccuaggcgacagagcaaggcuccaucucaaaaaagaaaaaaaaaaaaagacauuuaaaggaaaaugugcccacaaaagagaugggaaaagaaugauccaagaaguuccaggagaaccaagaaggaggagucaucucagaaaccaaagucagagaguugaaaaaggggguaaucuccugugucaaauguaaacagucaguccaguaagauaaggauugaggaagggucauugguaacuuuugccaagcuggacaaaaccaaauuucucuuuuuuuuuuuuuuuuuuuuuuuuuuucugagacggagucucgcucugucgcccaggcuggagugcaguggcgcgaucucagcucacugcaagcuccgccucccggguucacgccauucuccugccucagccucccgaguagcugggacuacaggcgcucaccaccaugccugucgaauuuuuuuguauuuuuaguagaaacgggguuucauuguguuagccaggauggucucgaucuccugacuucauuauccgcccucuucggccucccaaaguccugggauuacaggcgugagccaccgugcccggccagacaaaaccaaaugucaauggauaagugcauggaaaguaagaaaauagacaccaaugguacagccaaggcaaugaagaguagcuagagaagaacacaggagcaugagaggguggugguggugguuuuggagagauggaaaauacguaaauacuuuuaugacccaaauagcucaugccauuaaagggaggagauugaagagagaagaaaaagaagaugugauucauguaguagcaucuauucagagauagaagggcagagagucaagggcagucuuuugggauacaguaaguguggguauagauguaaauaguuuuauaagaguagggcaggagauugaagauuaaagcugauggacuuaauuuuuuucugugaaacaggagauaaguuuguucacugagggaaugaguauagcagggauugauagcuguguuaaagacaguggugagucuuagaguagucuuuuaagaaaauggaaacaagggcuagcucacaagaggcaagaaggauugauaggugacccagagguccaguugacuuuggagauuauggucuuauacuaguaaucugcacaguuuagggcuuuuauucaagggaaugccccaccccuaucccauucacccccgcuccccccaccccacuuuccuggcuccccugagugagggagaaugggcaagccuccauaggaaagcagccucagccuggacaaaagcaaaguuuuguuuaagacaacagauggagcauucugugugcaacuggaggauggcuuguuuuguuuuuuauaauggcaugaggguucuagaaaguaaaauaauaggaaagauuagaagggacucaagaaugagaaaagccacagauaagaaaacacagaggaguaagaggaugaggguaauggagagagguggggggguuaugggaguggcaaugugauuugcuucuuauuuagucgccagagguuaguugaaggaaagacuugguuggaagcuauugccugacauuuccuugguacaagacauuguggucacacaacugaccagugguccuuagcaguuucuggccugcucacagagcuuuguuuucuguuuuugagacagaguuuugcucuuguugcccaggcuguagugcaauggcacgaucucggcucacugcaaccuccgccucuuggguucaagcgauucuccugccucagccucccaaguagcugggauuacaggcaugcacuaucacacccggcuaauuuuauauuuuuaguagagacgggguuucuccauauuggucaggcuggucuugaacucccgacucaggugauccgcccacuucaugcugggauuacaggugugagccacuguaccuggccuacucacagagcuuuuaaagagaaagugagaguccugugccagacagagaugggcuccugagugaacucugccagccccagaguuugcaguagagcaggaguccccagucgguggccuguuaggaacugggccgcacagcaggaggugagcagcccacaagcgagcauuaccaccugagcuccacuuucugucagaucagcgguggcauuagauucugauagaagcaugagcccuauugguugugcacuccuuaugaaaaucuaacuaaugccugaugaucuaagguggaacaguuucauccagaaaccaucgucguguccucccuaccccugcccccaccacaccccagucugugacaaauugucuuccaugaaaccggccccuggcaccaaaaguuggagacaacugcaguagcguacuugcuugaguuaucccauagaguuguggaacagcaacaucuuacccuguggccuacucuuguuauugcaguacccacaaauuuaacaguaguaaucauaauauaaacaauagcuuauauuuauauggcuuuauguuuauuaaauguugguuucaacaacucuaaaacaggguagguaauguuaucucauucauaggucagaaagccugaaucucagaggguaaggucauacugcuaauaaauggaugaaauaaaaauagaaaucagaucuucugacuucuagcucuuuucagcuaugccacacugcaguuuuggagcuggaaacugcauugggcucauguaauccaaccucuucucuuauagaugaagcaaccgaggcagcagccuggugaaacaaaaagaaagcagauauugcaggcuggauauucugggauaaauauuuuauuuaaaaaucuuuuaauguuccagaaagguucaguaacuuucuaguggccacagucagugucgaagccagagcuggaacacacccuacuacacgacucuugggauuggguuucaaaucaagaaaugugggaggacauaucucugaugagucagaauaguggaagggaguggccccggaaugugacuaccuggaagaaucuaguuccuuaggcuaagucacuaguguuagcccaguauaaaaauguguuuuucagaauggaaucaggaggguaaaauuaaagaugaaaucaucugaauagcaguucucuaccaagacagcacuuuagcuaaaggaugauuacaguguagggcgguucauuuugauucacuggggcuauaucucuauacuuucgugugugguaguugcuuuccccacuagaucuggguucuagcccucccugcuggcucccucacuuaguggacguugaaccuuucacuuuccuucucggggccugaguuuccucaauaaaaagaauuuggaucuagguggccgucuucuuugugguuuaauucccuaauuucauuucauuuauuuauuuauuuucuuuuuugagauggagucuugcucuguuacccaggcuggagugcagugauguggucucagcucacugcaaccuccaccucccagguucaagugauucucaugccuuagccucccgaguagcugggauuacaggugugcaccaccacacccagcuaauuuuguauuuuuaguagaggugagguuucaccauguuggccaggcugaucuuuaacuccugaccucaggugauccaccugccuuggccucucaaagugcuaggauuacaggcaugagccaucaugccuggccaaauuucuuaauuucagauauacccuauggcacagauauuuuaaggcaaaacauagguauauuaugccauacauaaguguauuggaugaagcugacagagaaaaguauauaaucauucugagaaaagaagccucgauauuuacauuucggugaaaagggggagaaaauuacuguuuugcgaaucaaccaaaguacuccauagucauuacagaagcauguacuuaccuguaauuuuuuguggaauuguucaaaguuuauuguuuaacacuuauugacaaucacuauuaugcuggauacuaugggagcaaguuuaugcaagcuaauccccugcuguguuaaucuagggaaagaauggaacagugaucaaauuugcaagguuagaaaugcuaaagcucuugcuuucugucagaaaacuccagcuagguauucaaauuuagucgagauccaauaucagaaagccuuuauuauuuauugaagcaucugcucuuucuacuuuuuccauuuggcuucugugcucugugguuacuauucucagguaauuggggguaugacuucagucacuuuugaaauauugggaacuaaauucucucauuggagauucagcacacuucaggcauuuuaauaaaacucuaguaucuugaauucuggaaauuuaauuaauauacuuacacuuugaauuuuuucuugccugaaccauuacacauuuuuacagaacaaauauuuaauccuuaagauuucauaaccaagggauuuaaagauuagcuuugaaaauaggucagggaaaauauccacuuugguuaaaagcuaaucauguaaagaaguaaaaaaaaaaaaacaaaaacaaaacagcuuagaagcuuuugaaaaacauuuuuaaaaaucaauuguauuggcuaggcacaguggcucacgucuguaaucccagcacuuugggaggccagcauggucagaucaccugaggucaggaguucaagaccguccucgccaacacagcaaaacccuauuucuacuaaaaauagaaaaauuagccaggugugguggcgcacaccugucaucucaauuacucgggaagcugagacaggaaaaucacuggaacccaggagguggagguugcagugaauugagauugcaccgcugcacuccagccugggugacagggugagacucugucucaaaauaaaauaaaauaaaauaaaauaaaauauaaaauaaauuguauaggccgggugcgauggcucacaccuguaaucccagcacuuugggaggcugaggcagguggaucgcaaggucaggagauugagaccauccuggcuaacauggugaaaccccgucucuacuaaaaauacaaaaaauuagccgggcgugguggcaggugccuauagucccagcuacuugggagacugaggcaggaaauggcauggaccugggaggcagagcuugcagugagcagagaucgcgccacugcauuccagccugggagacagagugagacucccucucaaaaaauaaauaaauaaauaguauacaauuuugugaaaguauaugagucaaacuuuccuuuaguuugccauucauucauucauccauuuauuaguauucauccauuuauuguucauucauucaugcaccaaaaauuguucuagacacuaggguagcaagaauaaauaagacagucagagcuuacuaugugccaggcacuuugaaauuuggagcucaaugcuuuuagcuccacaaucuggugucaugguguaagcauuacacuggaagucuaguuuuuuuuucuaaaaacucacugguaggcuguguggcuuuaggugagacccauucuguguuaguuuccuccucucugcagugguauugcucacucuguuuacuucguagcuuugaugucagaaucaaaugaaauggugguuuugaaagagcuuuggaagucccagguguuauauaaagcaaguaguauucuuguaaauguggcagugguuuugaccauuucagugccuccgcgaaaaaagguugaagaugaguaucuuuauauuguucucuugaacuagaucuauauguuuaugcuggucagucuuaccauuuccuccacuuccugugcaggcgacagggaccucauaaugagguagcugggggaaugauaacuauagugaaugaaacucauuuagaaaauauuauucaauuuacacauugcauuaaaucagcaaguaaugauuaagugcucagauuaagggagcagagagagagauaagguaggagauggcaucugucuucaagcagccuagacuuggauuugaaaauucaaagcgauugaauauaaaucauuaccuaauugccauuucccagggaucuauguagguaugucaguuugguucuauaauguuuguaaggguccucucuuagacguuggaauacucaguuauaccugcuggcucauggaacagguguucuuaggaagaaacuagaagguuacuucuagcuucauguuaauuuuacugcuggauccuagguuuaccauguucaugcucuagaaagaaguaagagggcugggcgugguggcucaugccuguaaucccaauacuuugggagaccaaggugggcagaucaccugaggucaggaguuugagaccagcguugccaacauggugaaacccugucucuacuaaaauacaaaaaauuagcugggcaugguagcacgcgccuauaaucccagcuacucuggagguugaggcaggacaaucucuugaacccgggaggcagagguugcagugagccgagaucauggcacugcacaccagccuccgugacagagcgagacuccaucucaaaaaaaaacaaaaaaaaaaagaagaggccugauaugaccuagaauaaauuuaaucugggacuaacucaggaaucccucucaaauaucagcucuagcguguaaagagagauuuuuguguuuuacucacugcugucuccccauugccuagaacaauuccuaacaccugguacucacugaaaauguuuuaaaugaaugaaagcugcaguccccuguuuagaguuuuucuacuguucucaugucucagauagauggcuccuugaagacaaggacuauacauuaugaaucuucagauuucccaugucuggcacauaacuggcccucugaauuuucuccaacgaacauagagacaaguguaauccagguccaugagggagucucucccuagaguaagcccuaaaagcaguagaugugcuuguucccagggagucugaggcauagcccaaaguggacugucaugagugugaauuucauugacauuucuuuuuuaaucuuagcauuucuguuuauuuuugaguuuguacuucauucauauuccuuuaaaaagguuauaacccucaacaggauggagaacauaugccuuauguauauccucuguggagucccauucaugccugucacucucagcagcgccugucccaggacagggcaggcuguucuuguuuuuuccuuuuuuugaaauggagucucucucuguugcccaggcuggaaugcaauggcgcgagcucggcuuacugcagucucugccuccuggguugaaacaauucucauuccucggccuccugaguaccugggaccaucugcgcgcaccaccacgcccugcuaauuuuuguauuuuuaguagagaugggguguuucaccauguuggccaggcuggucucaaacuccugaccucaggugaucagggugggcuguucuugaagcuacuucagaaccguguaagagcugaaagacccagagaaaauuaucacaggguaggagagaaaaguaggacaauucgccagacucauuuucugggaguuuucuuauaccaucuugcagccucauuaacucuuccaacucuuuauaaaauaauaauacugaaaaauggccuuauaucuucuaguaccuugacacaugcaaauaucucauuuaaucuucacaacaacccugggaauguggcuuuuguuuuguuuuuauuguuaguacuauacaaaugagaaaucucaaaccaggagcaggcugaaacuagggugagaguccucaccucaggcacaaaacuuaaggggaugccaaaaacucaguaaucaaguaauauuuuauguaguaucuuaaaaauuaaaguuuauauacaguucaacagggccaggauuaaggagaggcaagugaagugaauuaugccagcugcaagguuggauccuggcuuuauuuaauuuuuuuuugguaguucaugaauuuuuugcauuaacuuuguuauuauuauuaucauuacuuuuuuuuuuuuuucuuuuugaaacggaguuucacucuuguugcccaggcuggaguacaacggcaagaucuuggcucacugcaaccuccaccucccagguucaagcgauuuuccuaccucagccucccaaguagcugggauuacaggcaugcaccacugugcccggcugauuuuauauuuuuugaagagacaggaguucuccguguuggucaggcuggucucgaacuccugaccucaggugauccacccaugucggccuccaaaagugcugggauuacaagcaugagccacugcaccuagucuuuugcauuaacuuugguuuuuaaauuauugcguuaaaaugcugcuaucuuuauucaguuuuuuguuuuuuguacccucuuaaauuuugccucucaggcagguggccgccuuacuuuacccuaguccgugccuugccuuagagauuuaauucuguaggucauaugacuuguaagaagcagagccuguguuagaaccaagacuucugacuccaaaucauaugcucuucucaucauaccacauagccacuuaaaaugccuaguuuucuuugucucugaacaucuauugauccuuaguuguuuuuuaaauuuucucagacuuguaggccccauuauuugagaaugacuuucaugguuccuuuugaccuuucuguacuuuuuuuuccuguaaauguguaucaugaacccucuauuacuuuaaguuauuugauuuguaagcauuucuggaugaauugucucucaagggcacacuucaaaauaguugccuuacuuagaacaaaauccugugacccgaauaaagaacacaugaauauagcuaacccugugugagcuugcggggcaggucaaauuuuuucuuuuuuuuuuuuuuuuugagauggaguuuugcucuuguugcccaggcuggagugcaaugcgcgaucuccgcucaccgcaaccuccgccucccagguucaagagauucuccugccucggccucccgaguaguugggauuacaggcaugugccaccacgcccggcuaauuuuguguuuuuaguagagaugggguuucuccauguuggucaggcugaggucuauuuuuuaaaccccaucaaacuguagaaugaaauagugguuagaaaagcaacuaugaauucaguggcaugucuuauaaagucagaauuccuacagacuuuacucuuuagugaaguuucuugaauaaugaaaauaguucauaacaagaacaaacacaauuaacacugucuguauucaccuucuggugggggaagugcaucagacuauaugaaggcauaaaucaccuuuuucuguuaggauuuuguuuuauacaauguauuaucaauuuguccugcuauauaguuggagagaauagaaugcugucuccaacugaucauuuuccuuauaguugaccuuacuccugaauaagguucaggcuuucaugagaauuucagauccaguauaccuguuggggaugaauagcaaaagaaaguacuaggaguuugggauuagaaauagaagauaaaagagcaauaauagacuuguguuuccuugcaauucaggcuuaguaaaggaagucggaggcaaggaaacuuagaccuucaaauuguacuccagugucuguuaaagaggaagaaggagagauguucagaaucacuauguccuugggaauaucacaggacaaaaacuuuauuuauaaauaaagguaaucugaacauuugguuugagcaucaggcacagaagcagaaaagcauaacuuuucuuuuuucuuucuuuuuuuuuuuuuuuuuuugagacagagucuugcucugucucccaggcaguagugcaauggcaugauauuggccuacugcaaccuguaccuccuggguucaagcaauucucuugccucagccucccaaguaacuggauuauauauaggcacgcacugccacgcccgguuaauuuuuguauuuuuaguagagacaggguuucaccguguuggccaggcuggucucaaacuccugaccucaguugaucugccugccucggccuuccaaaugcuaggauuacaggccugagccaccgcgcccagccaaggguaccuuuucuaaauauauguucucuuuauugguuuacuuuagugagacaaauauguguaaaggcuuucguuuguauguauuuuuaugugagaaguaaggcuagacagugaggaccaaaugugagaaguaaggcuagacagucaggaccaaacugcuaaaggaguugaaugcuacgcuaagaaaucaguacuuugccaggcaugguggcuuacaccuaugauccuagcacuuuggaaggcugaggcgggaggaucacuucagcucaggaauucaggaucaaccugggcaacauagggaggccugucuacaaaacaauuaaccaaguguggcugugcacaccuguagucccagcuacuugagagccugcgguugggaggauaacuugagcccaggagguugaggcugcagugagccaagaucgugccacugcauucuagccugggugaagagcgagacucugucucaaaaaauaguaaucgguacuuuaucuaauaggucauguugaauuauagaagacuucugagugagagauggccucaucaaacucauuuuucaaaaaguuuaaucugguggaauuaggaaggaaagagaaagcagagagaguacuuauccaugcguaaaaacaaguauuuuuuggcugggugugguggcucacaacuauaaucccagcacuuugggaagcugaggugggaggaucccuggaggccaggaguuugagaccagccugggcagcacagugaaacccucaucucuauuuaaaaaaaaaaaaaaaaauuaacugggcaugauggugccaccuguaguuucagcuacuccagaggcugagguggaaggauuuuuugagccugggaggucgaggcugcggugaaccaugaucacaccacugcacuccagccugggcaacaaagcaagaugcugucucaaggaagaaaaaaaaaaaguauuuuuugagaaggucaacauuugguuagugaaauuagaaaggaaaggaaaguugugacguauguggcaaaggaaauugacauugucacuggcacuucuguuggucguuugaaggagaaagaaguuaaaaaaaagagaaaaggaucccaagguuuuaucaugggcugccuagagaaugaucacuccauuaacaacaacaacaacaagcaaaaagaacuauuuggagaauaaaggaaaagaugguauauuucauuuuaaacauuucuuugaagcaguggugugaugaguaauuaaaauauuccuuagguuguuggggaugcagaccuggaaucagagagaaaaaucagggcuaaaaaugaaauauuuagaaauugcauauccaaauuuaauguuaauguuucagcagaaacaaaagagagagcugagaugcacauacacccauugccuagaaagagaaagagaugcccugggaggaauggccugagauggaggagguguaagaucccauagcagugcaugagccaagagaggaaguaauuuuaggaagagugguauggccagcagugccagagccugcagaucaaaacucaugaguaaucauaggaguagucuugagcuuagaaaauacaaauugagaucuuggaggagcaagaguaucaaaaaguaggaauuuuaaaauuuggcagguauuggggaagagaucaugacuuuuuaaaaaauauauuguuuaguuucuugauucucuuuuuuauuccacaaaauaugaacucaugcauagcuaucuuugcuuauuacccaaaauggauuaagauauauuugacucuuuaacuuuguuuuuuguuuguuuuuuugagacagagucccacucugucacccaggcuggagugcaagugacacgaucucgacucacuucaaccuccuccuccuggguuccagugauucucuugccuuagccucccauguagcugggacuauaugcacgugccaccacacuuggcuaauuuuuguauuuuuaguaaagacaggguuucaucauguugacaggcuggucuugaacuccugaccucaagugaucaccuuccuccgccucccaaagugcugggauuacaggcuugagccacugcacccagccgacucuuuaacugaguaaaagaagcugguucauauauggcugauuuggucuuugaaauacuguuuaacuuuguaucuauggagcaaaaccaugccacuauaaaaugacacuccucuguauucugcucacugcuugaucaauuuauuuccugugcucaucauggcuuggaugaagagaaguuuuuuacagcaggggucugaugaaugugaacauucaaugaucauagcuuucuacaagaucauuaagauccuuguuuuaugcuuugaguauuugccucuuggcaauaguucauggaaucugauuaaaccuauaagcuuggaaagcaaaucguuuaagucuguguugcagaggauaacuuacuucacaugaaucucaauaauaggucauccugaaucagucaucaucaauaguuaacaacaucuaucaaguuaauugcucaagagccuuuuaccaagcugagaguguaacaaaguaagcuaaacauaacuuguuaacuuguccucuggaagccuucauucagucagucauccauuuauaauuuauugauuacguauguacuuuaugcaaggcugaacuaaaggacaagcacggcccuuaugguucuuuaggacuagucucuuuacaaauaaugagaauuucaauacagucuugcaacuguaguagcaauaagcauaaggagcuauaagaagagagagaguguagcuagaauauaaggagagagguaaaaaaugaaguuggagacaguauacaggagauagauuaugaacauccuuauaugacuuacuaaagaaucugaaagguccaggugcggugacucaugccuguaaucccagcacuuugggaggccaaggcaggaggaucauuucaggucaggaguucgagaccacccugggcaacaugcugaaccucugucuacuaaaaauacaaaacuuagcggggcaugguggcaggcaccuguaaacccagcuacucgggaggcuaagacaugagaaucacuugaacccaggagguggagguugcagugagccgagaucgcaccacugcacucuggccugggugacagagcgagacugugucucaaagcaaaaaacaaaacaagacgaaaaacagaaucugaauguuauccugaaggcaauggcauguguugaauugcuuuaaauagaagcaaguuaugaucagcaguguguuauauccuggguaggguaaaagauaggccuagcuggaugcaguggugcauaccuguagucccagcaacucaguagguugagaugggaggaucgcuugaggccggcaauucugggcuacaguacaguaugcugaucgaguguccacacuaaguucagcaucaauauggugaccccucaggagcagggaaccaccagguugccuaaggaggggugaacgggcccagguugaaaauggagcaggucaaaacuuccgugcugaugaguaaugagaucacacuugugaacagccacugcacgccaaccagggcaacauagugagacaccaucucuuagaaaaaagaaaaaaaagaauaaauguaagugggagggaaaaguggaggcagggaagucaguauaagacuacucuaggccaggagugguggcucaugccuauaaucccagcacuuugggaggccgaggcagguggaucacgaggucaggaguucaagaccagccugaacaacauagugagaccccguuucuacuaaaaaacacaaaauuuugccaggcaugguggugcgcaccuauaaucccagcuacucaggaggcuaaggcaggagaauugcuugaaccugggagguggagguugcagugagcagagauuaugccauugcacugcagacugggcgaccaagugagacuccaucucaaaaaaaaaaaaaaaguauuacucuagugaugagguaaguagugaggggggucuaaguuaagauacuaucaaaguggacauaaaggggaggaauuaaauuugagagaaacaauuaaauuugaaagauauuuggaauguugugguaaucacuugaauggaagagauagguggaaauaagagacagaguagagucaaggauaaguuucggcuuaaauaccuagguauuaaggguacauaggacugaugucagccuuugguuaucuuggacaugaaggauuacaauagcugagucaucaaaggcugauucagucccugacaugacuccuagcuguucaucuuugaaaccaguaaugaaauggcuuuuggccccuuaaaacugagaccuuuggaagagugcugaauagguaugaaucagguuucauaggcaggagcuccugggguuucaacaucagcguucuggaggaugcaugcuugauuuuauugcuuuugauacuguuuuucacucaugcuuuuuaaugacucuguaaucauguguauguuuuauguuucaccuugagaauggcuguuauacuuagcacuuuauaucuucaaagaauucagcaauauuaaauaaucugcauaauaucucugugaguuuauagguggggauuauugcuccguuuuucaggugggaaaacccagagauauucggugacuuggccaaggcuauuuagccuuacauugacaacugaauauugaaucugcaguuucuuucuuuuuuuuuuuuuuuuugagacggagucucgcucugucaccugggcuggagugcaauggcgcuaucucagcucacugcaagcuccgccucccggguucacgccauucuccugccucagccucccgaguagcugggacuacaggcgcccaccaucaugccugucgaauuuuuuuguauuuuuaguagagacgggguuucauuguguuagccaggauggucucgaucuccugaccucaugauccgcccgccucagccucccaaagugcugggauuacaggcuugagccaccgcgcccggcaaaucugcaguuucuucauuuuaucacacuuacacuagaaguuuaauguccaucuuauuaugucacguuugcuuuuucacuuacuuauucaaaaaucucagcauuuagaucuagaaaaggacauacaagauacagaaaagaguggaggugaccaaaugacuaacccggcacauggggacaggaggaguguaaugucacuaguucuaaacuaaaagauuguuucuuuuccaguggugcuaugacaucauuuccgcuaacagaccagucagucauuguguuacauagcauccugugacauuguaguauaaccuuaacacuuuauacugccacaauaaaacaguuauagaaauugccuuauuauguauauauauaucccagcuacuugggauauauauauauauauaauauauauauauacacacacacacauauauauacacacguauauauauauacacacacacguauauauauacacauguguauauauauacacacacguauauauauacacauauauauacacacguauauacacacacacauauauauacacacguauacguguguguauauauauauaaaaggcuguguaauacgguggaaagagaacugacuugggagcuaggccaggguugaaaccccucccaagagggagcugggugacacggggcaggauccugauucugcagcaguguggaaaggauuagaucuugauguaugucagccgccuaucauagaaccugacaguuacugcuucauaaaugguugcuguuacuuuuauucucauucagagacaaaguauaauacugaaaaggccagugacuuccuuguugaaagucaggaccagguaaauucaacuguugagguguuacagccuauuaaagacgccagugagacauuuugguauugagucaaccagauacugauaccaucccuuguucacugacaaauaugggaagguaauuucaguaggucagccaucagugugugccuuccaaaacauuauagucauguuacaguaaacuuuuuauauuuguugcaucacaaagauuuauugaagugauaaaaguuauuauggaaaacagugugcgguaacuaugguaacaguuauuugaucucacaguaauuagcuaagcauuuaguugcacaauacuuucacaaugccuuccugguuaguucauuaaacaaaauuagcuuuuguuugaacugccuuccuacagcguccuaaauuugauuuuaguucaaaggaauuggaaaauguauuuuaaaacuaccuuuccaacuuacaguuuauggacauauuugagguugcaacuggcuuuuauuuaauucuuuauuuauacuacacuaugauaacgauucacuggauuaucaucugaauuucucuuggaaaugaccuaagaaaugaacaguaaaguuggagaccagugccuuaauuauggcccuguuccucacucauauugcagauuggggucaacagguguccuucuuaagacuuuguuuuuauaccugugaguuuggggugcuguauaaauguuagagucccaggaucacacaaguggagucauuucuugaucaucugcauaccuccugcugggaccuggagcuagcaggugcccaggcuuuuucuaaagccucccuccuccaggugccuccucugcccugcucagcauagcuugugcuguguuuagcaccucuuuuugcaagguggaaugugcugcagaugauucaccuaaaugaugaugucauccucagaggacuucagagcucuugagacaagggccucucagacuguuucuacucugcacccacucuccacucacucccagcagacagggaagcuuaacccguacugcuuggcagauuggagaucccaagcacaaaagaaagcuucaagcauucaagauuuugaaacugaaaaauacagaaaaugaaacaaaaaaaaacuuuuuaacuuauuuacuaaacaugaagggguuccaaaguaaauuagugaaacaggauuuuuuaaaauccaaucaauguuccuuguauuaauuucauuuuaauuccugucaccucagugauuuuuuuuuaguucauuuaauuauuuuuaaaauaauacuagcuuuuaaaaaugaauugcuuucugaguugugagucaagcucuucucucaguuaacuccaugucaccuaccaguuuucaguuagacaaguuuuuuugcauaugguccauaacauuuccaguucuaugcauuuuuauuugccuauuuaggucauuauuuucuagguaggagagaugcaucuucaguuucacugacaaggaauagaauucuaguaaguaacuauuuguggccaggcacgguggcucaugcugguaaucccagcacuuugggaggccaaggcaggcagaugaccugaggucagcaguucgagaccagccuggccaacaugacgaaaccccaucucuacuaaaaauacaaaaauuagccaggcaugguggcgcacgccuguaaucccagcuacuugggaggcugaggcaggagaauugcuugaaccugggaggcggagguugcagugagccaagaucgcgccauugcacuccagccugggcuucagagggagacucagucucaaaaaaaaaaaaaaaaagaaccuauuuguucuugaguagucuugcaauuuuucaggacaaucugaagaugauaauaauaauaauaauaauaauaauaauaauaauaaauagaauaauauccuagguggcuucagcaccugacuucuuuuucccccaucuucccuaucccugcuuuuaucugguaugauagucaugugucagcugauaucaaggccccuaaaacucuucacaccccccuuccauauccuuuuccuguccauaggagaaugucuuucucucacuccauuuggaaaacauuugauguccuuugaugcaacucucauuucagcuucugugaaacuuucugaauuucccucacacuucaucccgucuucuagcccucucaugucauuuguaccuaauucuuagccacacaucauuauucauuauaauuugugguuaaaaacuaucuugccgagugggcuaugaacuccacuagagaagugccacucuuuauucuucccuguacccucccaugguauccagcagguaagaacgugcccuguggauagccaaccaaaccacugaguucucuuccucuuacugcccucuaacuuccugaauucuacucauuuguauuuccucguuggcugcccagcccagccacacuggauaaucacccucccaacucucccaauuuugauuccuuuucucuagaccuaauguuuuauguaggggccucuagccacuucagggaaagaggaaacgaaguacuauuuauugagucaccuaauguguuuucgaugccguaugagguguuuugcugauuuccacaauccuaugaauaaauacuaauauccagauuuuuuuuugucaugagaggcuaagguucagaaugauuaagugacauaaugagcuaguaauuguaagagcuggaauucaaacccagaacgcuccgccugcaaaacccaagugucuucacuuuuuccaguccaauaacucuguuaugucuuuagcccgaccuaaauuccagccuuagccaaugucuuagaguagucacuggcacccuauauuccuuugaucucauggccuucugugccaucagucagccagaggucugccccccgcacugggucuucuguccugcuguagugcucaagaugucugccaaagaaauucagagauucuuccagaaguggcuuuuuacaaagacaggauacucaauuacauuuagacaaagaaugcccaguccaccacucacauagcaccccagccccuguacugcccagggccagcauugacaaucaugaguacauucucaauauagccuuccaggaagcccuuagccaaucaaacagaauggaaaccauagauuaaaucuguuucccacucugauuugcuuccaacuugcuguugcuguguaguuuuccugcccuucuuuguuggucuuaccaugcauucuucccacccuaaaaccccucuuccuuacuccagacuaacuggaggacugauuguauuuuacuuugcuuacugauaccuuuugcuuugcuuuuucucacacuaauuuuucuacuuggccuaccuuccuccuaucacugauuguagaauaauuaauaauggaauagccucauuugaguauaaacuucauaaaggcagacgcauaugguuauuauaucugauuguauauacagucccucauagagugucugacuuaugguagaaccuccaugaaccuuugaauaaagaaggaaggagaaagggaaggaaugguggauuuggcacagguauuauacuauauacagauguauuuuuguuuguuucauccuaauaacccaaugaaguuaguguuauuccuguuacagacaagcaaauggaaucucauagaggucacucugcuaguaaguggaagagcuuccuguuuuucacugaccugccaaaugccaucucuucuggaaagccuuuuauuauucccccaccuugaccacugcauugcacaacugugggggacaccauucacauagaugacagugugaauggcucccccuggaguugugugguugguggccuugguaauaacuuguucacugguguucugauggcgcaugagaucuuucuuacagcaguguucauacucugccuuguauccuguacucaaguccuauuuccucuacuagguuaugaauuccuugaaggaaggaaaagugcuuucuucaucuuuguguccucugccaguaacacacaaagggauuguugaauggucagauauccuaucugcugguuuacugaguuugaggcucugugacauggguuuaucaaccauccuuuuccucaccuaggcuucccucccccugugcucacccugcaucauucuugcuagcuccugagaaagguaucuccuccucaagucaccucucugaagucaaggccaugauauucauuaggcacuagaggcacaaugacuaaauaauaugguacuuuucaggaccuaaacaauuuuagagaucucaaaagaaaauggcuuuaaaacacaaaaaggcacaggauugaauauaaguguuugcacaaagguaaaaccaaauaauuugucaucuucuucuucuucuuuuuuuuuuuuucgagaugaagucucgcuuugucgcccaggcuggagugcaguggcgcgaucucagcucacugcaagcuccgccucccagguucacgccauucuccugccucagccucccgaguagcugggacuacaggcacccgccaccacaccuggcuaauuuuugguauuuuguauuuuuuaguagcgacgggguuucacuguguuagccaggauggucucgaucuccugaccuugugauccaccugccucggccucccagagugcugggauuacaggcgugagccacugcgcccagccugucaucuucuuuaaauguuaaauuuagcagucauuacugagaaaucauagaaaacuguaaauuaaaugaauaaccagcuaccaaauaauuuuuuuaaaaagaugcaaaaauucuuucaaaaauguuuugggcagaaaguuauuuuuaauuggguauaaauacaacuuuuaauauguuagauaugguaucagugggagagccuccagaaaacgaacauacuugggauccuuaaaauaaacugucuggguccaaaaugcugugcacauagcccgugaaauauuugcuggauuuuaauugauuauaguuaaaugaugauggucuuuuuuguuguggaaggaaggaagcauggguauuuuacauuauuauuuuguuuuguuuucuuuuauuuauaaaaagaaaaaggaguuaagggaauuuucccagcuuagguggaaugagugccacauuccugcggagauauugagcaaucuuuggggcccuugaauggcaccaguaaggcccuucagagcacucuguccuggcccugcucuuagguuugcuugccacgcugucugguuccuucagaauguaggaaguuggggguggcacagaagccccaagggcaguaugcuagugcagaggaagcgaaggcaagccauugccaggugcugccagcagagcagagcgugugcuuucgugaggcaugagggaacugaccuuuccacuugcccuucacacucagggugacucaaagugcugaccuauuguuuuagguacugauuauacagcgaacauguugaugauaugguagagguguuuccucagcaaugaguguugaauguuuaaagucaaguagauuuuugguaugcuuuugcuuuggucaagagggucuucuuuuuucuuucuuuuugucuuuuggauauuguuuugguuuucauucuguaguauaaauugcagucccagaagcugaaauucacuuccaccuguucaaaaauugcuguagacuuuagugcuuuuacuaacuaugcauaauauugauaugcccuugcugcugaaauuuuauaucuaagauuaucuuccuauuaucuagccaggauucaacucaaaccgagaaccaggaugggauuggaauuaaggcacauucagcuggagguuagagccauagucaaaugugaaaauauaaagcauauuaaauauuuuguguuuguauaaucauuauauuagaucagcuauaaccaccacgaggggaaguuuuuuaaauaaguggauuuauguuaucugccaucuccaaaaguuuagaguugccaguuaaauacauauauauuuuucaaaggaaaucaucaaaaaggacauuccacucuuauuacaaagcuaugucggauaaauauuuugauagaugugguuccgugcaccugggagcugagacguggcugagccuggagcaguuagcacagauggagcacugagauauagcaaggguuggguuuuuucuuauauauauugcaaaugguugauugagauagcaugaacauuacauuuuccaugccacucagaaaaguagcuuccuuaugagaaaugaucuucuuauuuaagaaugauaaugauaaugaccauacuaagacuuuucucacaaguaaauguauaaugggguauguuacaauaugagcguuuuguuaaauaagaguacuaauuagaagcaauucaguagacugggguaaguaaggucaagucugcuuaacuuugugucggauauaauguaaguguuuggggcuaggauauuuacugguccuaaguggcaaaaugcgaaagauagaaaugcauuaagauagaaagguugcuacuuugauuuuucucuuuuuugaauccgaguugaaucauaacuuauaauuuauuaaaauaaucaagugugucaucuugauuauuaggaaauaagcauccauauuuaaaauguugacuguucauacuugccuaucuccuuaguggauggauugcuuguuaagugacauuauaaaaucauaacacuuuuucccccuuugagccuuaaguuugcccuuaagaagguggcauuauuuucauuccuuuguuauuagcagaggaaugacuuaguaaccccagcgcagucaucuauccucucuaucaaugaguaagaaauagugugaaccacguaacaaugugcauguuuuuuauuugucauuuuuuguuuuccuuuuggacuauaaauuccucgagggcagggaccaucuuuauguucucaucuagugguuaucaaccaaauguuggaggacucacugccaagaaagugaugauuuucuuuaacaccccaaaagcugucaguaaacaaauggaaaagaugauuuuuuaaagcugccuuuauuaacauaagcaagaacguggauaauaugagcuaguuagaagaguuacaacucccucuucccugccuuugcuggaaguugguucauuguaaacuuagucuuguguuuauaacuagagagaaacagacccaaauacauccucagagagagauuccauaaauucagcaacugaauuugauuuuccagaguguuucuaaacuaaugaaauguccuuucuaaaacauuuaccuaaaauguucuaugguugcaacaucugcuaagccuauuacauucuuuuauuaaacaguuuuacuguccucugugcaaacugcuuauuugaagcaauaaagcugaguugacucuggacuuucuaacaaacaggauuguuuuuuaacagugagaaaaacuacauauucacuaucaucauacuuaguuuugaaaccaucuguucagaaaugauccuauuaauuuaaaaaagaaaguauuugaaguccagcugauuauaauaaaagugauacugauucuagcaaugcuuuugaccucucauacaccuuuaguucuuuuguuugggucccagacaggagaaagccuuuaaaugucuauagauucuuuaagacauaggagucaauaacgauucacugacuaauggaggaaauauuuuuaucacauaagauucaaaguuugguaagggaaaucucauuauaaacugguguaguuaaucuguaacuauauuuggauugaauaaacauguuaguaauuucucaaaugcauacuugccucccugccugcugcccuacaaaccuacagucuuccugaaugguagcacagcugcacagaccacagagguuuucaggaagaaaacucugccugccuauccagaaugggucggugaaugcagaugucaccuuuucuuuuuugucuacaacuuuugugacaguuauaagccgauuaagauagcuuuaaagcguucagacuuugccacugacugucuuucuuccuuaaaacacaugagaaaguuauagcuagcucuuuucccaacugugcagaacacugcaaacaacagcauggguuauucaucuugaagcccauuaaaaggauguuggcccaauuuguaauuuuugugguagugcuuuaauauuggagacauucuaguuuuggagacaaaaucaauuugagauggaucugucaguuuacuuugucaacugaggcaaagauaaaaguucagucacuaaaugacuaaaauuucaacacauuauacagcaagguugccagaggagaucacuggguguaucgagagggugauuuuuuuuuucuagagagggucuugcucuguugcccagguuggagugcaguggcacaaucucggcucacugcagccuccaccucccggguucaaccgauucucuugccucagccuccugaguagcuguaauuacaggagugcgccaucacacccagcugauuuuuguauuuuuaguagagcagguauuuugccauguuggccaagcuggucucgaacuccuggccucaagcaaucuuacccgccucagccucccaaagugcugggauuacagacaugagccaccgugcacggccguaacuuuuuuuuuuuuuuuaaggagauggggucuugcuauguugcccaggcuguugucaaacuccuggccucaagcaauccucccacuucugccucccaaagugcuggaucacaggcaugagcaaccacaacuggcuaagugggugauuuaagaaucuuagaaggcuccaauauacuuccuaaucucccuccaugcucugucuagcucguagcuugcaaacucuaacuccugcaggggccagggagggaaggaaauggauaaaacuggucccauugaaauuggugagcuagagagcaaauacccuguguaguguugcaucuuccaguuuuucuagagaaaucggauguuuggauuuuuuaaugucaucccuuaauuuuuuuuuuuucuuugagagggagucucacucuguaacccaggcuggagugcaguggcaugaucuuggcucauugcaaccucccccacccagguuuaagcgauucuccugccucaaccucccaaguagcugggauuacaggcgcaugccacuacacccagcaaauuuuuguauuuuuaguagagccgggguuucaccauguuggccaggcucgucucgaacuccugaccucaagugaucugcccaccuuggccucccaaaaugcugagauuauaggugugagccacugcacccggcaagaucccuuaauuuuuaaauauuagcuauugauugaaauuugaaaugcaacguuuagcuaaacaaaaccuauuugcaggcuacauaugguugaugcaucgcauauuuaccucugcuccacuuacuccuucgauuuaagaguuagaacuuguccuuuuggcuuggggcuuuugucuuuuaauuuucaaacggcuguaaccuggagaaaggcuguacuucagacugugucaaugaagaguugguaauuuccacugaguucaauucaggacaguuacuccccguugucuguguauaauauacugugcuugggcaccaguaauaaugcuacacagcuuaucccuucaaaguaucuguugacugugcaagagcaguguucccugacaccagugaccuguguuauacacaaugccauguguaacacaguguacagcccuacugggcaguucuggacuccacuugaaaauauuuuuaccgaaauuauggauggaaacuaugagaaucguucugaugagggcaucuaugcuaauuguaggaagguagucuagcauaauuguugaaagagcaagucauaaagccaaacugccuggauuagaaucuuaauugugcuucuugacagcugugugaccuuggguauauuauguaaccucucugugguuucauuuuucacaucaguaaguggaaagaguaauaauaucuacaucauagaguuaugacaaugauuaaauaugacaaccuucuauauaaagcucuuagcacaaggucugauauauaguaaaugcaaaguaauuauuagccacuucugcugcuauuguuuuuaauuaagaaaacacugaacuuagaaucaggagaucuggggcuaggcaugguggcucaugccuguaaucccagcacuuugggaggcuuaagugggugaucacuugaguccaggaguucaaaaccaccauggucaacaugacgaaaccccgcauauacaaaaauuagcugcucauggugaccugcaccugcagucccagcuacuugggaggcugaggugggaaguggagguuucagugagccaagaucaugccacugcacaccagucugggcaagugagaccuugugucaaaaaaauuaaaaaagaaucaagagaucuugguuugggcacccauuuugccucuuagugucucuaaccaacuggaaacugcuuaauuaaccucugugaauaucaauaagaucaggauaacaugaagaugaaaugcaauuauguaucaagacacauaaagcaaugcacaaaugaaagguauuguuugguagcggggagggcuguccagcuggggagggggcagugcccucaugacacagcacagucaacauguagacccuagaggaacccagggcccauuuugccucuuuguuucaacucaggcauuugauccacagcaagcauuggacuauuacuggcuuuagaaugacucaaguaggccgggcgcaguggcucacgccuguaaucccagcauuuugggaggccaaggugggcagaucacaaggucaggagauggagaccauccuggcuaacauggugaaaccccgucucuacuaaaaauacaaaaaaauuagcugggcgugguggcgggcgccuguagucucagcuacuugggaggcuuaggcaggagaauggcgugaaccugggaagcagagcuugcagugagcugagaucacaccacugcacuccagccugggcaacagagcgagacuccggaaaaagaaaaaaaaaaaaagaaugacucaaguaaacauuuagagaguaaaaaaaaaaaagaaaaaaaauuuuaaguucugccacuuuguuaaaaaaaauaccccugaaagacagaguaugucuucgacucucacaaguccuuuauuagacuugcuuuggaagaguuccaaacuguggcugagaggauggcauacugaggcacagcuaaggcugccauccacuucagagaaggagggauucuagcggagucacauggggguuugagacugaccaacccauuggucuuuguuucagaaaugaggaaacagaaccagagagguucuauccuuaucgaggauuguucaacugcugaccuuuccccuacccuaagauacuuagacucagcuguauucaggauuuucaguucuuucucugauuucucacauuuucaaagauaugccauucagauuuguuuagguauuuuuaaaucacuuggaagaaaaugacauaguggaucugagagcacuuacagcauuucugcaccauguucaguacuugaaucugaaucuaaagagagggcuuuauuggaucacuauucugggauaauauugaaauaacaacuaauaacaauaacaacaauuuuuguuuugugaaaaaauaauacaaccaaaugaaaauagauuaaucaaaacagugaaaacccuguccccuuuucugagcuuaugaaaagagaaccuaauuaguaggcauucuuuuuauagcuaaugugcuaauugccucagagauaacaccuguguaauuuauuuuuaaaaaucuuacgaaaaucuacauuuuagugagauucuaggaaagaauagcaacagcugggcccacaucuguuugaaugaugcggcaugaaaaggauucuaaauauagucugaauuagaggcaaauguacuuucaugcuguaguacaaaguaucaguugaacuagaucugaaggagcuuaucauuaaaauaaccuaaaacuaaaauggcacaguuugcuuuggaaagcaacaaauauuuaccuuaagcagucuuuguuagcaaacuugaaauauaacugguccauucccacuugccagauggagagaaagauuauaccagagcuuaggagaauaaaaauaagucacaucgacacaagaaagugacuuuuuacaagaaguuuucaucacauucaguggcuuggggugccuuguuucuauuuuucuuaguucuugaauuuuauagagccugaguuagcagcucucaacagcucugccuuccucccuccuccccucccucccuuccuucuuuuaacaaauacuuacaugcccauucugugcuggguauuuuuuguauauacccagauaagaauaggguagccauaguuucugcucuaauaggguuuugaagacugacauaacagauguuuuacuuuaaacauguacauuuagguaacacuguaccuauaaagcucuuagugucuggcacauaguaaguaucaauaaauaacagcaacaugugaagacaguacaagaaucugugaaaccuguaauagcagacccaauauaauagcuagcauuuauugagcaccuacaguaugcuaagaauucuucauacacacgcacacacacacacacacacacacaaagcuauacacacaguuguauuuaaucguuacagcauuccaaggguacaucauauuaccccaguuuacagaugagguaacugaagcuuggugagguugaguuguccaaggucacauguaugucucagugacugugccaggauuugaauucagguuugaccugaccaaaacuugagcccuuggccauuaggauguaccuuggaaucccauuuuuacagccuccauugccacacacuacccccgagaacaguccacuagcagcacuuguuucccuacccuccagugccugggagaguuaauuugcacaccacugucaauaccuuaccuucagggccccuucucaggaucacaagacuaccagaaaaucaauaggaauuaaucaucagugaaagccaaagguuuuuacuucaauauguauuuuccuuuguguugauaugucuuuacagagauaacaccaccaccaaaaaauuauccaaugguccaucucuuccagauuugcccaauauucagagacuccaaacaauaccuuuuauuuauuuuuuuuuuuuuuugagauggagucucgcccugucacccaggcuggagugcaauggugcagucucggcucacugcaaccuccgccuccuggguucaagugaugcuccugccucagccucccaaguagcugggauuacaggcgcccaccaccaugacggcuaauuuuuuguauuuuuaguagagaugggguguugccauguuggccaggcuggucucaaacuccugaccucaagugaugcuccugccucggccucccaaagugcugggauuacaggcaugagccacugcgcccggcccaaauaacaucuuuuaugugccaucauacacauacauauauuuaaauuaagcauuauauuuuacaagccacuuucauguccaugaacuugcuuaagcuucccuaagccuuguuuauagcaucucuucuccauuuuguagaugaagaaacugaagccuagagcaaaaaaaaaaaaaaaaaaauugcccaaagccaauaguuaauuuccagcaaaccugggacuucaacucagcucugguuccuuugcauccuaagaaaaucauauguguguggugauuguaauccccuggauugggggcuguguuugauuguuuaucucugaacuucaguagacgccaauugggaggugaacucccgaucucacuguaacgugccuccucuguagggugguuuuaccacacauguaagaagccuucacauuaauaaaauacagaauuuggccaggugugguggcucacaccuguaaucccagcacuuugggaggcugagggggacagaucacuugaggucuggaguuugaggccagccuggccaacauggugaaaucccaucucuacugaaacuacaaaaauuggccgggugugguggcgggcaccuguagucccagcuacucgggaggcugaggcaggaggaucacuugaaccuguuagguagagguugcagugagcugagauugcccaccugcacuucagccugggugacagagugaaacucugucucaaaaaauauaaaauaauaaaaucaaauacagaauuugccuccagcuaucuggaguugcuacaagcccagugccauuguuucaugccugcugcuacuguuccuuuccacagaugccuauccuugggacauacacugcuugauugcucuccuggcuagagauaaccagaagcuaaaccuuguuaaaauaaaugaccuaaguaagacaacuuucuccuccaggaccuugcccuuuaguuaucucuucuuucuguaucauccauaucauuagucucugcuggcuuuccacucaggcuacaaacccacucaacccuuuaaaaugaaacagacagaggagagagagauugucccgugucuagcuaaugccccuucucuccuuucccugucuuaaaagaguguucugacuacccagggaccacuuguuuacuuccauuuacuccuuaacauuggcagcccgaucucuuccaccauuccagugaauccucucugcagaauaucuccagugaccugcacauugccaguuuuccaauccauaucuuccuaagucucugugccauuuaaaauuuuugacuacucgacgcucccagauacucauuacucccuugugcgggauccuucucaacuaacuccuguaucuacaccuaaauauaacuuuuuaggauuaucucuguuuuucuuguggagacagggucucgguauguugcccgggcucuucacgaacuucuggccucaagcgauccuccugccucagccucccaaagcacugggauuguaggcgugagccaccauacuggccgauguuuuaggauucucauucugggcaauugcgcuucuuucuacugacuuuucuuuugucauuucauuuauuaucacggcugcagcucccacacucaccuuuaugcuacugcgugagcucccucaccauaauccuguccuuacugcuucucugacugcugggacguaacaggaggcccucagccucaagauaauuuuuuucuucugauaucagcucuuccuccugcauucccucccucagguagugcaucauacacugaaauagaaaaccuagucauaauuagacuaacccccuuccuucauucccagcaaucacauuucaauuauuuugccucugagcuauuucuguugauugauugauugccuauaucuccucaaauuccuuuuaccagggauauuucucaaaucuggccucucucuauguccugguccuuuuuccuggcaaaucucuguacuuaacacuguucuguguaucugaaacucuucucucacuuugguuguuguuacuguugacauuuauucauucuuauagacuuauuucaggccucauugccccuuuaguucuaugcaugugucuuucuuaacacucgagauacuguguaccuguguuccccacuaggcuaggaguuuuuuuuaggacaagucuuuuccccagucuuuauuuuuuaaauuuauuuauuuuuauuuuuugagacaggguuugcagucucgcccuagcuggagugcaguggcucgaucuuggcucacugcagccucaaccucccaggcucaaaccauccucccaccucagcugcccagguagccaggaucacaggcaugcauuaccaccaugcccagcuaauuuuuugacuuuuuauagagauggucaguguugaccaggcuggucucaaacuccugagcucaagcaauccugccuuaaccucccaaagugcugggauuuacaggcaugugccaccacacuuggccuuuucccccagucuuuaauucaucuuuguacuuccaaggccuacagcaguaccuaaaacuuaccacauccucaauaaauauuuguugaacuggaucauacuuacuuccuagaguaaucagaacacaugaaaagcauuggaaacgggaacuuuggaggaaaaauauaggcaguuauccaaaguaucacucaugcagcuguugcaggacaacuggauguuaacauguagacucucuucugccucccaucuuugcguuugaacauguauugcuaagugccccucucucagccaaucugucucugucucugcucucagucugcccaaguccugcuuauucucuuggacucagcuguuggcccaccucagaauggguuagaggccuuucauccaugcugcugugucuagcaggguacuuaucagagggcauucuuguuaucaaaggguuuccuguuuccuugucugucuuccccaguuaacugugagcucauuuagaacagagaccaagucgugcuccuuuuacauuuucagugucugacauggcucugcuuauuaaauguuugaugaauaaugaaggaauauacuuuaaaaguagcagauguuugugggugugcuguuacugaaacccccaccuaccucgaauuuaaagcuuagguuuucuuucuugaguaggaccuuaaaagccauguauuuuaguuuaggugcauucaaauucuggugucuccaguuagcaguuguuaaucacacuagcugaucaacuacuggucuuaaaucaaagcauuuauuaucaaagccuuuuuguuuaugaguacaaacacaccauugauguuuauaagaauaauuauuuucuccccugaauguuaacuagccacaaaagcugguguacacaugugauaguguuuuucacggaguuuaaagaauguuggucuuugauguucugcccuugaauggaaaugagucuguauuacaaaaucacuagugaggaaaauggggaacuucuagacaagcaccugagaagcauuauuagaauuccugagcauuaaaauccaacagaugcauuuuucaugacguuaaaaaaaacuccacuuucugguaguagcccaugucuuaugcuacgaaaaugaaugagauuaaguagaauauguuaaaaucauauuaaguagaaaugucuuagucaaaacgugacugaaaggaaaagacacuaauacaagguagcgguagcaaaaaaaaauuaauaaauagaaaaaauuuuaaauaagcuguaaggaaaaaggggugucucaugggaaaagggacuaggaacaagaaucuaaaaggaggcccuuuuggucuuucucagaccauaaaaucucucaucucuacuucuuugcaugacuugcauuuuuuuuuucuuucucucagccuggcuugcucaguuugccugaccaccuggcagaagguagcuaccucauagcauucuagguuauguauccucuuucaguucaacuaaagagcccagacagaauuagaaucucucaguuacaauuccagucucacagaaaaguugguugaggcaacauagguaggucacaaguccagugugguccaggcaacugugaucaaggagacagagccacaugacacaaauaugguugccauggcacaugucugaaugcaaagagacaguucucagacaggaugggcuaucaugaguuagacagacaacuccuaccaccaccaaaaacccaaggaagcauaaaguaaaaaggauaauguaguagcacuaucucaguauaaauuauuuauagauuuauugucuuuuuccuccaccaaauuauguguaccaugaggucaggcaccauaauuauguuuaauucucuaguaccuagcagugcccgacaauaggcauucaguaaauauucaguaaauauuggaugaacagaaacuaagguaagcucugccuucaugggaauuauagucuggucaugaaagcaggcagaaaacaagcaaauaaaaagauguaauugugguaaauauuaagaaaguuaaaagggggagagggguaaaggaaggguuaccaaacuacagcagaaacuuucagagguaggugaugguguuaaaacccaaaguagcuguacuaacuuugcuuauucauccgaagagacuggaggugguaaucauaaaagauuccguuuacauuuuguuccauucaucauuuuaacacauaaaaaacuaguuuacauuagagcauggguugcuaaaagguugcuguaaagaacuauauaaaauuuuaauaaauuuaauuaauguuugcugauaucuuuucauuuuuaucuuccauuuuuaaauugguaaacucuuagccuggagcucgauguaauuauauaacaguucuaugagcuggucaaugauuaaucaagugcacaauaggagauauacauuggccaacucugcaagcagauuuggauuaagauuacaaaucacacaaugggaaagacauguucuccaaaggagaaucaggcaggaucagaugauacaccgggauguguuuucagugugauggaaagauuguuuccagugaucuuagugaugguaaagauagaggagaagacaccuaagaaauguguuuuucuggaguuauauuaguauuuuuguugccaguaucuaauaguguuuccagaacuauucuggaagcaagccagaucucguaaacaauaauuaacagagcuuuuuaccuagcuuuauucauuagaguaacuaacaggaguuucuauauaaacaacuccaaaacccuaguggcuuauuaaacuguagauuuuuuuccuauauaaaguucagugcagauaaaggggguguuuguuccauaaauuuauucagggacccaggcucuuuccaucuugugguucuguccucccgcacucaauucauucaagcugguccauggggaaagaaugagauugggccaggacuacaccaggaagugcacaucacuuccacucucauuucauuagccaggauugagucacaaguaccacaccuaccuacaaggagggcuggacaaagguauaguuggggacucaggaagaagagaguauuagugacuguucucagugucugccacacuagcaauauguagauucaagaagcuaugggaggaaaaaaaaaaaaggagaagaagaagaaaaaagaagaagaagcugugggaggccagggggagcaguggcucacaccuguaaucccagcacuuugggaagccaagguggguggaucacuugaggucaggaguucaagaccagccuggccaacauggugaaaccccaucucuacuaaaaacacaaaauuaguugggugugguagcacaugcuuguaaucccagccacuugggaggcuaaggcaggagagucacuugaaccuaggaggcggagauugcagugagcugagaucacgccauugcacuccagccugggcaacagagcaagacuccaucucaaaaaaaaaaagaaccuaugggaaacaugaaaaagaaaauauuguagaaaagcccuuuguaucuucaaaagaauuuuguugccaaaauuugagaucauuucagauaaguuaucucuccaaaagcuucuuaccaccuguagugcuguuggcuucuacaaaccacaugugauucccugguucugucagugcuggaaaauucagaagaaaaauaagagcaaaucgauucugaaaaguaguuauuuaaucagaauggggguagugugugcuuucccuuccaaagcacaacuaugaguugcccaucaaagcuuauaaucaucuccucuaggaguguuccucaacaugaacgaguuucaaauguuggcaggucauacuuguugaagacccccuguagucuggagcaguauuucccaacuaagaauuuaggaaagagucuaauuccauaauuuuacuuaaaucugucccagggggccugguuuaggucugauaccauaugcucuuguccaugaugacaguagcugugccccagcucuguuucagggauucugcaaauuuaauuauacaacaauaauagcuuacacuguugagcacuuacuauauucuggguaccauucuaagaaugcuauuacuauuauacucauguccgggaaauaggaugcugccccaccuugcacucucagggaucuuguccauuaauccacacuggaaguuaccccugcccaggaaguuuaucaagggagauacaaacuuggcaguuuaagagggugguucuuauuguuauaaccaggacugacgaaaauuugaaggacauaauuguauuuuuagauaccucagauuuaguuuggcaaauggcuguuguggugcugaccagcuuuccccauauagagcuaauuauucuuuguuuauuuuuauuuacugacuccaguggguuaauuuugaaauuuauuugaacuucguucaauaaaugaucacugagcauccacucuguggaaagcuccaugcuaauuauuguagggaacacaaacaggaggaagguuuagucaucaagcauacugaugaguagagguaacaggauuacccuaaacauuaugagguugcugagacuuuugaagaccauccuguaggucuugaaccuuuagcugauggguuaaacacugaaugcugugagagaugauggcuuuggagucccaaguuagacaguuauaucuccuacuaucugaugugcuaauauucuucuuuauaacaguuuuauuaagauguaauauacauaccauacaacucaccuacuuaaagugugcaguagacuggguuuuguuuuuguauauucacagagcuaggcagccaucaccacaaucaauuuuagaacauuuucaaaaagaaauccuguauaauccuguaucuguuagcauuuacuuccuauuuucucccaaguuccccagcucuaggcaaccacuaaaucuacuuucuaucucuauuugcuguuugggacguuucauauaaacaugcauauguggucuuuugugacuggauucuuucacuuggcauaauguuuucaagguuuauccauguuguagcauguaucacuauuucauuccuuucuagugcugaguaacauuucauuauaugcauauaccacauuuuauauaucauucuucaguugauggucaucuggguucuuucugucuuuuggcuauuauggauagugcugcugugaacauuuguguacaguggacauuuguuuuuauuuccauuucucgugguauuuaucucacaguguaauugcugggucauauggugacucuauguuuauccuuuuuaggaacugccagacuuuuccaaaaggacugcgccauuuuacauucccaccagcauuguaugaggguuccaauugcuccgcguccucaccagcacauguuauugucucuuuuuuauuguagacauccuagugggcaugaagugguauuucauuauuuugauuugcauuucccugauggauuaauauuguaauauuuauuuuaccaaucuagggcuaaacuugcgaucguauacuuucuuaugcacguaauagaaacugucucauauuacuggauugacuuucuaaaacaaaaccauaguucuuuacaagaugaaugucauuuaugggguuagaauuauacgugaaaaaacauaaaguaaaaugacauggaguuaagauuacacacucaucugggaaauuuguuuugcgcuaugaauucauucacaguguuccgaggccuuuaucugagcuacucaaguacuacuaugugacauuuacuggauaauccagacagcacuuugguuaaauccacagugugaugucacccaguaaacacuugaaaauggagaugugugucucuucugguuuuaucagucaagauuaguggugguucacagcacagugaacuuuuucuccucugugauccaucagucugugucucauugugggccaauaaucugucaccugaaacuacuuaaaauagguuggacuuucuugaaugucguguugcugugaugacauaggguuuuggcugcagaaaggaaagaaccuuuuuauaacuuuuguuugccucuguaucccuuguuuccaguaaaagcacugugauuuuuagccccuugcuuauauauguagacuauuuucuaaaccaguuuuucauccaucucuuuaccuucuggggccccuaaucuggugaccuuuguguuucugucaaagaaagaaaaugacacagggcuuggaaggugacagaguuucaccaucuugguuugaccaacuagcagacagguaaaaacagcauccaaaagggccauuugauaauaaaauuaaaaaauuaaaaguugaagagaauucagaggaugcuuucuucagagaagugcuuaggauuucucagaaaucuccccagaaaagaggccuuaacaguagagugaucauccuuucugacccccugagagaauaacacacaggucggaauucucuucauugggcugcacaccccugucucugcuuaguacagcuuugggaaguucugagagggacaaaggggguaaagaacugagaguggaucauuaacccuucauaauacaucaucccauguucugccucauugguuccuuaauuuuuagugugugauuguguggcucgguuggggaauaguuggaaggaauaguuggagcuugaauuuugucuccuccaaaguaaaaggaagcaacagcuuuauacauuuauagagcuggauuucuuucuuuguuuuuuaagcucuaaugaauucuguuuugagcauucuauugacuaaaauauuauuuuggaugaaacugaagcauaucaugacccaauaauaaccguugccccuacugaagaucuuaaacuacugcauaauccugaaccaugugccuucacaacuauuaaacaagaaauaacuaauauuuauuaaaguaugaguaggaauuacagcuuacagcuuagauucugaucuuugcacugauuagcucuugauuaauuaaaaaaaauagcuagcacuuauuaaacauuuacuacacgcuaggcauuauaauagccuugcauagauuaucucauuuaauacuuuccauggcccuaugaacuagguacuguuauuuucuucuuuuuacaaacugagguaaauuuaguguugucaugugcaguuugcacccuuaacucccaacacucacuucugcuggguacaugacauauugaaugaauacuauguuuguaagagagagagaauaugcaugaaugaaugagagagagcauacccaaacagggaagcaaacugauggauuuggcuguagucaaauuguuguugccauggucauuuuuuuuuuuuuuuuuuuugaaacggagucuugcucugucacccaggcuggagugcaguggugcaaucucagcucacugcgaccuccaacucccagguucaagugauucuccugccucagccucccuaguagcugggauuacaggcaugcaccaccaugccaggcuaauuuuuuuguauuuuuaauagagaugggguuucacacguuggccaggcuggucucaaacuccugaccucaagugauccacccaccuuggccucccaaagugcugggauuacagaugugagucaccgcacccggccugcugugguaauuuuuaagaaagcuuuuaacauuuccuuuuccuccuucguauuguugcuuacaaacauaagacaauaacugcugaggagaagcaaacucaaggcugggcauuccugcaggaaaauggccaagguguacuuucguggaauaaaaaugaaucagagaauuugcuaauuuuuuucucuuaagaaauuagaauaaaaaacaacagugcuuauacugauuuuucuuuaagaaaucgaauaccucugauuacuuauuuugcauagaaaauauagaguauacuuagaaauucaggaaguauuuucuuucucauugcaaacauuaaguuauucuuagucacuuauucaauuaaauuguuacaaucacuucacugggccauuuuacugugagauauccuaaaaucaaugaauucguaacaucucugucauaaucacacacccauuuuuaacaaccuguauuucauauuuucaugcuuuuuagucaagguaaaugucugaauauaauguaacuaaagcuacauuccuauaaaaaugccuggccaaaagguagcucuucaagccagcagucaucuccaggauaauacauugaaucuguagagcuuauuuuacccaguuuuuccccuccccugcaaaggcaauucuuuaaucugcucuacaaagucucuaccuacuaagaagucaucuuugguugagggaccuccugggacaggcagcucauuccauuuucaaauaguucuaaaugggggaaaugguuuccuuuguucagccaaauguugucuucuuuaaggccugcuucuccacauuagcucuuccuucuggaaugagacacaguaaaaacuagggugaaaucucuuaauuaacaaacacuuaggcuguaaucccaguacuuuggaaggaccagacagaaagaucaguuaaagccagcaguucgagaccagccuaggcaacaaagugagaccuugucucuagaaaaaaaaaaaaaaaauuaaagccaggcauaauagcgugcgccuguagucauagcuaguugggaggcugagguagaaggaucacuugagcccaggaguuugaggcuacagugagcuaugauugugccacugcacuccagcccaucaacagagugagacucugucucaaaaaaaaaauuauugauuacuuuuacaauaugcaaagcaauuaugaaauguaucagaaaaugaauacauacacuucauaauauuaauguggacaaauaaacacggauguugaagucacaugauagcaaaaauaaugcugacugggccaggcacaguggugcaaugccuguaaucccagcacauugggaggcuuaggcagguggaccaccugagaucagaaguucaagaccagccuggccaacauggugaaaccccgucucuacuaaaaauaaaaaauuugccugguguggugguacacaccuguagucccagcuacuagggaggcugaggccagaggaucgcuugaaccuagaaggcagagguugcagugagcugagauugugccacugcacuccagccugggugacagugaaaguccaucucaaaaaauaaauaaauaaaauagugcugacuacaugccaggcacuguugcaaguacuuuguuuaaguuaacucauugauccugaccacagcccuuugaggcauguacuacaaaaauccccauuuugcagauguggaaacugagacacaguuaagacacuugcccaaagucacccagccaguaaacgugagauccagcguuugcagucaagcagauugccuggucccuuagcucugcggacccagagccagaucuuccagugcugaugcugcgccucauuagcaggauaaugcgggaaauuuacuuaaaccaucuccacuuuuguuuccuuaucuguaaaaacaggcagaguuguuauaguaauuaaauggaauaccauugaacgugaccagugguucuuaacagggauugcauaucaaauucaucuguggguuuuuuuuuguuuuuuuuuuuuuuuccccaguuuaggucuuaccaggaacuucugauucauuuaaauacuaugugguuuguugucaccaguuugagacucaugucaacauugguucagaauaagcagggugaugggugacuuuuuaaauuaauccucuuaauaacugcaaaacucaggacaguguuaguauugaugggauuaaguuuggggugauauuaaaaucugauuucaaagucccauaguaguuguuccuccgauccuuaaaaugaacuuccuugcccccauuuauugcugaaacauuuuucugcaugcauacccaagguagcacauuucaggaauaguugaugcuaguaaaaaauaauguucuguuauuuucuucuguauuugauaacuccuuuacugugacccagugaaccauucugaaaguaaaccuuugaaguauuuuuauagcaucaccuacacauaauuuguauuuuuaaaucuguauauagugaaaugcaugagguuaucaauagucuaguugauacaggauucucaucaccaaguauauuggcugaaucaagaggagauucuuugucagugugcuccguuuuuaaaaagaaaggagcacucuauucguuucuuuucacacugcuauaaagaaugaacugagacuggguaauuuauacagaaaagaggcuggggaggccucaggaaacuuaaaaucauagcagaagguaaagagcaagcaaggaaugucuuacauggcaacaggagagagagcgagcaagaggcgagaacugccacacacuuuuaaaccaucagaucucaagagaacucacucacuaugauaggaacagcaugggggaaacagcccccaugacccaguuaccucccaccaggucccucccucaacauguggggacuacaauuugagaugagauuuggguggggacacaaagccaaaccauauuaagcaccccuaaggaaaauguaacaaccccuuuaaugcauuuauuuauugggagguuggcaauucauuucacugagaauaaccaaagaacuuuuggcuuauggaaagagaaugccauguaguuugaagacuauuauuaccuugaccucauaauuuuggcuuucuuuuuuuuuuuuuuuuuuuuuuuuuuugucuugagacagagucucacucugucacucaggcuggagugcaguggcagaaucucggcucgcugcagccuccaccucccugguugaagugauucucuugccucagccucccaaguaguugggacuacaggugcacgccaucaugcuuggcuaauuuuuguauuuuuaguagagacaggguuucaacauguuggccaggcuggucucaaacuucugaccucaggugauucaucugccuuggccucccaaaaugcugggauuacaggcaugagccacuacaccuggacaauuuucggcuuucuuguacuggaagugggucacuucaagggcugugccucuuuuuuuuuuuuuauuuugagacaagucuagcuuggucgcccaggcuagagugcaguagugccaucauggcucacugcagucuugaccucccaggcucaauugauucucacaccuccaccucaccuccaccuccugaguaccugggacuauaccuggcuaauuuuuuuguuuuaguagagacaggguuucaccauguugcccaggcuggucucgaacuccugaacucaagugauccucuugcuucagccucccaaagugcagggauuacagacaugagccaucacaccuggcccuggcuaugccauuuagaccucguucuaagccauaucaaaugugacaaggcaaauucagagauuaaaaaguuaugguaucucaguaaguuggcacuguuccauucaacagucauuuauugagcaucucuuauucgcuaugccaugggguacaaagaugcgaagaacaucgucccugcacugaaguuuacagucugugggcaguggaguaggaacagguggucucaauaaaguucagcaaguguauuaugguggaggagguacaaggugcuuugagaguagaaaggaagguggccugauguagccuggggagagaggaagaaagacaggaaggggcuggucugcaaaggcuuucuggggacaggaguacugagaugaauguuaaaagauggauuaaugcuagcagagugaagaauggauggaagaacauuccaccugggcucuguagcccgcugagcagucuugaaucauccuaccuaaccaguggucaucucaguuccaaauaguguccugucugacucacugacguuccauccuaucauuauuugacugcucaguuauuucugugucacaaucauuaacuauuuuugugaaguauggcuucaaagagaaaacaaaaaaaacuuugagccaugccuuuuugucccugaaaugaacaaucuaugugacccauuuagccugaccuccaucauaacuugagcaggauuggcuggggaaugugcuagaaccccagcagcacaggcuggugggaaagggggccugaggaaaaucaccugccuguacagucggcauccagaagggguugaaaaaccagcaaaagugggacagcaaacagcgucccaaguagucaucuaacccgagguuucccuggccaaagguaauagaaugcaguggcucaugguauccagcaucugucacauacuggcuuugugaccuuugcaaauucaccucucagugcuuggucuucucuaaaauaaguaauaauaaucguaccucacuacauggagguggcgguggggugguggugaggauuaagugaacuuauucaccgaaaguacuuggaagacuuucuuguuaguuguuaggagacagcgucccaguuccuucagaaggggacccaggcacggugucaggaccucugcaguuagugagcucccauucuccacaagacaugaguuuuccauacaagccauuuuuuuuuuuuuuuuuuuugagacagagucucccucugucaccuaggcuggagggcuggagugcaauggcacagucucggcucacuacaaccuccgcuuacuggguucaagcaauucuccugccgcagccucccgaguagcugggauuauaggcaccaaccaaccaugcccggcuaauuuuuguaguuuuaguagagacaggguuucgccguguuggccagacuggucucgaacuccugaccucaggugauccaccagccuuagccuuccaaaugcuggaauuacaggcaugagccaccgcaccugccccaauuuuuuuuuuuugagaccgagucucacucucuugcccaagcuggagugcaguggcacaaucucagcucacucaaauucugccucccaggaucaugugauugucaugccucagccucccagagcugggauuacaggugcgugguaccacacccagcuaauuuuuguauuuuuaguagaaaugggguuuugccauguuggccaggcuggucuugaacuccuggccucaagucaucugcccgccucggccucccaaaaugcugggauuacaggcaugagccaccacgccaggucccaauuucuuuuuuaacacauauuuauuggaugucuccuaugugcuaggcacuguuaaaagcauuggggauaaaucagaggaaucaguccuugcaaaggcccuggugugggaguuggccuggcacacauuccaggagugacaaggagguucccauggaaugagugagggaaaggaaaguaggagaugagaucagagagcuaacaagggguggaugacacagggcuucccaggccauugaaggacuuuggcuuuuacuuagagguuaauauggggugagaauugagagaagaaugauaacuacugcugauuauugagcuuauagaagauagcuggcacugugcuaagugcuugaccuguguuauacuucuuaaucagauagaacaagaagauuagaacaaugauauaaagcaaauggccugucccgagaaaggacccugagacagagggguuggggagcgugcaggggcaguauucaaacccagaucugagugauuucaugaugucauacugucauuuaaugaauauagacauguguuugccaucacauugcuguagcaagacuaaucuuagccuccacuugaccacucugcaagaccacugcucaggaacuggauaggaaguuggugccugugccuccaaacaacucugggaauccgggacaaagaaucugagcacacaucaugcaccacacacacauuuuccccagggcacggagcaggguaacgcaguguccaugcugcagcuccacacuccccgcaucuucuguuucgcaagcggagaguccucacucuugccauauuuaaagacucaguguuucugagugccuuuuaagggcaggguagaaucaaaggccaaaauaccaaagguucaguuuccuguuacugaccacaguagaccagaaaaugaggcagcuuucagaguagcugccucccucugugaaccugcaguucagcuuugacucaggagagccugugggaacugucagacuccuuagucugcaagauguuguucucaacugaauggacacacccuaagucaaguuguguauucgagaccaaacugcagugcagaacaugaagaacagacagaauucuuuggaauucugauucauuugcaggaccaaauaaggaccuacccaaugaucaucuuaacucaugcugcacgaauuugaaguuugugaugaguauugaaggaacuaaacuauaaaauaaaaggucagggguauccauuuuuuccaauaaguauauaaauuaacugcuuauuuugugcgaaguauaauacugggugccaagaacgucaaaauaaguggcuucugcacccccucucgcuguuuaggaaaaggagguaauuuauaaguacuuacagugcacuguaaguacuguuaacuauauauuccaauugcuguacagaaauucaacuccacauacucaacaaaaauggagaguaaaacagagaggaaauuuaaauaguacagguaauuuuguccaccagucccacacugugcagaagaugacagggaugaaugauucccucaguugcucucagcuucccuauugcucucaugguguaaaauuucauugcaucaagugugauuguaguguuuaaagauauacauuguuuguauaacgugucccuaagaugcaugucaccuacuucuugugcuggcuaaagaaacaauguucuuucuagugcuaaaagaaauccugguuguguuugaccuuucuaagaaauugucaaauuggcuuugucauacaugagauuuucaucuuaugcuuugacuucagaguuuauucucuacauaagauauuaauucacuguacugacauauauacaggauaaagucaaacguggcugugaauuucaguuuuugacugauuuagacuguggaaaaguuauuugacuucccuuagugcuuaaugauuagccucauucgacucuaaucuauaaaacuaagauacuuaaauucauuucauuugcauuguugugaugauuacaugaauaauauauauaaagauccuaccaagauauuuagcauaguaagugauaguugccaccucauuccuaguaggugaagauguguacuuuaccuaugggagccugugaagguuuuuagcagaggagugacgugauccauguagguuucaggagagaugacuucagugccccgugauguaugugcuaaaguguagagagacccggggcaaggaaacgagacagcaaguaguuacaaugguuuagacaaagaugagggccugccugaaggcaguggaggugcagaggaaggauccagguuugggagcuuuaaaaguagaauugaggcugggugcgguggcucacaccuguaauccuagcacuuugggaggcugaggcaggcagaucauuugaggucaagaguucaagaccaaccuggccaacauggugaaaccccaucucuacuaaaaauacaaaaauuagccaggcaugguagcaugggccuguaaucccagcugcuugggagacugaggcaucaagucucaucacugauucucaucaagcgaugagaaucgcuugaacccuggaggcagagguuacagugagcugagaucgugccaccucauuucagccugggcaacagagccagacucugaaaaaaaaaaaagagagagaaagaaaggaaagagagaaagaaagaaggaaagaaaggaaggaaggaaggaaggaagaaagaaagaaaaaggaaaggaaagagggagggagggaaggaaggaaggaaagaaagaaggaaggaaagaaagaacugauagaacuuggggacuauuugaaguaaaagggagugggaagaucuucagaagugaaggaugucuuuauguuuuccagcuucagagguuggauaaauggagauauuaaauuaacugguacagagaauaauaaaagguacuguuuuacuucagacugaaacuauauaccuggcauuaagcuaaggaauuuaauacauuauuugauuuagucaucaugauaacccuacggaguaaguaguaucauugccauuuuacuacugugaaaaccuaaacucagaggagcccagugucauauagcuagcuagucagugucucccuaggaucugaacauggauuuguaugacaccaaagccucacuuuacaccacagcaguaaauaagcccucacucuggaagaggagaaauggaguagggacaagaggcugaagagaagucuuaguucuggaagcguuaaacugucaggcagagauaucuugaaggcagcuggaaaaucagaccuguagcucaggggugcauguggggaaauaagaaaauguggguguugcuggcuuaugguguuggagagugaaugagguuacucaucaaggaguauaugguuaaagagaaacagacccucaguaaaugaaggcuagaagggggaugccaaccuaguuuagaaacucguauaccugcauacucaguuuaggaguuuagaaacgcucauauaccuauaugcaguguaauuuuuucugaccaaaguauagccuugugcuuugguguauaaauuuuuagucagcuggguauugagaguucccuguuagagcuugagccuugcccucacagagcuuauagucuaguggagaggcuuaguaaaaaauccauuaaacaauaacaaucaguuguaguacaggcuaaauguuauuuuagggugcuguuacaggaugcugcauaagauuggccccaaagccaggcuugagagucaauagccaggcaauuaggauuacaggucauaguauugaauaaguuuauacuuggccagacgcaguggcucaugccuguaauuuuagcacuuugggaggcugagaugggaggauugcuugagcccaagagcucaagaccagccugggcaauauagugagaccucccaucucuauaaaaaauuaaaaaauuagccaggugucauggcaugugccuguaaucccagcuucucgggaggcugaggcgagaggauggcuugagcccaggagguugaggcugcaguaagccaugauugccccacugcacucuaaccugggcaacagagacccugucucaaaacaaaacaaaaacauaaagcuuauauauauuaaaaaaaaaaaacugagcaacagcuguuuucaccacucauugucccaucuugggccuuacugcccaauuuaaauuucucuaucucucucucucuucuccccacuuccucccucccuuccccacacagugaagagauaugaugcagcuccacuguaacaguauuugagucaaauguauacacugaaauuucuuagauuuuuuuuccugaacacauaauugcucuaggagaccugcacaaaaugugaaaauagcacguuucuuuuccacugaccaucagaacagagaauucccaagccuucauauugcacagugaauaacccagucucaauuuauggacuuuaucuugauauccagucuucauuuugguagguuaucuaguguaaugguuaaaaguacagguccuggagcuggacugucuggauuugaauucuuguuccaccaauugcuaacugugugaccuugggcaaaauacuuaaccucucugugcuuguuuccacaucuguaagaugggaauauaaugauauuaccuacauccuuagcauuaugugaggaauaauaaguuaauacaugugaaaugccuagaacuguacauggcauauauagaguaagcaauuuauaaagguucaauguuagugcuacuacugaauuaugccaguggauaaaacaguguguuaaaaugggagcccagcccauuguaaaucacucacagaucagcucccuguucacuuaacauggaggaaagaguccagcauuuguuuccuuuuccucucuuuuaacauuguggguaccggucccugguagauuuaguggguagucaauuucaagccccauagcuagagacaaggaaauuuuuuuuucuuuaaaauagaagucuccuucuuuccaaucacaugugcaaugucuauguuuagaaaucuuccaggagcagucugggaagauagcugaaagcaugguguauggcgagaugccuaguauaugauaaagaagauaggcaggcggccagccagccaucguguugucuguuucauaauguguugucagaucagaaagggaaugugauucuuuucuccguggcugaacuuuuccaucaguccuguugagcugccaauuggaagacccuaguugauacaucuccugagcccauuugucuggaguggcagcaaagaacaaaucacagauuuuacaccuuguugugaagccacugaacaucacucucacugagcacuuccccuagcuugcccuagaguucucagaauaccucccuucuuccaagaggaagcuacaggguuguaggcuugauacuguuaauggaagaaauucaucaacuucuugaaccugccucuaaaaccccacaaaguagagguauaaagggguuuugacuaagcaagugucguuugcucccuggaggaugugucagcucuugcuucuuuucaauugcuuaagaguuaaaaacgauuacuguggucucagaggacagacaccagcacugugagcuggaucucacccacagauguguucggcuugacccacauaguuguauacgcauaugucaguuuguugcaacauacaaaaacugggggguuucacauaaaaaucugcauuuucaauuucuuuuuuuuaacugccaaaucugacaacacugugucuucccugcuuccccuguggaaacagucugccugacuggguaacaguggcucccugguacccacaguuuaccaggccccaccuggcccacuuccuccacuccuguuuguuuccuagucucggaggcaugggaguuuauauaaccuucucuuagaacguggugccauguucucuacaguauaaucccaaaugaaaagugaaaauucucauuacacuccuugaccuaguuuuaacaagaugcuaaauacugagucucaggccuuugcucuuugauuuaagauaaaaaauccuaaguauuuucucuggauguuuuggggggaaaaaauccuaaguaaaaccuuuucugugucauuuauuuaaaaaucacaauuggcaauuauccucgccuaauggucuucuugagucagagaagucuuuuuccuuugaccuuuuccaugguagcauuuuacgcuguucugguuacuaccagcaauacaggcuaaacaacaacccaaaguuugaccaucuggccucguccuuagucaccuauuuuugcugcugauagauuugagacuauagguuguaucuggggaagggagcauggagaucuagaggggaaauaaguuaccuguuuaacuuccacagaguugaaagcugagucauggggccacacgauacaaaggugauacacacaaaagcaucugcaaauugcuuuuauugggaagccauuuuccuccccuuuuucaagccacauggccaacccacucccugagauucugcaggccucccauuccggugaguguagcucaguuggugaaaucugccccagcucaaguucuuccccaccuuuuacuauuuccuuauucugaagauagaugaagaagugcauuuuccuuacccccugccagccaucugaggacaauuugagcuugauaacguggggccagcgugcagcuguccaugaaagaauuguguuaugaggccgggcacgguggcuuacgccuguaaucccagcacuuugggaggccgaggcggguggaucaccugaggucaagaguucaagaccagccugaccaacauggagaaacccugucucuacuaaaaauacaaaaaauuuaguugggcaugguggcgcaucccuguaauaccaccuacucaggaggcugaggcaggagagaaucgcuugaaccuagaggcagagguugcaaugagccgagaucacgccauucaacuccagccugggcuauaagggcaaaacucugucucaaaaaaaaaaaaaaaaaaaaaagaauuguguugugaaaccacagaguauacuuacugcauuguagaaguuuaaucaguguauaaaaauucauuaagcacuuuaggagcuuuggauaaaaagucauaugugaauauuagucauuuauuuuauugccaucauugagucacuuuaccauagaaguguuuuauuaagaucaggugcaguggcuuaugccuguaaucccagcacuucgggaggccaaugggggaggaucgcuugagcucgggaguuugagagcaagcuggacaacauagcgagaccccugucucuacuaaaaaucaaaauaauuagccaggcgugguggcacaugcuugcagucccagcuacuuaggaggcugaggcaggaggauugcuugagcuggggagaucaaggcuacagugagcuaugaucacgccagugcacuucagccugggugcagagugagacccagucucaaaaaaaaaaauguauuaauuguucaaauuuccaugacuccaguuucacaugaggccguggacuucucaaucaaaaaguuuuuaguagcuucaguaggucugaaauuucagaguauugagcaaggccuacacugagcuagagcaugaucuaauaagauuggacugucaaaacaagaagcaccagucuguggucaaaagguuuuuaagaaggaaauguuaaagcucugcugugagaaacucaagaucaugaaacauguaagcuggcaggcuguuucuuucucauuucuacuaugauggggggacccucauccuagguaaacagagacacugaagcaaaauuaggugugauuaaacagaaacaacagaugguaucuuucuauugggaaacuaaucguuuguguaacuggcaggaugaaacaucagaaaauacuugacacauuuugcuagaguccuaaagggcaccuaggaagacugacuccaaaaugucaaaauaaggaaaauacauaacucagacuagagucagacagaagggaguuccauucccagcccaccaccugucagauuuggggcaaguuauuuaaccuuuuuugcuccucaguuuuuuuuaaucccugaaauggggauuggaauuggaacauuauaggauugucauggaaauucaaagaaagaaugaguggagaauguuugaaagaguaccuaccauaugaugagugcccaaucaauuguagcuauugcaauuauguaaaagagaaauguguaauagcuuuuuguuugguguauucaauaugguuuucaaaauaaagaccaauaucauaaaguuuuguugcuguuucucauaacuacauuuaaauucccgguuacuuuaagcccccuuuuuuuuugucuucugcauaccugcaaguaccucauccauucuuccguaauguuuuucucccuuagccaauaccauuccaaugaauaaaugcucaagaccaaaugugaacagagguuuaggcugacuuuaggacugagucacugugaucuguuucagccuccuggagcucuuuuuuccuccaugcucauuuaccgaggaguauaauguuugcaucauaccugcuguugaauuaccauguaacgauuaaugagauauguuuauuaacaagauauguuuaugaaaugccuuauguuugugaucacuuguaauaaaacauuaauaaagaauaugguuuauugaugaauauauuagaucgcaagggggaaaacccagugcuaaugaugaucucacuuuuaauauguuagauaauuacuccaacugaaaccgaauugauuuuuaucagauaaauugggggucaaaguuacaccgcaguaauuacugcuuucaaacuguguuuguguaaccuggggaaagauuuugcucuggggaccauauugaggcauuugcccuugccacuagcagagaacuuggaucugugcacacacaacuagaagcagaagcauguauuuccuuucuuuuaccaaagaauagaaaccaugaagaaaaccacucuccucaauacuggaugaaauuagacaccaaagaauucccuuucacucaguucucugcuucauuuaaaaccuagaaucuuuguagaaaucuguaaaaaaaaaugcguaaauuguauaguuuccuuuucccauaaaaucuccaaagaaggaaaucuuauuuuuaccuuggacuuucaaaaacauagauaauaaaaacauuucauuugcucuaacacaguuuaugaugucacuagaaguucuugauaaaauugucagcgugaguaugccacugaauuaauaagccaugcuuuauucgugguauguugugcaauaugucagcauuuccccuuucuuuccuguaaauuguaacuuuuccgaugacuagcauuuaaagucuuuuccugauuaaggaauugucagcugaaaucaucagggauuuccccuuaacuauuuuggaagaaaucugaagaauguaauguguugcuuggaaauuaagaaauuuggaauaauucaugugaaccuaaauggugaaauagaaucaagaaaugauaguuuucuuaaaaauaagauggccaggcacgguggcucacgccuguaaucccagcacuuugggaggccaaggcggguagauuaccugagguugagaguucgagaccagccugaccaacauggucucuacuaaaaauacaaaauuagccaggcaugguggcgcaugccuguaaucccagcuacucaggaggcugaggcaggagaaucacuugaaccugggagguggugguugcagugagcagagaucaggucauuauugcacuccagccugggcaacaagagcaaaacuccaucucaauuaaaaaaaaaaaaaaaaaagaaagaaaagaaaagaagauaaugauaaggucacagaaagaauaauaaaaacuguagaaauaaugaacucucugagacauuuaauaaacuuugaugucucuguucuaugcuuuucaaaagauuuguuacauuauaagagcuaaacugaaauagaaacauuaacauuucagaugcuuagaaaaugguuuuuaaauuuaauuucuccaguuacucaagguuaacagaaauuucuuuuauaaauguguauuguggccgggcaugguggcucaugccuguaaucucagcacuuugggaggcugaggcgaguggaucacaaggucaggaguucaagaccagccuggccaacguggugaaacucugucucuacugaaaauacaaaaauuagccgggcguggguggcacacgccuguagucccagguacuugggaggcugaggcaggagaauugcuugaaccugggaggcagagguugcagugagccaagaucacgccacugcauuccagccgaggcuacagagugagauucugucuuaaauaaguaaauaaacaaauaaauaaauaaauguguugcaucugcagugccacuagaacaaggauagcagacugaggugguagaaagcagacucaacagggcaaaaggcaagagaucuguuucaagugcaagggccuugagccuuuuguccaguggcaggaugggguggggugagcaggagacagguggcuagugugauaaagaguacggggccgguuggagaagagucauuagaaaaagccucucugaggaagugaccuuugagcugaaccagcacggggagagcacagagaagaacucagcaaauacacagaaagcacauaucacaugcaaaggcccuggggcuagagugaauuugaugaucaagagacagugaguagaggaugggucaguaggugugcagcaaaccaccauggcacauguauaccuguguaacaaaccuacacguucugcacauguaucccagaacuuaaaguggaaaaaaaaaaaagggaaagaaggaaggaaggaaggagaaagaaagaaggaaggaaggaaaaaaaggaaggaaagaaggaaggagaaagaaagagagagagaaagaaagaaagaaaagaaagaaaaagaagaaagaaagaaagaaaagaaaagaaggaaagaaaaaagaaaggaugagaaggcagguauagcuagagcacagggggagaguggugagauaagauccaaaagguaggaagaggcagcccugauaaaagucaaguauggggagaaaaaguuaacaguugaguuaauuuacuguguuuuagaauuaucccaauucuaaaaauggcacguggaaaacacuuuaaagaaggaaggaucuguaugccaaaucucaaccagcuguaagcuccaaauuuguauuugaugacagacaggccuuacucuugguaacucuuagaaagagaaggaccucacgacuugccagcuuagcucuuuuguugucaccuuccacauaaaggagacugaagcaaaggaaaaguguccucaaaaucggucauccugugccuucuacauccacccucagcccccauguauguguuauacacguccuuagaguuuccuuguuccccauacucuuccguggacaaagugugacacuguucagucugguggcagagaagggaaggaaaaaaagaaacagaacuuuacuuuucuucucucaacagacuuugcagaacaaaaugaaaaaucaaagggacccaaaaugauagaucugagauucaguccaccagcuauuacaacuaaauaguggcagaaagcaacugaugcuuucuuacucuaucuuccaaccaagacccccuagaaagcccugcaugagcaacuuuaggcuaucuggcauuuccaggguaguuauuuagaauaauggaaagugaaaaagauuggcauguguuuuucaaagaccgguaaucaaauaggauagcaaacgugcagagaugugaauugaaugaauguaggagaugauuuguucaaaauaauuuagcaacuagaagcaaagucuuuaaugcuuaaguggauaucuaagcagcaggccaauuccucccagccauuaaaagcuuaugcaaaucccauaaaucaguaaugugcuuuuuagguuugcaguuuccuuucaaggagccuuguguuuuguuuuuguuuuguuuuguuuuguuuuuguuuuuugagacagaauuucacucuugucgcacccaggcuggaguccaguggcacgaucucaggucacuacaaccuccaccucccagauucaagcgauucuccugccucagccucccaaguagcugggguuauaggcacccaccacccaugccuggcuaauuuuuuguauuuuuaguagagacgggguuuugccauguuggccaggcuggucucgaacuccugacuucgugauccacccgccuuggccucccaaagugcugggauuacaggccugagccauugugcuuggccgagccuugcauuuuuagacacucgaucacucccugaaaacaaccaagccaggugaugguugucuaccaguaauauuuuuucacaccucuggaaguggagcugugauccugccaguagcuuucuuucuugauguaaauacuguguagggacuugcaggcuuucauucaaucucuuuucauucauucauugugcaccaugccugagcagugugccagcucuuggugauagagcaauuaaguaaaaugcuggaugaagcccuauggggagaugggcaaagcaugagaaguacuagaauagcagagaaguaaacaaagcgagauguuggguggaaugggagcaacuaauuccagcaagggaggguggggaucaaggaggaccucagagauguaacuagacucacacugaaggguuuaaaggaaggagauauaauuaggcacaaagaaucacauaaggcgaaacagacacagaauaacccugcagagcauguuuucuucaucaugacuuuucucauugacuagaaucuuuuuuuuuucuuuuuucuuuucauguguguuuguguguuaggaacagagagaggaguuacagggauagagugguagggacaggagaaguagauagguaaggaaugucaggccccaaguaccaaacagaguaguguaugagcuucagugucagaaagaccugguugggccuuaggcuguuccuuuaccucaaagccccagcuuccacaucagcaaagugggaaagcuuccauuuggguugcucugagagugaaaugaggugcacuguagcacagugaggggcugaguuuugagucagacagaccugcuuucaaaucacacugacuucuuguauuagcugagucaucuugcgugucaaaaccucaguuuucucauuuaugaaaugggaauaauaggaucucccucaugggcauguaaggauucaacuagcuaauucaugaaaaguguuuauuaguacaaggcugggugcacggucagcaauguuagcuuucccucuccuuuuaauagaaccuugcuaaagguuaguuccuuuccccuaaggaaauguaagaguuugccauuuuaaguccuucaguaauuuauucacuguaacuguacagagaaagaguaugacuuuuuagcaauuauauuuuccauggaggagucuuccauucaggcucaccacauugauuuuccuuuguugguacccuuuuuuuucccucucuuuuuuaaagucaggguuucacuccgucacccaggcuguugugcaguggugcagucacagcucacggcagcuucaaccuccugggcucaagcaauccucuuaccuuagccuccugaguagcugugaccauaggcacacaccaccacauccagcuaauguauuuuuuguuuuuuagcagagacgagcucucacuguguugcccgggcuggucucaaauuccugggcucaggugauccucccaucucagccucccaaaguggugggauuauagguaugagccacuacaccuggucuaaaccucauucuuaucaaugcaugaugauaacagaugccaucccagggcaaacaagugaauagcaugucuucuuuuucaauucuagucuccuaauuugagguaguuucuacacaguuuucuuaccuucaacagcacauacuuaagaacucaauucagaacaauucaccuucuauauauaaacuuaguauugugagaagcauauggcccaaggccuugcuuucaagcagcuaacugccuucuugggaaaauagaacuuccagaaaacaauuaggcaacaauaugaagaaaguguaugauaagguacaaagucuauuccaacuauguuuaugacacuacuggcaguacgugcauuggucagaagcuggaauuuucagggcaggcuccagacuuuaggaacuauguuaugaucaaccagcaggucuuagaauaaccguugucugucugucuuucuuucuuuccuucuuucuuucuuucuuuucuuuucuuucuuuccuucuuuccuuucuuuauuuccuucuuuccuuucuuuauuuccuucuuuccuucuuuccuuccuuccuucuuuccuuccuucuuaucuuccuucuuuccuuccuuccuucuuuccuucuuucuuuccuucuuuuccuuccuuccuuccuuccuuccuuccuuccuuccuucucucucucucuuucuuucuuucuuucuucuuuccucuugcucuguugccaggcuggaguugaaguagcaugaucacaguucacugcagacucuaccucucagacucaaggaauucuugcaccucagccccccgaguagcuggcacuauaggcgugugccaccacacccagcugauuuuugguuuuucguuuuuuuuuuaagagaugggguuuugccauguugcccagacuggucuuggacuucucaucucaagcaguccaccugccuuggccucccaaagugcugggauuccaggcuggcucaccacuccuggccuauuguuucugauuucacaucaucacuccaccuucccagaauacccucaagaugaguccauccugggaaaaaaauaagacuaugauuuaaagucagugguuuccuaaagaucuuuuuuuuuuuuuauuggagacagggucucacucuaucacccaggcuggagugcagugaugcaaucacagcucacugcagccucaaccuccugggcuuaagugaucuucucuccccagccuccgaauagcugggacuacaggcacaugccaccaugccuggcuaauguuuguauuuuuuguaaagaugggguuuugccauguugccuaggcuugucuugaacuccagagcucaauugauccacccgccuuggccuccauaaguucugggauuacaggcgugcaccaccacaccugaccaagauuccuuuuuuaauauauacuuccucccuccuccaugcuuugaaauucuucccuaccaaauugcauuuacacauaauaauuuuugucuuccauguuuuauuaaucaaagacaguugccuaucugaagucuaggucagcauaagccaaugugaacucaguauagcaacacuauuaucugauuccagguuacaggggagaaaagaaacuaggguauuucacuuguuaauuaugcauuugagauauaaagccuugcuaaugucauguauguauacauccagaaaauaugcaaaaucuagaaaccaugcagaaaaagauugauaauuugaacuacaucaaagcaaaaauuaucagaccagaaugccaguuaaauuuuuaaaaaguuaaaaaauuauuuaugauauuuuuagaugcccucaguaaagucaaaagacaaacuaucagcuaaagaggaaaauuguaauuuaugugauagaggauuaauuuccugcacaaaaucuuacaaaucaaugugaaaaugacaaaccaauauucuacaaaaugaaagcacauaguuucagaaaaagcaguaccaaucaccaguaagaauauaagauguuuaacuuuacaaaagaaaugaaaauaaaauagggccggguauaguggcacacgccuguaaucccagcacuucaggagccugaggcaggugcaucacuugaucucaggaguuugaggccagccugggcaacacagugaaaccccauaucuacaaaaaauacaaaaacuaaccagauguagugccuguagucccagcuacuuaguagggcugaggugggaagaucacuugagcccaggagguugaguucuugguaagccaagaucgcgccacugcacuucauuccagccugggcgacacagugagacccugacucaaaaaguaaaauaauguuuaccuaucaaauuggaaaagauguacacuucugauaauauucaguguugcaaucuauauauggggaaguagccaccuuaaauaauuuauucaacauguaaguccacacauagacccaaaaguauguauacagugauguuaauggcaacaucuauuguaucagccaaaaacuagaagcaaaccuuaagcuucugaucaagauuaaauaacagguaccacauugaacuucccuccuaaaauaacagagaaaaaaaaagaaaacaaaaucugugaaacaaccacggcacucaaggcauugacaucaggcauggaaaggcaaugauccuugaagacaggaaacaaaggaaaugggucccaugcuuguuccagcuuacuauugagagaguuuucaggccauaguacagggaaggggaaccuaggcagauccuugugaucucccugaauggaggaaauauaacuaagaguccagggaagccaagauagcuagacuagaguagagagaugcacaaagagagaaaucuggagaugugaggaggucuccugaauacugaugagcacaugcaugugaagaaacuacccaaggccagggaaagagcuaucuaauggauuagagagaacagugccuggaacucacacagggaugagaauaguaccuguucucaacaaccagaaaggaaagaaauccauaauucagagacauugguuacuuuugcuucaguaguagaaaaaaauuaaccauagauuaaacaccacucuggucauccugagcacaacuuuaaaauaagacccaaaagcaucaaacuguuuccaaauaaauaacugcauccaagaacaaaacucaagaauguuuauaaagaaaacaaaaauaaacagcacccacaaugucuagauuccagguaaaauuaccaggcaaacagguagcaggaaaauacaaccccuaauaagggagggaaaaucaacccaucaaaacugaccuagaaaugacacagauauaaaaauuaauaggaaaggcauuaaaacaauuauugugauugcauuccauauguucagaaaacuauaagaaagauugcccauguuaauuagauacauggaagguaggugugugugugugggcaguggggguguaugucuuuacauauguaaagacccaauaagaugaaaccuacaauggcugaaauuuuugaaaagauaaaacacacaaacuggaugggauuaauggcagcuuagacacugcagaagagaagacuagugaacuggacaacacagcagugaaaacuacccaaaaugaaauaaaaaaaagaaucuuaaaaaaaugaacagggcaccagugaauugugggacagucucagggagucaaauauauguuuuagugaagucuggacagucucaaggagucacauauauguuuuagugaagucuccaaaagaagaaagcuaugaggagacaaaaagauuuaagaaaauuguggcuggccaggcgugguggcucacgccuguaaucuagcacuuugggaggccaaggcuggcagaucaccugaggucaggaguuccagaccagccugaccaacauggugaaacgccaucucuacuaaaaauauaaaaauuagcuggacgugguggcaugcacuuauagucccaccugcucaggaggcugcggcaggaaaaucgcuugaacccaggagguggagguuucaaugagccgagaucacaccaccacacuccggucugggcaacagagggagacuccaucucaaaaaaaaaagagagagagagagaaagaaagagaaggaaggaaggagggagggagggaagggagggagggagggagggaaggaaggaaggaaggaaggaaggaaggaaggaaggaaggaaggaaggaaggaagggaagggaaggaagggaaggaaggcaggcugaaaauuuuccaaauuucaugaaaacugugaacccacaguuuucagauuucacaaacccucaaagaaagauacauggggaaaaaacuacaccaagggaucuuacgaucaaauuguuuaaaaugagugauaaagggaaaacagcaaccaaagggggaaaagaaacauuauguauaaaauaacaaauauaaaguugacagcagauuucucaaaaaaauguauaaaguaagguagaagacaguggaaugaaauuuuuaaguuacugaaaggaagaaaaaacuuucagacuagaauuccauacccagcaaaauauauuuuuuaaaaaaaggugagacauaaagauuuuuucagacauacaaacaauaaaagaauucaucaccaacaaaccugcauuacaagaaauguuaaagggaaacccuucaagaagaaagaaaaugaugcaguauuaguucucauacugcuguaaaaaaaauaccugagacuggauaauuucuaaagcagagagguuuaauugggcucacaguucagugggcuguacaggaaacaugaugguggcaacugcucagcuucugcggaggccucaggaaacuguaaaucauggcagaaggcaaagugggagcagacauauggccagagcaggaggaagagagaggggcuacgcacuuuucaaccaccggaucucacaagaacucuaucaugagaacagcaccagggggacggugcuaaacuguuagaaacugcccccaugauccagucaccucccaccaggccccaccuccaguauuggugauuacauuucaauaugagauuugggcaaggacauagauccaaaccauaucagauaccaaguggaaaccuggaucuacacaaagaacuaaaugauaaagaucaucauaaaugguaacuacaugaauacacacaggauuuuuuuucuuaauauucuaaccucuguaaucauugaguuuuucaagcaaaaauaauaccaauguuuguaucauauguaaaaguaaaauguguaacaacagcacuaaggcuagcagggagaaauggaauuauacuguuuuaaggcucuuacacuauagagcccaggcaacuggcuucguggugaauucuaccaaguauuuaaggaaaaaguaauaccaagucuacagaaacucugacagaaaacugaagaauagaaaauauuaccccaaacauucuacaaggcuagcauuacccugaugccaaaaccaggcaaaguuauuauaagaaaaagaaaauuacaaauuaauaucccucauaaacauagaugcaaaaauucuaaauaacuuuuuagcaaauggaauccaaauauguacaaaaaagauaauacauuaugaccaacgggggguuauuccaggaaugcaagauugguuugacauuugaaaacuaaucuguauaauucaccauauuaacagagcaaaaaaagaaaaaucaggccaggcacaguggcucuugccuguaaucccagacaugauagucaguuuuuguuguuguuguuuuuguuauguuucuuuaaacuuuagccauccuaauagguguguagugguaucucauuaugauuuuaaucugcauuucccuaaugacucaggagguugagcaucuuuauguaugcuuauuugucacuuacauauuuucuuuuaaguguucguucacaucaauauuuuuuuguuuauuucaauaucuuuuaagaucuuuuuuccauuuuuuggauuuugaguuuuaagagaucuuuuuauauucuggauaugaccucaaacugaccacuuugggaagcuaaagugggagagucgcuugagcccaggaguuugagaccaaccugggcaacauagcaagaccgugucucuacaaagaaauuuuaaaauuagccagguguggugguggguaccucuaggucuagcuacucgggaggcugaggcaggaggaucacuugagcccaggaauuggaggugacagugaguuaucauugugccacugcacugcagucugagagugagugaagcagaaagaaggaaaaucauaugaucaucucaauagaugcagaaaaagcauuugacaaaauccaauacugauucuugauuuuaaaaaugcucagcaaacagaauagaagggaacuucuuaaaucuacuaaugagcaucuaugaaaagccuacauauaacaucauacuucauggugaaaaacugaaagcauauccccuaaggaaacuagcaaggaugucuacucuuaccacuucuguuuagcauuguacugggguucaaacaaguacaauaagguaagaaaaagcaauaaaggcauccauuggaaaaggaguaguaaaauuugcagauaacaugaucaucugugcugaaaauccaaugaaaucuacaaaaaagcugcuagaacuaauacgugaguuuagcaaauuugaagaauauaagacuaauuaaaaauaauuauauuccuauauacuagcaacaaucagaauuuaaaaauuuuaaaugccauuuaugauaucaucaaaaauaugaaauacugccaacauggcaaaaccccaucucuacuaaaaauacaaggaguagcuggguguggugacgcaugccugugaucccaccuacuugggaggcugaggugggagaaucgcuugaacccagguuucggagguugcagugagccaagaucaugcugcuacacuccagccugggcaauagagugagacucugucucagaaaaauauauguauauaugaaauaccuaucgauguaucugacuaaaggugugcaagaacugucuacugaaugcaaacugugagaaaucagagaccuaaauuaauggaaagauauaccauguuaaugaauucgaaaacucaauauacuuaagaugccaauucucaccgaauugaucuguugauucaaagaaaccacaaucagaaucccagcagggguuuuuuuguagauauugacgagauuauucugaaauuccuauagaaacacagaggacauacagcauccaaaauaacuuuggaaaaaaaaggacaaaguuagagaacuuauucuaccugacuucaagacuuaaugaagcuauaguaacaaggguaguguaguaagauggacaacaguuaaauaaaucaguggaauggaauagaguccagaaauagauccaugcauaggcagccaauuaauuuucuacucacaugcaaagacaguuccaugguuuuccacaaacaugcaaagauaaugcagugagaaaaggacagccuuugcaacaaaugguucuguaacaauccaauauucauauauucagaauauaaacuuugaaccauaucucacaccauauguaaaaauuaacucaaaguggaucauauaucugaauauaaaaccuaaaacuauagaagcccuagaagaaaacauaggagaaacugugaccuugguuuaggcaaagagcaauccacauuuuuaaaaauuauaauuuagacuucaucaaaauuaggaacuucuguucuucaagagauacucuuaggagaaugaaaggccaagugacagucugggaaauguuauuuucaaaucacaaaucugauaaagggccugaauccagaauaguaaaagaucucucaaaacucaauaagaagaaagcacucccaaaaauggaaaaaagauuuugaaaagauacugaaaugaacaacaacaaaaaaacuaacaugaacagacacuuaaaauauauagaugacaagcacauguaaagaugcucagccucuuuuagucauuagggaaauacagauuaacacuauaaugaaauaccacuacacaccuauuaggauaguuaaaguuuuuaaaaacacgacaaaaacugaucauaccauguguuggcaagucuaggcagaaucugagucucuucacacugcugguggaaauguaaacugauacaaccacuuuaaaaguuaaacauauaugaccuaggcaucccacuucgagauauuuauucaagaccauuggaagcaugugcccgcagaaagacuucuacuacacaaauguucauagcagcuuuauuucuauuaguucaaacuggaaacaagcccaauaucccguaacugauaaaugaauagacauuguaugucauauccacagaauacuacucagcaaaaaaaaaaaaaaugaggacuauugauacaugcagcaaggugccagaccaaaaaaaaaaaaaaaaaagagcauauccuaugugauuccauuuugauaaaauucuuuuuuuuuuuuuuuuuuuuugagacgagucuggcucuguugcccaggcuggagugcaguggcgcaaucucggcucacugcaagcuccgccucccggguucacgccauucuccugccucagccucccgaguagcugggacuacaggcgcccgccacuacgcccggcuaauuuuuuguauuuuuaguagagacaggguuucaccauguuagacaggauggucucgaucuccugaccucgugauccgcccgccucggccucccaaagugcugggauuacaggcaugagccaccgcgcccggcccauuuugauaaaauucuuuaugaugcaaauugauguaaggcaucagaaaacagaucaguuguguuggaguggggaguagaagccugaaagugcagaggauagggauuacuaagggcacaaggcaacuuugugaacaaucaacaaauauucacucucuugauugugguaaugauugaacagauguguacauuaucaaauuauauacuuuauaugcauaguuaauuauauauuaauuaugccucauuaaagauggggacaggaagcuacuuacuuaaaugcuuauuauagucucaguuacucaggaggcugaggcaggaggaucacuugaguccgggaguucaaggcugcaguacacuaugauagugccugugaauagccacugcacuccagcuuggguaacauagccaaaccccguuucuauuaaaauaaaauaaaauaaaauaaaauaaaguaaaauaaaauaaaauguguauugucaggggauuaauuagaugaauucuggggucucacucugucacccagguuggagugcaguggcacgaucucggcucauugcaaccucuaccuccuggcucaagucauccucucacuucagccuccuaagaagcuggaaccacaagcacauaccaccacaccuggcuaauuuuuuuuuauuuuugguagagacagcauuuugccauguaggcuggucuugaacuccugagcucaagcaaucugcccgccucagacuaccaaaaugcuaggauuacaggugugagccacugugccuggcuuaagcagcuauuuuuaaaaaugaaguugggugcaguggcucacaccuguaaucccaacacuuuggaagaccgaggcaggaggaucaccugcggucaggaguucaagaccagccuggccaacauggugaaacccccacucuacuaaaaauauaaaaguuaacugggcaugguggcgggcaccugucaucccagcuacuugguagucugaagcaagagaaucacuugaaccugggaggcggagguugcagugagccaagauugcggcacuguacuccagccugggcaacaagagugaaacuccgucucaaaauaaauaaauaaauaaaaauacccgggcgcgguggcucaugccuguaaucccagcacuuugggaggucaaggcagguggaucacgaggucaggagaucgagaccauccuggauaacauggugaaaccccaucucuacuaaaaauacaaaaaauuagcugggugcgguggcaggcgccuguagucccagcuacucgggaggcugaagcaggagaauggcgugaacccgagaggcagagcuugcagugagccgagauugcgccacugcacuccagccugggcaaaagagugagacuccaucucaaaaaaaauuaaaauaaauaauaaaaauaaaaaucaagucauccuguaugugucaauaggaaaugaucccccaaauaaauuauuagauguaaaaaugcaagguauuugcauaucucuuugaguaaaaauaggcauuauauauauguguguguguguauuuguagauauguaugugugugucuauuuacauauauguauauauaguuuguguauauacacuguguguaugugagggauuucuugagcauauacaaaagcuuacagugguuguuucugagaauuggcauugugggauuguggaaaagagagagaggacuucugauuuuauucacuuuuguugaauuuuuugaaaaccauauaugugcauauucuuuuauaaguuuaaaaaaaagauugguuaaaaagauaaaaaaggcgggccaggcgcaauggcucacgccuguaaucccagcacuuugggaggccgaggcagguggaucaccugaggucaggaguuugagacaggccuggccaauguggcaaaacaccaucucuacuaaaaacacaaaaauuagccggucgugguggcgggcacuuguaaucccaacuacucaggagacugagucaggagaaucacuugaacccaggaggcagagguugcagugagcugagaucucgccacugcacuccagccugggugacaugagcaaaacuccauuucaaaaaaaaaaagagagagagagagggccaggcgagguggcucacaccuguaaucccagcacuuugggaggccgaggcagguggaucaccugaggucaggaguuccacaccagccuguccaacaugguaaaaccccaucucuacuaaaacuauaaaaaaaaauuagccggcgugguggcgagcacuuguaaucccagcuauccaggaggcugaggcaggagaaucgcuugaaccugggaggcagagguugcagugagccaagaucacaccacugcaccccagccugggcgauaaagcaagacuccaucucaaaaaaaaaaaaaaaaaaaaagagagagaaaccaaaauugggaacuauaauugaaauauaauuacugaaugaauguaguauaauuaccaauugaaaacuauaugacugaaacauaauccaguuuguuuauucaucugaguagcugcugucuuuuuaggaggcuuuaaagauaauucuggguuagaaaauugauguuguggguuugucccaaauaacuaaaauauuuuacaccuuauuucuugaucagauuaaaguaagagaguguuuuuuuuuaagucuuuaauuugagcuaaaacaucuaccauuuuguaguaugugagagcuauagacaagagagaggguagguacagaacuaaggaggcuagaagucuuuguccauacagguguugggcacagaauauaaggaaauaaaagguguuaaaaguaagauuucuuuagaauauuacaggacuugaagguuugaccugaaguacuccauuucuccaauauaguauaaguaaccacaaaauauauguauacaauuguuuuaggauuuaaaggcaugacuguauuagguaacuaauuaccauagggauuaucaugaauggguuuacagagauucuugacaucucuaaaugggucugaauagauuaauaucaagguaaucugggaacucccuuugaaccuuuugagguuaguauauauuaaagagcuccuccucaauaaaagauugccauauucaagaacuaucauaauuaugggugagguuuucuagcacaaggaaaaucauuuuuuaaaacuguuugcuuuagugagacuaacauuugaggaaauaguacuggccauuuuuccagguuguauagucacuuuuaagaggcaggcaucauccaaagacuucucacuggccuuuuuuuuuuuuuuuuaacagauucuuaaguuaugacauugaaauugacagucagaaucauguccacaagaaacaauauucuaaacuugauguaugaaucuucaugaugccucugucuuuagaaaauuuuugaauuguuuaugaggucaugggauggagcuaaguauaauaacuguagucuccauuuaagaaucaauuuucaugccugucucaucagagucuagugaaagaauaaaagaaagguguauaaaagcacauggagagcuaugaacgugcaaauugcugagcaccucgagggccuggauuggguugugugccaggcacaaggaguaucuuaacacacguuuucacuggaguagaucuggacaccaaggccugcugguuucagaauucgcugccaagccagaggaugaguaguucucucaugagagcccaacucagggauuuucaaaaauguggucuugaggauucuccacaugauucacaggcuggugcacaaauucucaauguguaguguuuuauuucuggcaugaaucagugauuugcuaucuaucaucgguguuucaucagaaacaguagcaaccuuuucauucaucccugucaucugggucuccacuuucuguuuuuuuuucuguuuuauuuuuaguggcaggggaguuauaaucuuaaaaugucacagcuagaaauaauauccaaggucauuagucccaacccucucagagaugaggaaacaucuagucacuguuucagugagacccgaagucagaacuccuggcccccaguucagcaccuucuuggcugccugcaugaggccugucccaucagacagucugcagaccaaggaaaugugagcggcaguguccagacucauccaagacugaguugugaccaagacagcuacuguauuaguuaagauguggagaaaaccacccuugaaucauguugcagcaacaucaagguaggaccucaugcuugguaaaaucccuaccugggaaaccaagaucugaaugacagcaagaccagccugaccucaguccccagcagcgggcaauccuuccuuaccagguuaucucagugagacuuuaauuaggauguucuuggauguguuuaaaaccuggcacagccuugcaguuucagcccagguccuuucaaucuggggacagcaggagcucccacuacaggagcuuuuuggcugugagcagggcuccuaucagcuuggcucuucagagcugucacaaaaccuggagaccgccauuguuuuuugauauccuguuuccuuucuuuuuaguuaccaagaagauuuccuuuugaacaagcaucauguuuuguuuacauugaggguuagguguuuauguugauguuuuaguuggaauccacgucugccuuuaguuauagacaaccucauugccagcagaucuuaguccucagcaacacaccugucuagcuuguuccgauauacugggacaaaccuugggagucugggggcccuuuuuaaucuuguggcuccaucacaguagagagagugauaaguauggccucugggaucagacuuauuagcugccuggcaaauaucaggccaguuuaccucucuggaccucgguuuccucaucuguaaaauggggauaauauuugcaaccugccucauagaguuguugugagacacauugugaauuaauucacacaguguucacucaguucaaggccugguagauaguuagcacucaguaaacugacagguggccauggagguggugguggugauaccauguaguaagacugguuguuauuuuuuuuguuacuaucacuucucuccagcccccuccgaaagaaccaucauuaccuagaaucauugacccugagguugggaguuaaagccaaagguggguaagcuacaggaggaagggguaugaccuaggaaugggagggaacagguagcuuuacagauucggggcacgucgcuuucagaaggauggaaacaagucugccuucuuguuagggaaaaacagaacuaacuuuuucuuuuuucuuucuuuuuuuuuuuuuuugagacagucucucucugucacccaggcuggagugcgaugggacgaucuagguucacugcagccuccaucucccgguucgagcgauucuccugccucagccucccaaguagcuggaauuacaagcgugugccaccacacccggcuaauuuuuguauuuuuaguagagacaggguuucaccacguuggccaggcuggucucgaacuccugaccucaagugauccacccaccucggccucccaaagugcugcgauuacaggugucagucaccaugcccagcccccagaacuaguuuuuggacacaccaugaagaaguguggaaaucuccugcccucuugccaauccccaaccucagggaggaaggcuacccuuagagaaacacagaucugcucugaggaaugcaugggccaaaaauaagcucgcaccugggcaacuccagauuucauuccaugccuaauuacguuuauuucuuaagccucgaauguacgcuagguacuaaaggaaacagaauuuagagcuagcucuucccaauaagaagcaggaggagugggaaacgccagaggcuuuggaggagugaugaucacccaacauugccucccacaagcacguggccuggagcacuuaccucccucuaggccccagcugucaagugugggguuuggacuaggugaccacagcuccuuucaguuuuaauguaaugcagaguccacugaaagagaaacucaaacuuuguucccuuuacucauuagauuuuuguguuaccaccucuuucacacacaugaugugaaaaaggugguauugugucauauauuaagaaagaaaggugacugggcgcgguggcucacaccuguaaucccagcacuuugggaggcugaggcaggcggaucacgaggucaagagaucgagaccauccuggccaacauggugaaaccccgucucuacuaaaaauacaaaaauuagccggacuugguggcaggcgccuguagucccagcuacucgggaggcugaggcaggagaauggcgugaacccgggaggcggagcuugcagugagccaagauagcgccacugcacuccagccugggugacagagcgagacuccgucucaaaaaauaaaaaauaauaauaguaauaauuuuaaaaaaagguuucucauaauuuugaacaagucauuagaugucugugacuguuuccucaccuguaaaauuguuaucaguacucagggcccucccucauagggugcuugugaacauuagauaauaaaaagauuguaaagcacuguguaaaugucaagugcuggguaauggggaagaguaacugcaggcaggguaggaaaacuuagcaugggaaagaugaaaacuauagauuuucuccucccugaaguuuaaaaacgaucuuuuuuuuuuuaacaaaauaaccagauucuuuuuauacacuuuucucuuaauccuucagaauagcacaguuuggggacugccuucaaaaucagaccacauuguuagaaguuauuucacugcuucagaacccaaauccccugcaaggaauguaagagcaacuuacuuucuuucaaauuucagucaacgguaaaguuucagcguauagcaugguccacuucuugcaaucacaaauuuacuuugcagggguaaaauuucggaaggagcaguggaagaagucuggucuggguacuucuuguaaacuucagucagauauggccugugcaagggcaaacaguaguuccauauuucauuuauuuggcacuuucucuaaggagaucaaagcugcuuuguggacuuaaucuauuuaauucucacaacaucccugccauguaaguagcugcuaucacccuccuucugcugauaugaagcccacagccagauaugaaaacuggcuuuucaagggcacaagcaaaucgacaucaagaacaggaguuguacucuaaauuuuauuuauuauccucuucccauuugaauaaauucuccuaaauaaagcaaauuugagaauuauuuugccagucaccgaugcuaagucaaaauuugagaauucuauaaagggcauauuuuugucucuaauucauagauucuuagaaaauuggcagauuugcugagucuuccucuucacuguuagauauucuagaaauuuugaccuuagauacaugagguaguaagaccaugcuaauaguauuguaugguuuauggagugaaauauaccugggcuuggcuagcucugugaacuucaguuuucauucaaaugugaauaauauaguacucgcaucagaguuguaucaauuaaauggugcaaugccuauaaaauaguuagcguagaagcuggugcauaguaagcuuucaguaaauaauaguccucauauuacaaaacaaacagguucuuagguuaguucuuuccuuguuaagauuuucauugaauauuuaagcucuagucaagcuaauccagauauauuacaaguuuucuuuuaaacagaaugcuuuguacacugcuauagcaagcuuguuccauuuuucuuuccccuauccccuucaggguuccauuuugguuacaagaagcuugcucagggagagguuccugcacuuuagcuuagauuucugucaaaacaagauuaccucuuuaguugacccugugagaagccguuuagucuuaugaaccaaccuuugauuucaaaauucuuugaguuguccugaaugugguaagcuacccugcaaugugcuuggaaaucauccaguuugggaccucaagagagagggauaagaugaucuaaucaguuuuggaacuuggaagagacagaguugucugaguggaacacugagcugugaacccaguaucauagacauugauuguugccagugagcuucguuccaaaaugggggacccauacagaaaauaaaggugucuugguccccacuccagaccugccgaaucagaaucuccaacaguagaccuaagaaucuagauuucuuuuuuuuuuucuuuuuaucuuuuuuuagaaacagagucucgcucugucgccaaggcugaaauacaguggcacgaucacggcucacugcagcuuugaccuccugggcccaaguaauccuccccauucagccucccaaguagcugggacugcaggcacaugccaccaugccuggguaauuuuuuauuuuuuauuuuagagacagggugucacuaaguugcccagguuggucucgaacuccuggccucaagugauccuccugccucagccuccagagucacugagauuacaggugcaagccaccacgccuugcuagauuucuuucuaauguaguuuuccuggugguucuuuuuuuuuuuuuuuuuuuuuuuuuuugagacggagucucgcucugucgcccaggcuggagugcaguggcgcgaucucggcucacugcaagcuccgccucccggguucacgccauucuccugccucagccucccaaguagcuaggacuacaggcgcccgccacuacgcccggcuauuuuuuguaguuuuaguagagacgggguuucaccauuuuagccgggauggucucgaucuccugaccucgugauccgcccgccucggccucccaaagugcugggauuacaggcgugagccaccgcgcccggccuuccuggugguucugauaccaccaaguuuggaaccacugcgaggccauuucccagaugaagaaaauaaggcccaaggagaggaguaccuccaccaagaucaguggcaugcugaacucaugaauggcagaggccugcucagagcucaggucacccucacagucagugcagguuuuuuuccacuacuccuucaugcuccugggucugccguggacucaggauaaacagacaaaguugucugugucuguacuuucucaucuguacuguagagauaauaacuccugaccuuaaagggccauugugagguuaaauuaguuaaaggguguucaguucacuuuguccuuuacucagagucuguucuuuagacaacugaaagggugcuaaauuaagccauuuugcagagaggucugagucaucuaguggcagcugucugugccucacuggaggugcuuugaucauugucaucuaaaugcaugcguuaaguacuaucuguagcacagcgcuccaggcugugcuaagugaguuacccagauaauggucucugcccuugagaacagcgcugaggcaagggacauaaagguuauucacacagcaacagaacaggggauccaugaacguugaauucagagagccuagaaggagcauggggacacccauucugcgccccuggcuuagaggaccgaagugcugcagcucaggucacauggcacguugagagcgggaugugugacccaccaaggcugaguccuucccaccucccccugcuggaggggaauuguuuuucucacggguuggaauguagcaaguguccauuauagucaaucuggaaaggcuuuaguuuggaguuaguuucaaggaugucuugaaaugaggcgguuagagcucagaggaugacuuuggggauggugggcagacuauguguacgaaggauugggccaaaaaagauuaugaaguaucuuuucuuuuuuuuuuuuuuuuuuuuuuuuuuuugagacacagucucgcucugucacccaggcuggagugcagugaccucccaggcucaagcaauccucccaccucaaccuccugauagcugggacuacaggauguacaccaccacacccggcuaaucuuuuauuuuuuuguagaggcggagucucacuauguugcccacgcucaucucaaacuccuggccucaagcaguccucccaccucagccucccaaauugcugggauuacaggcgugagccgcaguaccugaccagauugcgaaguaucuugaagcaaucuggaaagaagucuugaagcaauucuugaggguguuuuguaccacagagugaagucccaacaggacucugagaaggaagccacccacucagaauuacugccaagggaggggcuguaaugacacaugauggagugaggagguaugggaagcagcucuggaggguuaaggaaaucauugccaccauuuuuaaacagcgauuaugugccaagccccauguuuagcguuuuacauaaaaugccuuuauccucagaacagcccuaccagacagguauuuucauccagacagguguuuccccugugcguaugacaaaacgcacucaaggugauuagguaacuugcucaaaaacacagagggacugaggcaggcaguauuuaagccccugcuggauccuuccaaauaugucugcuacaccuuaagcccucucuaagaauauuagagauaguuauggauagccagccaggagguaacuaaaaauuuccauuauugucuauaaacaaacaaaggagcaaaaugggggugauacuccaugcagugagggugggaaaaccacacaagcucucucaguguucugaauuaugcccaagaaaggaugagcagaaaugacuaagguuccuuauuugacagaucauugacauggugacgugacccagugagauagaggagaugaagaauuuccaaagaaagauaagcauaugucauuuauaguaagaguuacugaugauuaggguguuuaagaacuaggcauugcucaaccaaaggggaaaguucaaagugaauagguagguuggugugucaucuaaagagacgauauagugucaucaagugagauagagccucagaaaacaucacuuuuggaucuguguauauaugacauuguacuaagacacuguagcauggaagugaauagauaagaauuaggaaaaucacaagcuaggagaggacagauguuaucacacagcaccuuguaauaaagggagaagaguagggaaaguuaagccugacaggaccccacuccugguagaaaggaaccauugauauggcuuugaagauaggaaggacagagcauugaggcagaauguaaaagcaaacaccucuaguaucauggaauccagggaagaaggaaaggaaaggaagagaagaccugugagcauuuuauuaugugcugggcauauuaaauaaucaauuacucaauuaaauucaauucaauacucaguuaaauacucaguccuuacaguaguccugccaguuaagucuucucccauuuuacagauggggaaacuaaggcucugagagguggucauuuucccgagaucaaauagcuaggggaggcaggauugucccaggucugacucugaaucccuugcuucugccacacugcuucagccagaaguuggagaaggggaaggaggauugguuauaugcagagucagaagcuaugagaggaugaugaggaucagaguggauuuggagaagugaugaggauauggguggcuuuguugggugauacugcugcagaguagaaaugggagaaguuggcuacaaggaaauucacaugguuggguucacaguuucaucugccauguguggcauuuuacuaccugguauauggaagauuaaauauuagcugcauuuaauucucucuuuggagaacugcgaguuccuuuuugaacaaauucuuugcaagcacuucuagucuacauaguugggcuuccagguugaugcaucuucagauuauaguuccaagaaaaauacugacuccagugggugguuuuucacauuuuuaaacugaucaguccuauuggcaacauaggcauucauccauucacucccaucugggaacuaugggaaucuucuccuccagcuaacacugugauuuggucaucuguguuuaguaauaucccaacaucugauccucuugccuuuuucagugacauaggcuucuuauuguuugugaaauuauggguuugcaugaauugcaacuaaugguagaggucuuugaaaaaauaauuauaauuugagaaaaugggguuagccuauauuagguuucuguagucuugagguacggaaagaaugggcaaacauuugcccuuuaaaguagguaagaguccauagcacaguaagaagucuguuuccucucacugggaaaacauauuccagccacugauuuaacuucucuuauuguugcugacuugcaacccuacacccccucuaagucuaugacaggucugaacauaauucuucuuuguaguccauugacucuuauaaaauaaugcugugauuauaagguuuccugaauacaauuuucagaauguuaguaauaaccacauugcaccuaccugccauacuugggcaauuaucucuguugcucaauuuacuuaauauuggucauagugaaacauguuuucaucacuugaaauccuaauuuuauuugccagauuacuaauggccaccuauuucuguaacauaagguagaauguuaugcaaguuugacuugcaaauacuguauguugacucuagaaaacaacagguuuggccgggcgugguggcucaagccuguaaucccagcauguugggaagccgaggcuggcggaucaccugaggucgggaguuugagaccagccugaccaacauggagaaaccccgucucuacuaaaaauacaaaaauuagccgggcgugguggcacauggcuguaaucccaacuacucaggaggcugaggcaggagaauugcuugaaccugggagguggagguugcggugagccaagaucgcaccauugccugggcaagagcgaaacucuaucucaaaaaaaaaaaaaaaaaaaaagaaagaaagaaaacaacagguuugccuggagauggcagcauaaggagucauuuuucugcuucuuuuuaagauagucugauuccucucaggauaaaauguugauaaugauugaaaggauaaagcauuuaaagcuggaauggauuuuugauacuagagagaccacccuccuucuaauucucaucccuuuucaggcuggagaggaaacaagguggagaaaggugguauacaugaugugaccucccaggucacauagcugacuaguggcagagccaggaacuuucagucauucuggugcccuuuccaccaaagcaccauuuucuucuaaauggcaaacaguugucuugaaggcacugucuuuuucuaccuagauguuggguggaaaaaaaaaaaaaagcugccuuuuauauagaaguucuugggaauauuucucauauagugagaugaacagaaugcaaaaguuucuuccugcaggaucucccaaaauccucuuggcuugaauuuucuucucacuuuucuuuugaaaagcuuuguuccuuuugcaccuuggaaaaauaagucuuguuuguccugacagcagagugcaagcaucuauugcaucaaaauucccaaguggaauagaaaaccaaugguccuuuucugaauuucguuagcaguagcaacaaacauuucaucauaaccucagaagcaauacagagaagaaaagaaaaaucaaguuagcaauuacagcuaacaucaugcaagaugaaagccuggcauuauaaaauccuuacuguuguaaacucuacuuuacuucuggaucugucugcaggcagccuacccuuucaaaauucaguaucuguugucaguaguuggguuauaaaugaaauuuauucuaggaguaauaaauaugguaugcaugaugaaacugaaugauuauggaaaagguuucuugacaaggaccgaauuaggcuaucauggugcuucugacaucuuagcaucucaguuuaggccaaagauuucuaaaggauucccugaaaacuaaauucacgcucugcccuagauuuacaguugacaugaaggucaaggaugagcaggcuggggagagcacaaagugccucaucacaagaugugccuuacccugagacauccugucaaaacuguucuauguugguaauucacauggggagaggauacauuuuaaaaagcucucuggcaccuuguugcuguuggaggaagggacacugcucugcagugucuucugucaggucugccuugaguccuguccacccucaauuuucucuccucagcuuacaguucuccaaaugcaccuggucucucuccuugggggcuggagugagcuccccacacugcuugggacgguccuuuuccucaggaguccacugcagaagcucgcagaacuuaucccuuguaugcuaauggcacugucugccccaacacuagacuagaguccuuuggauugggggcucugucuuguuuaucuugguguaugcagaaccuaccacacaugagaggcacacaguggugagcgggugguuggaagaggaagcaugcaggcaagcuucuguauagcuuacauuucaggagacauuuaaauaaucauaauccugggaaaauauuaaguaacauuagaaaagcugccuuucagaugcuccuauucccuaguguaucauaauggacauaaugaggcauuuguacauaucauuagaauugcugccuucaaaucccuccacuaagaauggcagaguggcagccgugcuuucucucacauuuuugccuuugcucauccuacuccuucuccuucaggauuccucccacugucacugugccuccagucauuuuaagaaguccuuggugaguucccguggcccccugagcuugccucucuccuggugcccgucacacuaugcuacagucguggguuuccuugucuauuucaaccccauccucugugccugggaaaugggagguggucagcagacauuuacugaaggaaaguugcaugagucauaccuugggcuccugaaugaggaagagaaaauaaauuuucuuuaaauuuugcuccugauccugggaaaccauaagccuccgacguuguaguuuuuuuuuguuuuuuuuuuuuuuuuuuuugagacggagucucgcucuguggcccaggcgggagugcaguggcgcaaucucggcucacugcaagcuccgccucccggguucacgccauucuccugccucagccucccgaguagcugggacuacaggcgcccgccaucacgcccggcuaauuuuuuuuuuguauuuuuaguagagacgggguuucaccguguuagccuaauacagcaugacguuuaaccauauuuagggcugcaaguuugaguuauccaaccacugugaaaaugcuacucgacugucauugugaaacuagguuaaaauuucaaagccaaugcucuuuaccguuuagugacaaugguuaguuacguuucuuggccgucuuuauauuacuucugaaaaauaaaauaacugaauuagcucugaaaaauaugagaaacaaguccuauuuuuaguauucccuucucaucuauaaaucuguuguaaauugaacauauuugacugcauuuuauucucuuuacuuguuccugcuuugccauuuugaucuccuuagaugcugaauuauauuuuuggaaugaaauagucauuggcuuuuuugucauuagcuauuuuacuauuuaauuuagaauaaaggacagaaugauaaaauuagauacaagaggccacugugugucaucaaguaaccuaaucuacuuuugguaacgaaaauaaaauucucuuuaaauaauugcuagcucauuuugaaccagcuuuguucagaugaauagcccucagucugggugaagaggaugagaaacucaucucucccucacaaggucuuuccaacaauuaaaauuauccuuuucucaauuucauucuauugcuccuaauuaugacccugauaauuagugugcuaauuacauccccugcauaauuucucugccuccuugauguucaccuuucauuuauuuuuagccugccuccuuuauuugcuccugaauucccugcuuacguguucccucacugggcauguggucgggggccucaaauucagagagaggcuuucccaaucacuuuaaccagucaccucuccauauuuuuuuuucuuuugucuuaagggaauuuuuagcuaaggaauaaaaguguaguuagaguaacuggagagcugcaauccagccuuguccuucugcgaugcugcgggaggggcacucauuacuuggugugcacucacuaccuacugcaagacccagaugucauucacaugccaggcuguagauuaugcuagugacccaacagcaucaucuucauuauggggugaggaaggucacuauuugggaucuuuauauuuuccuguagaguucauaaagcaaguucugagagucuuuuucuucucucuuuuucuccuuucuugcuuccucuguuuugucccgcuuacaacugcagguaguauguacacuguagugcuaggagucaggcccguaggcuuugaaaaugcgaagcaagaucaaccagucacccugccuugcccuuucaggaacuauuuccagaguucuccuuaugugguuuuuguuacugcguugauucaucuguuaguuuuuuuuuuccucuaaugagggcaaaacacuugaucccaucuucacaguauccuaaugauacagagaagaagaaagugauagccuacaggaaauuugacaccuaucccccaauuuaugguagagccaagguccagacuuaaccuacccucccgaaguccauucuuguaugaaacuacagaacaguugucucugggucuugcagagcacuccuuuacuccuuugcagaagagguagagagugggcagaaccaacuugaagccaccaaggacccuuuaggaucgagaguccaugugcaaugcacugaggaucuagaaauggaaaaaaaaaaaaaaaaaaaaaaaaaccugucucugcccauggagcuuacagauuagugggggaaacagccacacaaacagauaauuaugaaugauguguuugauauguuaauugccucaggugguggggggguuaaggggagacuccuggggaccccugagugagaaguuuuccuagaggaaggcaguggccuugauaaaaugcccuccuggacugcuucucagcacucuauuucuguguggcacagccuaggcucauagacaucacauucucugugguucuacuugugcucacucguaauugucaccugcccuggaauaugugagcuuucagugagaaagaacaucugucccucuugacaccuuuggguguggguaaggaaaagaguaaauguuccaugcuaagcauauugucaagcacugugaaugucaugaaggaggaaguuugaaaagugugauuucuucauguuuacaaaaugaacaaaugacucagaucuguuguacacauucacaagagcuguguccuaagcugauccugauuuugaagucaugugucuuccuuugcauguggggaggauuuuaaagggauggaaaguggacaaggagggggugggugagaggaaggaaggcuuagaggcaaggacuuuguucuacgaugcugacucagugaugccuucccuugggcucugcagaaauaaagauuuuccucaucuuuuagcuccuuccuucccuccucccucccucccucuuucccucccucucucuuacuuucauuuuauuucuuccuuccagucagcagguuuuugugggguauguuuucuguuaggcuaacuucagacaagacccugaaaacuaaguacagaugucaucacagaugaguguuccuuacucuuggaaguucagguagcccugccucgauuggcucugaccacuuugucaggccguggagcugagcuacauuuuggggauuucacccacauuguuguugacaggauuguuaggcuucacuagauuugcacccucgggcuuugaucuuuuuaauaucuuccggauugaauacccuuuugggauuguucuccugacuuuuuuuuuaaacgaguauauugugccacuagaaagaagaauguuuaaauggaucaaaaauaaaucuugauacucucuaucaaaugcauguaaaaaggaaaaacaagcauguuucauuaauacuaagauuccagggcaucugguaaugacagcgcugaguaaauccuauggggcgacauauuugauuagauucggggucagugggugaggggacauacuccagucauuacaaucugaggacagcgcugagcacuaacagaugugacaacuuauaacacagguacuuccuccuucacugcacuuuauccaaaaauagacaucuucagagguucuuuaccuuuuagccuuaaaggauuugagaagcuuuagaaaacaaauuaugauaucaggucuagauuuauuuugcuauuaaagucucacauucuguacaaguauuuuauuauuguuugucuaggucucugaaauuagaagagacagaagaaaacauauuauauaaauuuaaaguaugaauuagccaggcguguuggcacgcaccuauagucccagcuacucggggagcugagguaggaggauugcuugagcccaggaggucaaggcuacagcaagcccagauuguuccauugcacuccaggcugggugacagagcaagacccugucuaaaaauuaaaaaaaaaaauuaaaguaugacauauaaccuuguaagggauccaagaaguuuaaaauauuacaacugcugccgggcacaguggcuuaugccuguaaucccagcacuuugggaggccaaggcaggcagaucacaaggucaggagauugagaccauccuggcuaauucggugaaaccccgucuccacuaaaaaauaagaaaaauaaaaaaaaauuagcuggacgugguggcgggcgccuguagucccagcuacucgggaggcugaggcaggagaauggcaugaaccugggaggcagagcuugcagugagccgagaucgcgccacugcacaccagccuggggaacagagggagacuccaucucaaacaaacaacaaaaaaaauuacaacugcuuuuaagauaauacaucuagaaaauacaagggauugaaauggugucauagccccaucuuacccaaauugaaauguugcaguuuuaaaguugagcaauuguaaaucuuaaaguucccuuuuuuacuaugaugaucucuggacuuuauuucaucauuuguuucaauuugacuaauugaauaaacaaauccauccacccucauugccgucaguccuacuuaccucaucaauauuauuuggucucuugaagaguacuagauauaaaaagcucaagcuaaauaauuacucuccaaauaucucagaaaucuugauuccucuacuccuagugcaaauaugcaguaguuaugucacccacacaggauggacugcaacauuucaucaucuauuccuucaaucuuuuuucuauauaccauuguuuaagaugaaucauggccggucacgguagcucacaccuguaagcccagcacuuugggaggccgaggugggcaaucaccugaggucaggaguuugagaccagccuggccaacauggugaaaccccgucucuaccaaaaauauaaaaauuagccaggagugguggcaugcaccuguaaucccagcuacuugggaggcuggggcaggagagucgcuugaacccaggaggcagaggcuauagugagccaagauugcaccacugcacuccagccuggcugacagagcaagacuucaucucaaaaaaaaaaaaagaaaagaaaauuaauuguacuacauguacauuuuaauuucaguuuuuucaccucauguaauguaagcauuuccucauguugaagauuauuuuuaauaacuaucagauuuuuuaaaaccaggaaaauucuagagaaacugagauuuugugagucauaauucuacaguucucuuaaauucucagucuuucagauaucuauacuucuccaauguuucucuauuauaaaaacaacaguaauugaaugucugucccaccuugguaaagucaacaaacuuaaaaaaaaaaaaaaaccuccacauuuuugacagccgauuacuacuguacuucuguacuuuucuggggacauagaugguuucuggccagggaauagaaucagaggugaucgggggcguagaugguuucuggccagggaacagaaucagaggugaucuaaauacguauguggaguaguuuauuucuuccaccaaugugaccuccgucgucuuucuuuuugguaauuugcuuuuguacagaaguggaacagagaaugaacaaugguaugaccuacacgguauaauguggcuuucuuucuggaaaaucaguaauuaacucaaggaccaaauugucuuauucuaagauguuugucuucaaaacaauccucuucacuauuuucaucuuuuuauugugguaaauuuguacaugacaguauucaaagcauucucuuacuucagcaaccauucguuuaugaaguuccuguacauugccugguucacugagaacaugaagcugaaucagacaguuccuucccuuaaggaauccacauucugguagggaagauagagaaguaaacaaaugauuacaguagguacaaaagguacccuggaguccugaggaggacucaccucugcuuuagcaccugacagaggaaaugccugaauugagucuuggaggguggucagagauugcuaggugaagagauagcagcagaagcacaaacuaaugugcuaaauaugggugaacuguagucagucugggauggauaugggggauaggauugaagugaguagaguaggagaugaggauacuuacucugggccaacuagcgaagagucuuguugucaugcuuagaaggccauggucagccaggcauggugguucaugccuguaaucccagcacuuugggaggccaaggcaggcagaucaccugagggcaggaauucgagaccagccugcccaacauggcaaaaccccgucucuacuaaaaauacaaaaaauuagcugggcgugguggcacaugccuguaaucccagcuacucaggaggcugaggcaggagaaucgcuugaagccaggaggcaaagguugcagugagccaagaucgcaccauugcacuccagccugggcuacaagagcgaaacuccgucucaaaaaaaaaaaagaaggccaugucuuagaaagaugaccagcuggaauagaaagaauagacuggggagacugaggcagagagcugaauaaagaacuuuuuucaguaauccaaauuggaaauguuggggguuugaaguaggacagcagcagugaaaaugaagaggaggagacagacucaagauaaagauggagaauggacaggcuauacgaacaacuugcauguacugucuugaguaccugcacaggugguacuuacaacucucuaaaauaagagaauguaagaagaugagugcaaagggcgcuccuuaccuucugaucuuugcuuucuucagacuuuacugaggauguaaauaauggaaaauuguagaccuucucaaugcuggcuaaucagacuuucccuauuauuugguuuuccuaguucauuacccagauaaaagaaauagaaugugugcauuagauuuucugcuucugcuuggugaccuagagaugaucaucaagccuuuucuuauaagagguauuaaaugcaggugcucaguuugggaguauuuccaguauuuauugguuugaaguggauauuguaugaccaaaucuuaacugacgauuuuuguccuaccaguugaaugugcuggguuuugauuauuuuaaaccuaauauuuggacaguauuuaauagcuggaggcaaauuaauaacaugaugucagcugaggacaaaggacaugucugcaacaacaguagauaaauuauaagcacaugauaacaugaaaggguauaucuuacuaaaaugucagcucauuuggaggaaacucuucauucaguuuacuuucaaaaucuucagaggagugugucgaaagagccauggaaguggaagcagacagaaaaaaauugaagauguugauagugcugugucagcuaucuacagcuugcuauuugccaggaaccaugcuaagaacuuuucauacauuaacucacuuaauccucagacagcacuaugaaguaaguaccauuaguaucuccauuucauagcugagaagauugagacaaagaaagauggaguaauuugcccaagagcacccugcugauaaugauagaaccaggcaaauccaagcaggccucuuuccagagcccauguuccuaaauacuguaauccucauugucucaauauccuucccucuucuuaucacaccucccuggagagccuggcugagucauuaccuucuucuaggaggcucaccuugacucuuccccuaccuccagagauacuuuuguacuuuguacaaaauguauauauuucacugaucacacaggauauaaauauucauaucugucucuccuaccagacccgaucuuauuccucuuuguaucuauaccuggaauuugguguagugcauggcacagaguaaguguucaauaaaugcaagucuaguugaguuagcuucacuuaaacacacagugcuuguccucaaagagcuuucaauguaucaggaaaagaaaguuccauucacaugaaacaacagaauaagaaagaaguuugagcuaaaagaguguggguauagacaguggauauuaugagauuucaaugaaaggagauuggcuauggagauuguguuggguggauugaguugcauuggguuagauuggauagagauagcuucaccacguacauagaaucugagaugaggauggauuauaguuaagagaagaaaaggaggaagaacauugaucagaauguugaccugagguggcaaugaaugaaaugcuuacauuuaagggggugguagaguuguuuagaaaauguacgcugaaagaucuuccucauugagccagaucagacaucagcuccuuagagaggcugacccuguucucucucgagaccuuccuuccacaguaucuuguauaugcaugaccuucacaagaacacuuugcuuuguaggugucuguucugugugacugagcucccugaaggcaaggauuauuuuucaccaauaccaugcaugucuagcagauaacagugguaaaaauaauaauaauagcaguaacaauuuuauaauuacagaaguauauaauguugauuuuaauaaauaccuauacaaaauaaguaacauauuggauccuuauuguguucuagccauuuuucugauuacauuauauuaauucaaccuguguucuaguauuuuuguugaaauuuauguuuguugaacuuugccauccugugagguuguaacaucuagggaaucuuucauuguguaggugcuauuugaucaugaucuccgucugaauucugcgaaaugucuucacauacagcagagucuuagcugguaccagggagcauuggaacuuauaugguuuggcuguguccccacccaaaucucaucuugaauuguagcucccauaauucccacguguugugagagggccccagugggagauaacugaaucaugggggcgguguccucccuacuuuucucaugguagugaauaagucucaugagaucugaugguuuuauaaggggaagccccuuucgcuugguucucaucucucuugccugccgccauguaagacguccuuuuuuucuuccuucgucuuccuccaugauuguaaggccucuccagccacguggaacugugaguccauuaaacuucuuuccuuuaaauauuacccagucuuggaugugucuuuauuagcagcacgagaacggacuaauacaggaaccuaggauucagcuuccugcagaagggaaaugacaacauggcccaaccaaacagcuggcagucaggacaggccaccagucccaugaggaaacugagguacaaagcuggacacccaagaguaccaaggaguggaucucaaagcaaaacacacacacacacacacacacacacacacacacacacacacacacacacacagagcucuuaauuccaaaccaaaagaacugagccugcugaauaucucuuuuuccacuuaaagccuaagaaguaucugaguccacaggugggguuacugguagccccagcuauagguuacugaguaggagaaacaaaucaggaauuggcacagauacauacucacaugcuauaacuaaagaauuucaaacuuggaaucaaugugcuuuugcacauuagcgugacccccaaauuuuccaagcaccagcucagccuuuccaaauaaacugucuuuggaauaaugcaaguaaaauaauaugggcagccuaauaagcauuucaagcaggcaacaaauauuuguauuuucuucauaugcuacuuucauaguuucaagagaaaagugcuuuuaggaaaauguucaggcuuaggccaggcauggugacuaaugcuuacaaucccagaaauuuggaaggccaagguggaaggaucccuugaggccaggaguucaagaccagccucagcaacauagugagagcuuguauuuaaaaaaaaaaaaaaaagaaagaaaagaaaagaaauguuccagccuaauugaaaaaguacauagcaaucaaauuuuauucccagcuggcauaaaacuuucuaacugguagccaaauuugggaugccugaagacagacaagugacuaaugcuagggcuguguguggccaguaccaaauguauuuuaugaccacaagaccaugucuggauucuccuuuguaauuaccacacagccuacuguaauuuucaagcuuauauuuacuuccugccuuugacauguaauucaggguccaggacugcaccccgagcgagagugaaguccucucugucauuuggcuaaaaccuauaaaaucaucauugugugaggauguguguauguguuuguguugccacgucugcuaaauauguuaaguguaaucuugugaaaaauaugcccacuccugccuuguuggaugaggcacuuugcuugucagauguuuauugaacaccuacuacccuaugccagggacuauuuuagacucugggaaacauccgugagcaagagaaugaaggccgugcuuuccuggaagagaacgagggagggggaguggagaagaaagacagacagaaaaauagcacuuauggacaugugcuguguggagaacaagagugaugugauagagaaagucuguguggcuucuuuagcuugggacaucagagaaggccuugccaaggagaugacauuuaaacugacauuuuaaaaugacaagaaggaguaggacaggcacagagcaggaggaagagcauuccagacagguuaguguuaaggcccaaagacaggaggagcuuggcauguuccagaaacagaaaaggccagugugccuugagcacagugggagacaggacaacugagcagagagguugcguauuaauccauuuucaugcuguugauaaagacauaccugagacuggcaagaaaaagagguuuaauggacuuaacguuccacauggcuggggaggccucacaaucauggcagaagacaaggaagagcaagucacaucuuacguggaugcuggcaggcaaagagagagagagcuugugcagggaaacuccccuuuuuaaaaccaucagaucuugugagacuuauugacuaucacaagaacagcaugggaaagaucugcccccaugauucaguugccucucauuggguccuucccacaauaugugggaauucaagaugagauuuggguggggacacagccaaaccauauuagguugucagggacagagucacauggggcugucuaggccacugcaagaggcagacaugggagguuguggcccuucgugagggacacuaguuaggaagcaacugcagagggcugagcaggcggcaguagugguuuggaccaaggcaugaaguagagaaugagagaaggggcuggauauggaauaugguguagaaccagagucagcagaaccuacuaguggauuggaugugaggaaugaagaaaagggaauaaccaagaaugauuccaaaggcuuuggcuuugagcaacucgguggaugcugacugagaagaggagaaccaaaggcagagcugcuuggcucuucccugagucauaacugacaagccacaaaaauugggaacuuacaucuugggguccaaucaaugcccucaugacaccucccauccaauuuuacauugcuggacuguauuuguagaccuuuggaaauacuacuucaaacauauccaggguuucuccuuccuuuugguguacauuuugugacauaaaaaaaaaaaaacauauucgaguuaccuaacucuaccuugcuccaucccucaugggugcgcuguaaauguuaguucuugugcaggcuuccugcuucagcacaguucuggggcacccugggcaggggcaucuggaggucaaguagaggucugagaucaguccauuggucacaaguuggacagccggcauaugcuucuaacaacaucgucuauguauauagaaaauaauaugacuaguuugcuuguuuuucuacuuauaguuaggaaaauuuuguaaccucuuuacuaaagauuaaacugauuuaauccaauuguugcuuuauuauaaagcaaauguagauauuuucuacauuugccuuaaaaauauugugggguuggccgggcaugguggcucacaccuguaaucucagcacuuugggaggccaagacaggcagaucacuugaggucaggaguucgauaccagccuggccaacauggugaaacccccaucucuacuaaaaauacacaaaauuaaccaggcaugauggugggugccuguaaucccagcuacuugggagacugaggcacgagaaucauuugaacccaggaggcagagguugcagugagcagagauugugcugcugcaacucuagccugggcaacagagcaagacuccauuucaaaaauauauauacauaguggggcuuaaauuuucuugcuacacaauaggaauaacaauauaguuauucuucauggguauuuuguuaggaguaaaugaaauaauguauaugacgugcuuagcacuguagcugcuauauaacauucaguaaauuugagguauuauuaucaaugaaauaacaauuuggggcugggcgugguggcucacgccuguaaucccagcacuuugggaggccgaggugggcagaucaccugaggucaguucgcgaccagccugaccaacauggagaaaccccgucucuacuaaaaauacaaaauuagccgaggugguggugcaugccuguaaucccagcuacucgggaggcugaggcaggagaaucgcuugaacccgggaggcggagguugcagugagccgagaucacgccauugcacucuagccugggcgacaagagugaaaauccaucucaaaaaaaaaaaaaaaaaauuugggagcagaggagcucccagaaccaacacacagauuuuaauauucaaaugaaccagucagagaaaauagaacaacacauugauuuauuaaauuccugcaucacuuuggacaaaaccuacacuuucuuuguaucucaauugucucagguaaaugugagacucaggauagauagauaaccucaacuuuaaaacuucugugauucuaguagaugaucaauauuuucucucccaucuuccuuuuaccagacuuaucacaaaguuuugucuuugggucaucuaaaucaguauaagugauauuuauugccagaugugaccuuuuguuagcacacuggagaaucccaacgcuaaugucaauuucuauaaauauagauugagagugaggaaauguucugucucuagggaaguuuagcuauugagagucuuucucuuuuuagacucuuggucuguggucucuuacucacucgugacauucuuccccagucucacuuuuguuaccuuuuuauuucgugaucacugaugcugguagccaccuacaauuuugaaguuccccacucagccuucccuagugguaggcauugcauuugaguugugcuuucuuacuuccucuaccuuuugaaauuuaaaaauaggaaauagcaaacaaacccacagucuuucacaucagcugaacucuguuauucauccagcagauuuucuggugaauucucuggcacaacguauacagucagaaaccagcaucaguucagaauaaaugguguacaaaauuaagaaagagcuacuuuuauuuuuacucuuaaacacacgaucagaaaugggaggcagcagcauaggaggaggcuuugaaaaguaaauccaagggaaagacggcuccuagccuucuccuuggcuuuucuccuuaccuguccaacuuucccgagccaugaugaagagucaguggauugauaaagggacucucuuaggagucuaacucuugcacuaugaauaccaaagacaggcccugagaagcaugaaaacccaucauagccaugagcaauauaauuuccagagaccccaccccacagcaaacauacuauaauaugguaccugcccuauuaaauaucguuuuaggacgggugcaguggcucacgccuguaaucccagcacuuugggaggcugaggcaggcggaucacaaggucaggaguucgagaccagcguggccaacauggcgaaaccacgucuccacuaaaaauacaaaaauuagcugggccuggugguggacgccuguagucccagcuauuugggaggcugaggcaggagaauugcuugaacccgggaggcagagguugcaaugagccaagaucgugccauugcacuccagccugggcgacaagggcaagacuccgucucaaaaacuaaaaaauaaaaaauauauauauauauaauuuuauugcugucaauuuguuguuuuuuuuugagacggagucuugcucugucacucaggcuggagugcaauggcaugaucucugcucacugcaaucuccaccucccagguucaagcaauucuccugccucagcuuccugaguagcucagguuauaggcgcccaccaccacgcccagcuaauuuuuguauuuuuaguagagaagggguuucaccauguugguuaggcuggucucgaacuccugaccucaggugaucugcccaccucagccucccaaagugcugggauuacaggcgugagccaccgcacccaaccuugcugucaaaauuuugaaaaaauauuuguauaauuuugcuuuggaaauagguuggcuaccaguaacugauuuaauuuguaauugacuauuaguuucagcaauuaucuuaccauacugggaaauuuuuaugaaguuuaugaagaaauaaauccagcccuacauauuacuuccaaauuauguauuuucgauuaccggaucaacaauuaaugaaguuaacuucacauuugcauagaccuuuaacauuuaguaauuucaguacuauuguuauucuguuuugaagccaaccaaugguuuuuaaggucucagacguuuguuuagcucucugaaaagcuggaagccccgaggcacugcaccuuaaugcccagugguuaaaaaugcucugacugguuauucccaagcccugagaucuucacugccuucuucaaagaauaaaagcugguuuaggggacagcaagcuggcauacaaauauaccagucuacuccaagaaggugacucucuaagaaaaacaaaguaauuggaggcagaaucccuguguugcaauuaauucaccagguuaccuugaacaagagcucugcagcccuuucccugccccucaguacagcuugagcaucccuaaucccaaaauccaaaacccacaaugcuccaaaauccaaaacuuuuugagcaccuacaugacgccacaagcagaaaauuccacaucuggccucaugcaacaaguacacaugaguguuaaaaaugcugcauaaaauuagcuucaggcuauguguguaagcuuuauaugaaacauaaaugaaauucauguuuagucuugggucccaucccccaagauauuucaucaugcuuaugcaaauauuucaaaguccgaaauccgaaacacuucuggucccaagcauuucggauaagggauacucaaccuguagugccuuugcaaacaaacaccucaucuggccuaggugauggcccacagucaucaguucuauggaaccgaaagguaugccacaccaucugaaccagaaacaagggcuuccucucacacauugaggaaagccauuuuuaugucuguauuauuuugccaaaauuaaagaaggaagggaagggagaaaagaguagagaagggaaagggaaaggagaaggaaggagaaaggacuacaccaucaacauguuuagaaagcuacugaucuuuuggcugggccccguggcucaugccuguaaucccagcacucugggaggccaaggcgggcagaucaccugaggucaggaguucaagaccagccuggccaauauggugaaaccccaucucuacuaaaaauacaaaaauuagccaggcauggugucgugcaccuauacucccagcuacucaggaggcugaggcaggagaaucacuugaaccugggaggcggagguugcagugagccaagaucgcgccauugcacuccagccugggugacagagcgagacuccaucucaaaaaaaaaaaaaaaaaaaaaaagcuauugaucuuuaacuucugugcaaaauuacaaguaucuuuucuucagagagaauggcuuucaugugagauacucccaucaucccauucaaauguugucuaucaucuguuuuugguuugguuugguuuuucaguugggggccaaugggauguaacucaaagaacaucaguuucagaagcagcucaugcucuguucaaagccaguccugucacuaucacucagcaguucucaaagugcaggccagggaucucuagggugcuccaagggucuuucagaguguccauaaggucaaaacugucuuuauaauaauaguaugaucucaucugccuguuucacucucauucuuuucaugagugaauuuucccagagacuacaggauaugugauauugugacagauugaaugcauacgcagauauccaaauccaacuggcugcuaugaagccagacauucaagauauuuauaaaaauggaaaacaaugccauucuucucauuauguaugucuguguguauggggggggguguucuggaaauauaauuuuaacuuuuaaaauguuuaugguaacacguagugggauuauuacuguuacuuuuaauuuuuugguuuuuuuuuuuuuuuuuuuuugagacagagucucgcucugucaccagacuggagugaaauggcaggaucuuggcccacugcaaccuccaacuucuggguucaagcgauucuccugcccuagccucccaaauagcugggacuacaggcacaugccaccaugcccagcuaauuuuuguaguuuugguagagaugggguuucaccauguuggccaggauggucucgaucucuugaccucgugauccgcccaccucagccucccaaagugcugggauuaaaggcgugagccaccgcaaccggccuuauuguuauuuuuuaaugaauuuuaaauuccuuaaucuuaaugucuaauauguuaaauauugauaaauauaacccacauagaaaaagcuuaaaagaguucauaccuauaacuaaaaaguuugagaagcccugcacuaccuaauuguaaugacuguuuauugauuauugcuuuguaccaugagcugugcaaagcauaccacauucuucaucucuuuuaaucuuugccacaaggcuguaaagcagaggcuuuaaaaaagggcaccuugcuagcccagcgucucaccacuggacaagaaagagaucaccaggucgguucucugacucugaagccacacccuuggucacuuucucuauaacuuuaaaaaagauucuuuuuaacugcucugagccucaguuuccuuaucaaaaauagucagaaugagguaccccguaguguucucugaaaagcagaagaguuucuaugcauccaguccuuacaugggggccaacagcaaaugcucccccagaaacucuucaccucccuuccuuccauuccuuccuuuucuuugacguuagaccagagaggcuuaucaacucuccauuuuccucuagguggucuucaagcugacagagaagcugacggaacagaaggaguggaugaagauauaauugugacccaaagucagaccaacuucaccugccccauuacaaagguaccgcuuccuccuacuuccccugaaagaaacacgauucacuucacagaggcagaaagguuccuguuugcuuucugguuugauuucacuuagggaguuaaggagggaguaaagaaaagugcuggggguugaagaguauccacgggagguucuugggcuggagagagcugucagucaaucaugcccugaaggauccgggacuaaagucauggccuacaggccaagugacaguacugccacuggauucccugcauuuccuuaucuaaagccuaguaauuauguaaagccaugagaaugggaaguuaaacauagaaagcucaggacuaggacgaaacagcuacuggaaguugaucauuaucauuccugaaagcccaacaucuccuugauuacaggaggaaaugaagaagccagugaaaaauaaaguguguggccacaccuaugaagaggacgccauuguucgcaugauugaguccaggcaaaagcggaagaaaaaggccuagugaguggacgcagggaaggaaguggagccuucccuagugguaguuacucagagguggcguguucacgcuagaggaagaggcacuucaaugucucuucuaaauuccguucaccucccgaauacuguaaacauggaagugggcuuucuggaaaaacaauacaugagggaaaaauuaguaaucuguucaggaagaagcugagggaacuucaaccacaccuucaaaacagaauaaggccaggcaggguggcucaugccuguaauccuagcacuuugggaagccgaggugggcagaucaccugaggucaggaguucaagaccagccuggccaacauggugaaaccccaucucuacuaaaaauacaaaaauuagccaggcuugguggcaggugccuguaaucccagcuacucgggaggcugaggcaggauaaucucuugaacccaggaggcagagguugcagugagccgagauugugccacugcauuccaaccugggcaacagagcuagacucugucucaaaaaaaaaaaaagguuuagguaaauucauggcuaacucaugaaugauaaauuauuuuuuuaauuggaaguuuugcagaaucuuuauaaauagacauaauauauauuauauguuauauauuguuuuauauguauaucauauauuauuuaucuuuaaauauauauaauauacacacacacacauauauauaucucaccuuccuuccccuucuuccaugaccacggaggaccaugcucuguuccuguaauaacauagaauccugaguuagccagacugacuggcauugacuucguuuggcauuucuugugcucuuaucauggauuuguugcaggaauggaauugcaggugugacuaguucucaauugacuucugauaacagucccuuugauguguggcuugcuucuccauugcccagaaauuugcugguccagaccuagaauuggaauuccccagcacuccucaucuggguguggacuuagagauaauauauuggagacuaaagauaucuugauggucauucaggcaaauaacuuauccuauguauucuagaagaauaguggcuuugcugccuaaugguugcaaaauguagacauucuuaguacauuuugaucuguuuugaguuuuugaguuaacaguugaaaugucagauuucggccaggcgcgguggcucacaccuguaauuccagcacuuugggaggccgaggcggguggaucacgaggucaggagauagagaccauccuggcuaacacggugaaaccccgacucuacuaaaaauaaaaaaaaauuagccgggcgugguggcaggcgccuacagucccagcuacugggguggcugaggcaggagaauggcaugaacccgggaggcggagcuugcagugagccgagaucaugccacugcacccagccugggucacagagugauacucugucuccaaaaaaaaaaaaaaaagagggaggauucuggguuguuaaauggcaugcuuucuugcucuuucucuuuuuuuuuuuuuuuuuuuugagacugaguuucccucuuuuugcccaggcuggagugcaauggcgugaucucagcuuaccacaaccuccgucucccagguucaagugauucuccugccucagccuccugaauagcugguauuacaggcaugcaccaccacgcccagcuaauuuuguauuuuuaguagagaugggguuucuccauguuggccaggcuggucucaaacucccgagcucaggugaucugcccgcuucggccucccaaaguguugggauuacaggcaugagccaucgcgcccagccauggcaugcuuucauuaguuuccuuauccauaaaugaaugacaaucguuguaaucaccucauuggcauauuugaaauuuaaauaagauacaugcaaaguacuuaaaguagcugguacacaguagggcucaguaaaauuaucccaucaucaucuucaaacuugagccacuaucaacauccucuucguuuuuuuccaccauugcucuauaggcaugggagacgaggacaguuuuaaaggaguaagaugagccaaccuggaguuuaggaaguuacuccaauagcaaugcagagauggauuaaggaggcaugaggcaaaaaaaagucaguuaggaugcuuuuacagugguuuaaguuauagaaaauuagaguauagagauacaagagugauuguggagguacaguuaacgacauuugacgacugacugaauguaagagaaaggaagaagcagcgagggguggcugacauuucucaucugggugucuaauacugucauuugcucauuagccuccagagaaggcaugagagaggaacacucuuauuggaggauugugauagacucagcucaggucauccuaaaugcaaggucccagcaauacagccccguggaaguguccaggaagugcagcaagugugaguuuugcagucaggggaggacucagaacuaucgauguggauugggagguuaucaguauagacgagucaacccgcucaacuaccgucacagaugcagcucuggaacaaaugcauucaccagcagagagccagcaaggcaggacccgcaccucgccugugaucuccacaaggccagagcccgacuucguucugcucacugugaugccuuagcacccuggugccaacccucaaaaaacacuuuguugaccaaugagaggaucaaucagcggaagaagaccccuaaaaaagcagucuaaaauauagccaggagccaggaagagugauaaggaguggaggcucaugggaacuugugggcggggugggcaggguucugaaggccaggugcauuugggcagcaguagauuagaacucagggccuucuugaaaccaacuccagaaguuucugaugaagcaugaagucguaucauuucccaugaugcacauuagagugaugaguauuucuggguucgcuuuguuuagaaauguccaugacacauugucucauuucuuccuccuagauuguucuaguuauguuuguuuuuuuagacuggaguuccagguccauuguguucugggcacugccugaauuuuacugugcaagcuucaggcccugggaaggccucucugcacuggcuugagucagaauaauauuguugagacuuuagccccagccaagcacgguaguuagaauaauuuccuaaaauauaucuguuaacaauaagccuauuuauucucuuaaaaauaaagcugccuuaugauuuccuuuuuuuuuuuuucguuucuuuuuucuuuuccuuuuuuuuuugagacagagucucacucugucucccaggcuggaguacaaccucugccucccagguucaagcaauucucgugccucagccucccaaguagcugugauuacaggcacaugccaucacaccuggcuaauuuuuguauuuuuaguagagacaggguuucaccauguuguccaggcuggucucgaacuccuggccucaagugaucugcccaccuuggccucccaaccuuaugauuuucauauauuaauauuucuaaccugaccacagucacuuuuuugcuuuuuuguuugagaacaggaaacauauuuuuaaaagucauauuuaagagcauguagaauaaaaugaaauugaauagaaaugggucauucgacagcagaacuccagcuuugugcuuggaauuccuguuucaacacuuaccaacaagccauucaaccuuucugccucaguuuccucaucuguaaaguggaaauaacaucagcaucucacagcacuucaggggccaaagaaaugguagggaauuccauucuaggucuggaccagcacauuucuuggcagaagaguagcaaaagcacuuaguugaaagcucuuuugggagcgaagagcgcuaaacaaauagcuguaggguuguuaagaccgaggcugauagaguuguuaucacuccccgugcugcuuagugacacauuauuugacucagggguuguaagauagaauuacugucuguguugagguaugacaggaaucccucccacucagauuuccagaggucucuauagaccuucugucuauagcuuguagacuaaaccuuggaauucuugggacccagauccaggaacucccagaaucauguacuuuugagcauuugcagaggccaagguuccccacagcucugugggaccccaagacccgguucccuuugcucagcagucaccuuuguguuugcccugugcugcagcgaaaugcucugcccggguagugccuggagguggggacccagccgcuccugcgaggccugaagggcugacuccugcacagcgaugaugcggcagcugaagaucggguauugccacacugaacucgcucaccaagaugucgugggauuaaugccgaaugcuuacggagacaguuguuucuccagaggaggcaugccuugauucagcacuguggcaugauggccuucucuuauccuuucugcuuuaaaaacuuguguuuauuggagacgaaggagaaacaagguccuucccaguuccagcaucaaccucgccuccaggaagucuucccugagcccuuauucaugcuggacaaaaugucguuagcaccccaugucaugccaacauugucagugcagcuggcuccucuccacgagcuucuugagagcggaagcuguggacuagggcagggacuggugcacggcaggaccugaagugaacuccccaguccuugacacacaucagccugcuuauuucucagccuuauuggacaggcuuguccucugccuucauguucuuaaagggaaaaacugaggcacagagaauuuagucacuuacccagagugacacagccaggggguuuaagcccaggucuuucucauucuugagccugcaauucugucaguaggccauccagcuccccuugggagggcuauuugguucaugccucuaccaucagagucuaucuccucagugaacucagaccuuguuugacauggcucacucugggauccaucccacugaagugaaggugggcgccugcucugcagcugagugugugguuaaguccaucagacauucucagcaugcucucaugcacugacuaaaaccaugaugucaucaggaaguccuccccaccucacucuccacuucccucuccacugcuuauucacugucuggcuaugaaaguuaaggccuuugcuggguagaauggaagagaccaaggccaggcaguccaaagcagauauucaggguuauguuuuaagggagggucaucccagcaaccuacuuggaguugcauuucaaugucauggaagccaaaguuaugauacuuggcuuuucuagucacaaaagugucuguauccucuucaugaucuuagcugcuuuuuuucauacuuacagacauaauucaccaggcacgguggcucaugccuguaaucccagcacuuugggaggccaaggcagguggaucacuugagcucaggaguucaggaccagccugggaaacauggugaaacucugucucuaccaaaaauuuuuuaaaaauuagccaggcgugauauugugcaccugugggcccagcuacucaggaggcugaggugggaggauugcuugagccucagaggcagaggucacaguaagcagagauagugccacuccagucugggugacagaaugagacccugucaaaaaaagaaagaggaaagaggagagaaagaaagaaagaaagaaagagagagagagagagagagggagggagggggaggagggagggagggaaggaaggagaaaggaggagggggagggaaggaaagaaggaaggaagaagagaggaggaggaaggagaagagaggagggcggggagggagggaaggaaggaaggcaggaaggaaggaagaaaggaaggagaauucgcuuugagacuucacagcguagggggacaggcugggaaaaaaauacagauuuuuaaacuaguguaaaacauuucuccagccuugcccuaaugcaaagccaaaucaucaaaaugaugcauaccugggccaaaucacccugauccucuuucauauaauugccuuucuguaauuaugauuuaacacaucauguaccugaguauguagggcacuuuuuuuuuguuuguuuuguuuuguuuugagacagagucuugcucuguugcccaggcuggagugcaauggugcaaucuuggcucaccgcaacccccaccuccuggauucaagugauuuuccugccucagccucacgaguagcugggauuacaggcaugcgccaccacgccuggcuaauuuuuguauuuuuaguaaagauaggguuucgccauguuggccaggcuggucucaaacuccugaccucaugugauccaccugccucggccucccaaagugcugaaauuacaggugugagccaccgugccuggccauauuuuaauauuuuaaaaauaaauacuguuauuaagcauauuauauuucauugauuaauaccccucuaauguaaaaacuccuugauccacagaucagggccaagaaauacuuucuuucauguuggacuguugggcuuccuaccacuagacaaauuggagcucccaugaccaacuuucuuuccuucugguuugcaucuuuacugugguuugcacauuuguuguuuuuggucuuaauauccugugcuuuauggagagcugucucagaucacugggccagagcucugugugggcaggaaccauguauuuguauuucacaguugcaugcuuagaaccuagcauagggcugaucccuagaagagucaauuaaugcaugaaugggugcaugccugugugggauauaugcaagauagaaauagauccagaacuuuaaaacuucuuggaagaaugaugaugagggaacacaugauagucacaggggaucuggaagggaauuaacauuauugagcacagaggaucugggagggaauuaacaguauugacugucaccuugggaaauaaggguucucuccccauuuuaacucagaggcaagggaggcucaagaggguuauugugaauugccuguggucucauaacuagcaaguaggugguagagagaaaauucagaccuagguuagcuugacuccaaacauugggccucuaaucuaccaaaauuugguucacuuugagaaccagauucuuugagaagaaauaggugguuucauccagcccacugcccucagagaagaccacaucgaagcagagccguggcuuguuuccaccccuuugugggugacucacugaugucuuuagcugcagccuuuccaccgagucccaguggcccacucagucucucuucuaggagggcuacugggcauccauuccagaggaaacagauaccaaccaggacugugguucugugcugcagccuguuuugccccaucguuucccacugugaugaagggcacuaccagucacugaucuacccagaugaagcucgcuucuucccuuucgcuuaugcuccacagccacuccaucggcaaguccuauagguucuauggucaagcauguccugaagcugaucgccauaccacccucagccgagcugcccucaccucucuccugcacccugcaggaucccccaugcuauuuucccugcccuucucuuaccucccuguuuuguauucuccauaagcagccagaguaacauuuuccagauguaaaccaaacacacuccucacccaucucaaaaccuuccaguguuuugucuucauauuuaaaauaaaauccaaguccaggcacgguggcucaugccuguaaucccagcacuuugggaggccgaggcagguggaucacuugaggucaggaguucgagaccagccuggccaacauggugaaaccccaucucuacuaaaaauacacaaaauuagccaggcaugguggcaggcgccuguaaucccagcuacucaggaggcugaugcaggagaauugcuugaacccaggaggcggaaguugcagugagcugagaucacgccacugcaccccagccugggugaaagagugagacuccaucucaaaauaaauaaauuaauuaaauuaaauaaacuccaaagccccauuggcgcacugaccucacuuccaacugcucucccucuugccugggucgcugcagccacauagagcuugcugucacuccagggcaccaagcuggaacguccucagcacugcacuugcuacugccucagcccagaccacaugcagacuuguucccacgcuucauucuggguccugcccuagauaagauguguucggugaggcaugcccugaguccagccagugaagcuguggccccagcacucucucucccugacccugcuuuguugcccucauagcccauaaggugaccugaacuugcagcaagcauuuauuugguucccuagugguugccugucuuccucauuagaaagauagcucauaggcugggcgcgguggcucacgccgguaaucccagcacuuugggaggccgaggcgggcggaucacgaggucaggagaucgagaccauccuggcuaacacggugaaacccugacucuauuaaaaauaccaaaaauuagccgggcgugguggugggugccuguagucccagcuacucgggaggcugaggcaggagaauggugugaacccgggaggcggagcuugcagugagccaggaucgugccacugcacuccagacuccgucucagaaaaaaaaaagaaaguuagcucaugauaaggcaggcacuacucacauaucgcuuguguccccagcacccagacagggccuggcucagguagggacucagugaauaaaugaaugagcacagcuugguccugauuuugacacuuuuccuuuuucaguaaaaugccuuacuuaaacacuugaguauaaaagaaguuucugcuuaaggcaguaaaggggacugacuugauguucuuucuuucucacaguugcccucaaauuggcuguagccacacggauauaagaaagucagaucuuauccaggaugaagcacuuagaagggcaauugagaaccauaacaagaaaagacaucgucauuccgaguaggaaaagccaccugccugcagggacaccagcagccuaccuccuaccccagcugucuguugagagcagugcugaccccagcaguuagggacuggcugcauagcauacuuguuggggguaaaacuuguugcuuuuaugugugcuugaaaacauuuuucaaaguuacacaacagaaaugcaaucauauuguuuauuuuuaaguguucuauaauguuaaauaaaacuuugaucaucugcagu

SEQ ID NO: 17784 - RNA, 857 nt, Homo sapiens
guagaaagagaggaaaggauggcugaggauugaaccuggcaaacccauggagagaaaagaggaagcugauggggaaacgagcagaguauaaagaaucuaacauauuugaucccguagaaucaaagggaagaaaagcaauauggcagcaacagacagcugaagggcauauuggaugggcuccugguucaagguguugaccugagcuuacauaugagacaccacauguucaccaccaccuccaccaucccacuccaguuguaucaccucuaaaguguccaaaugaaauuaguaggaaaaagucuuuaucacugcagaccaccaagaaaagaugccaugcaaaugccuagcuuaacaaaacuugguuccagcaagaacuguuagcuuaugguucaucccaugcuaaggaggacccugccuggaaaguaaacagagggcccucugaccagugcucacaaauacccuucagcuuacaacagcaggagcuagagaccugggugaacuacagaguaguuguggaagaggaggggggacauauuuugaaaugucuggagccucugguaauuacauagguacuagagaacagagucccccacucacagcacaaacgcauacccaugcgauggcucagaauucucaccugguuuacucucagcaaagucaggcuaacugcagaagagacagugcuagcugccugugggucacagugauagacaaggagaggagagucaucuuuaagcugcagucacuuuuuuuuucuuuugcuggaaccuaaaaguuuauaucaaaaacccacaacauuuuugauagaacacucacaauucucaauauugguuacauguagacucuaucuggguaag

SEQ ID NO: 17785 - RNA, 2638 nt, Homo sapiens
uaauaaggaaaaugauuuauuccuggggcucgaccugguuuuagaaaauuaaguauuuagcagaaggacaaguaagggcucucuaauaauaguuauauuguugggugcccagggacuccaaacugaccugguucacucaagaaagaaaaaugacagauuccaaguuguuucacgcgcaacuuugaugcucuuccaaaucacacggaaugaaugcaugcgcaccaccaggcagggcugcccgggugcaggcgguaucucuggcaguggccagaaugacuuccaccagccuacccaccuacccagguuggcacucaggcccuagacccugcggcgcguguggaggcuggggagggaguaggaauccggcggcagccacgugggccccuuccgcccgcuccccacauccuuuguuucccaccggcccuggcucaggaagcucuuucugcgagucaccgcgaaggggcggcccgggagccuggagaagcuauuuccgugcaauccgggcgggcggcaggcgcggggggguugggggggcguggagguggaggcagcgcagaaggcccaguguuugcuuuuauuuccuccaacagaagguucuauuuguggaagcgaacagacgcuggggauuagagcugggagggggcaggaaaagggaaaaaaaaaagccacauccacuaccacgcacaggucuuccccggaacuaccgcgugggggugaaugacugauucuggaauucaucaccucccuaucccccuccuuccuccggcugcagccgggccucggcggcgcccacggcuccaaccggagcuccccaggcgcugggcgguggggggauccccggggcgaaaggcgucgccgcggggcugcagcgagcggcgggugcagagaaccguggugcgcgcucccgccucgcgcccgcagcccauugugcuuacugugaaugaggcgcgcgcaccaaucagcggucgcuucgcuccccgcagccccgucccucccgcccacuuccccgggcccuuacgucacgggaacuuuuccuccgcccccuccuucggcuucuccgcugagcugggggccugcgggagggcgcgcgcgccgccuccugcccagccccucccagcccugggggcgugugcgcgcguccaggccggcccgggacgcaccaccugcgcccgagcgcgcgcugcccggagcauccccagcccuaaguccacccccauuccccccaccuccuacucccucuccccuucccccagucuccucccuccgcuccggagacugcucgcugggcggcggggccggagucgucgcagccaccucauugcacaacccggcuucccaacuguuuacacagcccggccugugaguguguguguauacagcgugagucaccaggaggcggaggagguggaggaaaaggagaaggaggagugcacuggccgggaucggugcagcgcucacacucacucacagucacucucucugagcgcgucucgcucgcucucauacacgcccggagcccaggagcgcucaggaucccgagcgccgcgaaaaaguucccccggcuuuugcuggagacucaucgcuuugggaagugcauuugcuucguggcuccgccgagccugcugaauccuguccucgcggcucgggaccccgggaucgcugaccgcugccgccgccgccucugccucccggacuaucggcagccucggcaacaauaguggcggccgcccccagcgaggcuccgggagcccuugccugcggggguccggggacucgagccggccuccgccucccggacgcacagccagcgugguccccgcgugcaacgcgagcgccggggaguggcuccugcuuugccccucgugggggccgagccaagaccagucugcaaacuccaucccgccggcuggaagaagucgcggagccggcaccaaacccgcagcgucuucccgcgcggaucccgggacuuaaaaagccggggccaccccggcccaggacgggaugcgggucgguccggugcgcucugccaugagcggcgccucgcagccccgcggcccggcccugcucuucccagccacccgaggcgucccggccaaacgccugcuggacgccgacgacgcggcggcuguggcggccaagugcccgcgccucuccgagugcuccagccccccggacuaccucagcccccccggcucgcccugcagcccgcagcccccgccugccgcuccgggggccggcggaggcuccgggagcgcgccggggcccagccgcaucgccgacuaccugcugcugccccuagccgagcgcgagcaugugucccgggcgcugugcauccacacuggacgcgagcugcgcugcaagguaggcgcucccgggccaggacccggcuggggucgggggcgcgggacggggugguaggcaaaggugcuugggguccggccaacgcuugggcugggcacagggcggaucaguagauugggucagauaagacgccauuugaccagguucacguuuuuguggaucgagggguuucccauggagugauauaaugggggcgccuagaggaagugcaguguucaguggcuuucucuaucuguuccuuuccucagcgcccaguguagcgcguggcguuccauau

SEQ ID NO: 17786 - RNA, 8526 nt, Homo sapiens
gcugagcugggggccugcgggagggcgcgcgcgccgccuccugcccagccccucccagcccugggggcgugugcgcgcguccaggccggcccgggacgcaccaccugcgcccgagcgcgcgcugcccggagcauccccagcccuaaguccacccccauuccccccaccuccuacucccucuccccuucccccagucuccucccuccgcuccggagacugcucgcugggcggcggggccggagucgucgcagccaccucauugcacaacccggcuucccaacuguuuacacagcccggccugugaguguguguguauacagcgugagucaccaggaggcggaggagguggaggaaaaggagaaggaggagugcacuggccgggaucggugcagcgcucacacucacucacagucacucucucugagcgcgucucgcucgcucucauacacgcccggagcccaggagcgcucaggaucccgagcgccgcgaaaaaguucccccggcuuuugcuggagacucaucgcuuugggaagugcauuugcuucguggcuccgccgagccugcugaauccuguccucgcggcucgggaccccgggaucgcugaccgcugccgccgccgccucugccucccggacuaucggcagccucggcaacaauaguggcggccgcccccagcgaggcuccgggagcccuugccugcggggguccggggacucgagccggccuccgccucccggacgcacagccagcgugguccccgcgugcaacgcgagcgccggggaguggcuccugcuuugccccucgugggggccgagccaagaccagucugcaaacuccaucccgccggcuggaagaagucgcggagccggcaccaaacccgcagcgucuucccgcgcggaucccgggacuuaaaaagccggggccaccccggcccaggacgggaugcgggucgguccggugcgcucugccaugagcggcgccucgcagccccgcggcccggcccugcucuucccagccacccgaggcgucccggccaaacgccugcuggacgccgacgacgcggcggcuguggcggccaagugcccgcgccucuccgagugcuccagccccccggacuaccucagcccccccggcucgcccugcagcccgcagcccccgccugccgcuccgggggccggcggaggcuccgggagcgcgccggggcccagccgcaucgccgacuaccugcugcugccccuagccgagcgcgagcaugugucccgggcgcugugcauccacacuggacgcgagcugcgcugcaagguaggcgcucccgggccaggacccggcuggggucgggggcgcgggacggggugguaggcaaaggugcuugggguccggccaacgcuugggcugggcacagggcggaucaguagauugggucagauaagacgccauuugaccagguucacguuuuuguggaucgagggguuucccauggagugauauaaugggggcgccuagaggaagugcaguguucaguggcuuucucuaucuguuccuuuccucagcgcccaguguagcgcguggcguuccauauaaguuguggaauugaaauggauuccagggccaugccauuccccuucucucauucuccucgcucuccacccccccucccccgccaauguccuggaaggacgcccuuuagugggugccuccuaggagcuuggagcagcuggcagcucucuugccgggcuugcacggcacccgggcucaguuguaggugguaagggggcuggaagacuguguccggcuccugccuuggggauuccgaauugaauccgcgcugagacuagaacacgcccucccaagggagcagucccagagucauccacccgaggcggaggaaucugcucggaguagaaauguugaaaagcccacaccggccaggaacccucgcuucgauucacuuuauuuuccagccagcgauuuuccuuugaacauagggaucccauccaggaggaggagacacagcuccuagaaacaggauccgccggguccuccuccugcgcggguagacgcagaacguucccacagucuacuuuaugcgagcguggcaccccugcuugaggcaccccagagcacccucgggccgcuccuuuucacccgaaagauaggaucaccccccaguuaagucgcuucuggguuuuccgcaacucaccugacacucccaacaccccgaccccgucccggggcucgcugcugccaccuacugcccaacccgaaugaaauuucagacgcaugaucaagcccaguuuaauagggaggaaaaaaaaaccuuuucuucuccaugacuggggcuaagagcuguucugggacaagcauguauguguguguggugggaugggaugggauggggugggaggagggggcagcaggggauuuuucuagcuggugccagagcagccaggccucuuagagguggggugagucuggccauugugcaaccccuuccaguuccucugagcagauaauagcugaauccagauggugacagcccgugugucaccguuuccaguugagucuaggauaugaguaacuggacugaacaaaaggccuuuaaagagaccagccagcuuccuagaagagaggagaugcuacucauuucuagggguggggucggguguggggggauaaacaaacaaguggaaaacccauucgcaggauuccauacccuuccugugagaauuguaacucaaggcugcuuacacuugagucggacuguaggcagguugcuuaaggcugcauugucccagccucccccuccaagucaucuguuccuucugauuaaugacagcucugcauguucucuggccccugcuuccccuuggaggcugcagagucaccacauucugugcccuuucuguguugagcacuuugggucugcaggaggcacaugcacguccagggacugcuuuucagcuccuggacaggccaggggcuuccuucuaucagccacucaacuaguguggccugcaaacaggaaagggccacagagggugggggguuugcuuagcucucaggagcugacagaagaugggaacauguacaggagacaguucuuucaaaucaucugugugaaagcggguaacccuuuggguauuugcaagucuagagcuuuagguguuacugguuuuaaaggugucaggggcagcuggggcugcguaagguaagguggcagaggaaaggaguaggugaauggaacuuacucacauccuaagcccacagguugagaacuucuguucagcucccucagggguuugggaggcugccuuugcuuuucuagcccccuaaacgggccccccuucucucuacagguguuucccauuaaacacuaccaggacaaaaucaggccuuacauccagcugccaucgcacagcaacauuacuggcauuguggaagugauccuuggggaaaccaaggccuaugucuucuuugagaaggacuuuggggacaugcacuccuaugugcgaagccggaagaggcugcgggaagaggaagccgcccggcucuucaagcagauugucuccgccgucgcccacugccaccagucagccaucgugcugggggaccugaagcuuaggaaguucgucuucuccacggaggagaggugagcggccgccacagcuucuccuguggccuuuuggaaccaaagcggaggugcaggucauguaguuaggugcuguguguuggugcaaaacaaagucaagggcucauaugucccagauuuaguauuuagagcuucuguuccugaggagucacagccaagguugguuuauucugcauucucuuggacggggccuggggacaccguggcgcuucuaugggauggcaaguguugacagggugcucuuccucuccuaccccaggaucagguucauuccccauuguugucagaaaggucaguugucugggguacaaauauuaaacugcccuuuacgauauugccuucugaaggaaguguucaaaucuuugcuuaugccaagugcuguuuuguaccuggaagguuucacagagcuagugagacugucauauaugcagaauuccacccucuuguuucacacagcauuccucucccaucccaguccagguucucuguaacaucacauucucuggugacuuuuuagacagcuuguuuggauccgucuucagaaaauagccacauugaauaguaaauggaaguugguuaggauggauugcuaaauauagaucauagcuuaccucauaaagaacaagaugagcuugauaagagaguaaugaggcauuaagauucaaagcugagguuucagcuagagaauucaggaagccgcaugagauagaccacacuugauuuuaagagccagccacaucccuuguggaaagauuacaagcaguaaggcuguaacauuguagaggugagagugaguuaguuuguuguaagaagugggcuuaucucaccugugcauuuuuaccuuugacuccagagcauaugaaacaguacaggguugagcugucauaaagcaugacuuuguaucugaccucgcaauaauuauuggaacacacugauuagcaaagaaaagcaaacuguuggcaaugaagaaguuucuaauuccuggaacaugcuccuuugauauggugaugcauuuucugaaacaugccuuacacaccuccuuacuagcuuuugaaaucugcauugcacaggcgaauaucaugggcaugggguuuggcaacccggggguuaagcaaugucaggcugacgcuauucguguaaccagcacaggugcaggguuuuagugcuguagcagccaaucaggggcagacaguguggguugagucauauuuuccguuuacagaaccaauggguauuuuacauaacgacagggaggucacgcugaggacauacugaaguuagcacauguauacuacacuccagggaacaggaaggcagaaaaaaaaaaaaacagaccuuugagaggaaaaggaauugacccaucagccaguaccaaauguuugcauuuaacuucacaagugacuuacugaaacggguauuucagagaagcaggcagagacagggugucacuggauaucagagcuuccccaccacauggcuuugagcuuugggggauccaggagacuuggguggcugguucugaauaaggaggcaccugcagcuucauaagagagccuuugacugaagguguuuuagacuuucguuguuaccugaacagagacccccccuguagaauacauaugcucacauguugaugugccaucccagggggagugugugucccuguguaagaauuucagggucccugcgucccugaaauccaucagccacuuuuguuugcucgcauaaccucucuguccaggcaaaguguucuuugcaguuaaacaccccaauaaauguaauuaacauuccuugcaacuuucccauccuaauuguugcagccugggcccaggaggacaaaguuugcucugugugcauguaucagugugggcaccagcgcugaugaccuguguguaauagcagugacuuugggcuccguguucuguaaugcaguguggguccagguagcccuggcagucauaagagggaagauggguucguaggaugcucaggcccucucugaagaaguaggauaugcugcucuucccugcuagcuuuuguagagaaugcagcauucugagacaggcucccaguucugcaaugggaacuuaguaaauugcguaacuccuauuaggauaucucuuguaagcuccagcauuaugaauacuauuuggggcuuugccucauacccuccaccccaggcgcucugccgauacuuugcaaacauuuauugcaguucguguuaguuugugaaaucaggagcccucgguaguugcagggcacugcuuacuggacgaagggguaaauagcauuccuggagccuuugcuguuagugccugugggcgcuguuauugggaaggcuuuguuuuucauagcagcugguguggaaauaauggcuugguuccucucucuugcagaacccagcuuagacuagaaagucuagaagacacacacauaaugaagggggaagaugaugcuuugucagacaaacauggcugcccagccuacgugagcccugagauccucaacaccacugggaccuacuccggaaaggcugcggacguuuggagccugggggugaugcucuacacccuucugguuggacgauaccccuuccaugacucagaccccagugcccuuuucuccaaaauucggcguggacaguucugcauuccugagcacauuucccccaaagccaggugccucauucgcagccucuugagacgggagcccuccgagagacucacugcccccgagauccuacugcaccccugguuugaguccgucuuggaacccggguacaucgacucagaaauaggaacuucagaccagauuguuccagaguaccaggaggacagugacauuaguuccuucuucugcuaauccccaaaaccucagaaaccucauaauucuuaacaccuggcauuuccauuucuaaagauggacaggcccuuuggcgugguaccaaccagauaaugacugcaucaggaugaaagcugcugaacucggcauggcgccuccucuucucuguugggaugagugacuuuauugauuugagcagcauaugcugugauuggcugcccugcaaauuuguuucccuuaaggaacccucaccaacuaucucugcuggauuugggaguuccgcaucuuuuguggagggcagaguauggacaucuuacacccgguggucaaguguguaauaaacuugagcauucgaaugggagaaaaagcaaaucgcacaaugacauauuuugaguaauaaccguauuuuucacagggugacaaauugggccaauaaaucugccaucuuugaacucaucuuugguggcuagacugcuacggcagcuucucugaugggaaaguuccuuuuuuggcuuaacacucacccuuucuucacacucacauuuaccaaugacucugcuccguuuuuggagcagacuguuuuaaguugcucaggagccugauggaaccaugaaccgagacucuucucuguuuccugccaagaccucaucugcacuaaugccuucucccugaccuugacacuucccccuuuagcuauaaaagcacuuaccagccgaacguggaacaguaucacaaaagauuccaucucccaacgauuucagaacucugagcucagagagacuccagauuuuaaaaaauaauuugagugcuuggaaacuauuagcuuuuuaaguuccuuccaaauauguuaguaccuacccuuuacuuuuuccccaagaccaucucaggguggagcauucugucuaagagaagaaagauaaggaggcucccacccaccucucccaagagcagacauuaaacaucuuugugcuuugaagagagugaauuuuggauagucuugugauucucagacuaacuuccagaauuauacuuuaaccccucccagauaugguccgccuuuggcauuguguguacaucugcaguuuugcaugguggguuguuaauauuucaaaugugugguuuaugaauacgucuguauaaucggcuucuggagugaaacagcaaaccccaaaucuucaaaguuggaaggaacuuuaaaaaucauccgguccaaucucuuuccucuuucugccaccucccaaggcagaaauccccucuucagcuucuuuuguaggugggaauccagccucuguuagauauguccagagauggaaacucacuccccuacaaaagauggagcuuaauggagaaauugcaacuuucauuaaaaaacaaauucagaugaaauaucaguaacugucuuggacagugcugaaaucaggugguuaaacggguaaacaaaauauacuguauuuugagaaauggcacaaaaacaggcagucaucuuuaagggcuaugccuaggcaaacuacuaacaugcauugugagaaugccguguauaccucacguacuguguacuuuguacauauauuuuaccuuuuauaccuauguucgauuuuguuuuguuuuguuuuguucuggcuuugaggcuuguuuuguugucugugucugucugaauaaccugcgugucuaaaaccacgugaaaugugaaugauuauuggcaauauuaccuugacagaaucaugggacuuugagaagagggaggacagaggccucugucgcacuaacgcucucgugguugcucgacuguuguaucugugauacauuauccgacuaaggacucugggcuggcagggccuucugccgggaaagcuagaaacacuagguucuuccuguacauacguguauauaugugaacagugagauggccguuucugacuuguagagaaauuuuaauaaaccugguuucguaaauagguguggugaauuucuuucgaguuccaucugcuuugccuuuugcaauuucaugcagagguugcaaaggucucuggccucag

SEQ ID NO: 17787 - RNA, 1396 nt, Homo sapiens
gugagugagagcauugguggguguugggccggaggaaagcaggaaggcccaucggagcauguggauuugagccaccacauuuuuuaacccuagaucucgaaaugcaucgugauuccuguccguuggacugaaagguuuauguaggcaaucuuggaaacaauggcaacaagaccgaauuggaacgggcuuuuggcuacuauggaccacuccaaaguguguggguugcuagaaacccaucuggcuuugcuuuuguugaauuugaagauccccgagaugcggcugaugcaguuccauccccgagagcuaaauggaagaacacuauguggcugcuguguaagaguggaacuguccaauggugaaaaaagaaguagaaaucauggcccaccucccuccuggggucgucgcccucaagaugauuaucguaggaguaguccuccaccucgucgcagaucuccaagaaggagaagcuucucucacagcuggagcaggucccuuucuagagaugggagaagagagaggucgcugucucgggagagaaaucacaagccgucccgauccuucucuaggucucguagccgaucuaggucaaaugaaaggaaauagaagacaguuugcaagagaagugguguacaggaaauuacuucaucugacaggaguauguacagaaaauucaaguuuuguuugagacuucauaagcuuggugcauuuuuaagauguuuuagcuguucaaaucuguuugucucuggaaucagugacacagagguguaauucucuaugguuugaaauggaucauaugaggcauguaauaccaagaauuguuacuuuacaauguucccuuaagcaagauugaauuugcuuugaacuuuaguuacgcauagacugacaauaaaccucuaaaccugcccagcagaagugugauuuuuuuuuuuuaauacagaagcaacuggcaaaaauugaacuaagauuuacuuuuuuuccguagcugggauauaggaugcagcuauaguugaacaagcagucuuuaaaaacugcugugaaacacaagccaucagguaaaaauaaacgcugcacuauuaaauuacagguuuuugaaaaauccaacucacuuucauccugggcagagguugccuaguugguauagaaucuguuaaguuucaagaaaguuugccuuugcuuuaggucauaaguuacuuauuugauugcuguauaugaauacauggcuguucgugacauuuuuuaugugcaaauuugagauuucaaaaauguccugccaguuuaaggauacauuguagagccgaacuuugaguuacugugcaagauuuuuuuuucaugcugucauuuguaauauguuuugugagaauccuugggauuaaaguuuugguuacaaauuguuguu

SEQ ID NO: 17788 - RNA, 4089 nt, Homo sapiens
cgccggucgagcugauucugagcgauggugagccggggccagcagggacagggacgcggcugggucccuggggagcaggagcaguaccagguguagagucuggggaagugcagugcucugggccaggguccaauaccaacuuuauccgcccacccgccgauucaggguccuaaacugcaaauaugaugaugagcgugacaaccuucaggccccacagggaauaacugggugaacaggucuggcccaggccacagggggcaccaccuggcaggucccaucccagcugccaggucuaggugagcacugagggccucugcugaggcagcuccuccgcucgcuugccuuggaccugaugguauuuagcaaacucugagcaccggacagcgaaccccaugcccagcggaccacaggggccccuccguggggcgggcauuggggcggugcucagaagacgcucguggagcaaauccacuacugagcggcaucgugcaccaggcaucaagccaugcacaaaacauguccccguccccgcuucccgucugugucuguagacaaacaaauuacuaagaaacagugaaagggugcgugugagauauccaaggacugggaugcaaagguggggcgggcccggaggaggcgagggaggaagcuggccaggucauugcgggcagaagacucagccaaggcaaagagcgcgaggccagaccacgcguuagggccgagccagccgcugggcgcccgggucagcccgugugcugcuccgcagagacgcugcccgcgccggaguucuccccggagccggaguccggcagggccuugcggcugcggugccuggcgccccuggagggcgcgcgcuucgcccuggugcgcgaggacaggggcgggcgccgcgugcaccguuuccagagccccgcugggaccgaggcgcucuucgagcugcacaacauuuccguggcugacuccgccaacuacagcugcgucuacguggaccugaagccgccuuucgggggcuccgcgcccagcgagcgcuuggagcugcacguggacggugagcuggcggggcaccagcgagggcgggcgcggguucagugccccucggggccuccugucuuuccccucuuuccuugggcguccgacggcggcgcucugggccuugguucagcccccaucgccuaccccggcggggagcaggcgaucgguggucgagggucuggggacgccuggaauuucggcuuauuucccacggacgcaagcccguaggucacguguagcgugguggucggcagcagggaggcuggccccagguuuucuuguucagaucccugcagcucuguggcugccuuguuuuauuacuggccaugucagucgucauacuggaccccccgccccggccccggucccgcaggcgcacggcugauguguccuucuccccauccccgccguccccagcucuguuugucccucugauuuccucaucgacgucuccaggacucagagcccagcagagcgugagggcacaggucugaccuccagaucuugaggucguacccuuugcugggagcaccguuuucucuuuucuuucacuuucuuucuuuucuuuccugccuuccuuccucuuucuuucuuucucuuuccuucuuucuuucuuccuuccuucuuucucucuuuucuuucuucuuuuuucuucuuucucucucucucaucucugccccccaaccccaucucucuccuucauuccucccuuuucuucuccuuuuuguuuuuuuuuuggauaacuuacuuuuauucuugcaggccggagugcaguggugcagucucagcucacugcaacuuucgccuucuggguucaggcaguucuccugccucagccuccugaguagcugguauuagaggcgcaugccaccaugcccaccuaauuuucguauuuuuaguagagaccggguuuugcuauguuggcugggcuggucuugaccuccugaccuugugaucugcccgccucugccucccaaagugcugggauuacacuugugagucaccaugcccagccuauucuugcaguguuauaagccaccauccacaauugaugaaaaauguuuaaucuuggccaggcaagguggcucacgccuguaaucacagcacuuugggaggccaaggcggguggaucacaaaaucaggaguucaagagcagccuggccaacauggagaaacccugucucuacuaaaaauacaaaauuagccagcugugguggcacaugccuguaaucccagccacuugggaggcugaggcaggagaauugcuuuaacccgggagguggaguuugcagugaguccaggucaugccacugcauuccagccugggcaacaagagcaaaacuccaucucaaaaaaaaaaaaaauguuuaaucuuuaaauuguacaucuauauccuaugacuccaaauuuuauuuaucacucuccuuaaagucugaagaaaaugauuaauuuacuaagcuccaaagacaacacagucccacugacauaacauuuaguaugauguccuacucuccuguuagaauuaagaacagccaguaucaaacuggccugaaaucugauuggguuccugggcucagaauaacuguaguaaauuuguaaauccacacuaagacacaaaauuaaacuaggauguguauaucuaucuuacaagaaaacguuucacaguaaaaauuaacauuaugauuuuaccaaauuucaacauuauaguuuguuaauccaaucaagcuuucaaaauuccugauuagcuuacaauuaauugcaaauaacuucauguaguuuggcuagcauuucaaaauggauagggaauauaacuuuuaaaaugcgaaaguauauuauacauauugcacuuuucugcuaggcugggcuaguaucuuccauggcaagauacucaaacuauugaauaaaauacacauuuaaaucaagcacuuacauguacuucauuaauuucccugaaauuaucaacagcauuaccaaaaucuuccaggauuuuguaacauuugauuccuuacaguuuuguuuuguuuguuuguuuuugagacggagugucacucugucacccgggcuggagugcaguggcgcaaucuuggcucacugaaaccucugccucccagguucaagcaauuuuccugccuccaccucccgaguagcugggauuacaggcgcacgcugccacgcccggcuaauuuuuuguauuuuaguagagacgggguuucaccguguuacccaggcuggucuggaacuccugagcucaggcaauccgccugccucggccucucaaagugcugagauuacaggugugagccacugcgcccggcaccuuaaauacacuuuuaaaguuaaacuuauggagggaaaacccucaucuauugacauagauuguauguccuuuuuuggucccuccaugaaggagcaccguuuucuccaucauuucuucuucccuucacccgucagagugaccgaggcuggggaccccagaagccccagagcaggcccgaaucugggacuuccacgguccugggggaggggugcggggacacucacguguggcgcggauguccggggugugaaggcagcgggcgcagcucggcggcgccggaggagcccucugcgcccaggaacaagacagggaagaugaagccggggcugaggcgcaggcgcgggcgcggccugggguguggccugggguguggccuggggcguggccuggggcguggccuggcccgaccacccgcccgcuccgcccaggacccccucccaggccucagcuccgggcgacguggaguggggcgguccuggcgggccgagaugccguccugcgcugcgagggacccauccccgacgucaccuucgagcugcugcgcgagggcgagacgaaggccgugaagacgguccgcacccccggggccgcggcgaaccucgagcugaucuucguggggccccagcacgccggcaacuacaggugccgcuaccgcuccugggugccccacaccuucgaaucggagcucagcgacccuguggagcuccugguggcaggugacguuucccugggucccgggu

SEQ ID NO: 17789 - RNA, 846 nt, Homo sapiens
cucugccuucuccucucccaucuugacaagucacuuuaccccgauccaguucuggauuaccccccaccccagccccaguuaccauaacuacucugagaaaagugucaauagcgcaggaaugggagaaaagacacccuauuuaggcauucgacucaucucagcauuaaagugauaaaaaaauaaauuaaaaggcaaguggacuucggugcuuaccugguuuuccacuacccgaaaaaaauccagcgucuaagcagcugcaaggagagccuuucagagaagcggguccuggcagcggcggggaaguguccccaaaugggcagaauagccuccccgcgucgggagagucgcguccuugcucggguguuguaaguuccagugcaaagugcccgcccgcugcuaugggcaaaguuucguggaugcggcaaggguugcggaccgcuggcugggggaucagcgggagggcugggccagaggcgaagcccccuauucgcuccggaucucccuucccaggacgcccgcagcgcagcucugcucgcccggcucuuccacccuagccggccgcccgcucgcucccucugccucucgcuggaauuacuacagcgaguuagauaaagccccgaaaaccggcuuuuauacucagcgcgaucccucccuccguucuuuuucccgccaagccucugagaagcccugcccuucucgaggcaggaggggagccagggacggccggggcccggcgguggcggccgcgagcagcacagcucggggguccucagccguccagacccucgcauuauaaagggccggugggcggagauuagcgagagaggaucuuuuuucuuuuccccc

SEQ ID NO: 17790 - RNA, 5427 nt, Homo sapiens
gauauauuugccaguuauuuuauuuuuucuaaaaacaauagaaaaaaaucaacuuuaaaaagcaaaauguacuuaaauaaaaaaaauuaggguuuauaguaccuauaauacuagguacuauauacuaggauugaaauucuguguaacugcuauaaacguuuuauuaaaguuauuuacauuuaauggcaauauuuacagagaaacauuguguaaaucuuaaaauuuuuuaaaaacaauucuuaaauacaaaucuguuaaagaaaaaaaaaagaugguaagcauaaaaaaguucuuuuaugcccaaaguccaauuugaggcaguuuacauuauggcuaaaucuuucagucucaagacucagccaagguugugagguugcauuugaucaugcauuugaaacaaguucauaggugauugcucaggacauuucuguuagaaggaaucguuuuccuuacuuuuccuuacgcacaagaguuccguagcuguucaaguuuguguuucaacuguucucgucguuuccgcaacaaguccucuucagaaaugagcuuuugcuccucugcuuggacggacaggauguaugcuguggcuuuuuuaaggauaacuaccuugggggccuuuucauuguuuuccaacuccgggaucuggucacgcagggcaaaaaagcuccguuuuagcucguuccuccucuggcgcuccaagacguuguguguucgccucuugacauucuccucgguguccgaggaccuggggcuggugcauuuucgguuguugcugaucugucucaggacucugacacuguccaacuugacccucuuggcagcaggauaguccuuccgaguggagggaggcgcugcguaguugugcugauguguggagacguggcaccucuugaggaccagugggcugugaggagguuugcuguggccuccagcagaaggugauccagacucugaccuuuugccaggagccugccucuuuuccacagaaacaacaucgauuucuuccucaucuucuuguuccuccucuuuaagaaaggaaauagaaaucacuccuuuagcaagguuacauuaaaauaaucaauuaccagauuaaugcuguacaaauacaaggcaugaauacguuagaaaggucucuggacaaaauuaucuccccaaagagccacaucuaagccuggugcccuggcucacaccuguaaucccagcacuuugggaggccgaggugggcggaucgugaggucaggagagaccauccuggccaacacgaugaaaccccaucucuacuaaaauuacaaaaauuagccuggcaugguggugugcaccuguagucccagcuacuugggaggcugaggcaggagaaucucuugaaccaggggguuggagguugauugcgccacugcacuccagccuagugacagagugagacuccgucuuaaaaaaggaaaaaaaaaaaaaaagaaccaaucuagccagccacccuuacuccucucaccaugaagguaagagucucauaaagggaaagacagcuggguuauggcauggacaagaaaagugcaacuucccaggauaggacauugaugccaauucuuaccuaagacuuaaugaggcuuuggacacacccaaagcaaagcacauucccaagcaccuccuauuuuugagggacuuuaccaagaacacuucagguguugcaaaugauagcugcaaauugcuugguaugacuuuagcaacucccuauuuuacuggaaaugaaaaauaaaaaaaaaaaaauugcaguuuugccaaaaguccaagagggcgggggaaggaauaaaagaaaaaaaaaaguccaacuuuggcaaggauuugcuuuucaguguucaaaauaggcugagaagaucccagcuccucagcccacccacucuugaggcaguucacuggcucccgcacucaggcaggcccugccuagccucuaaacacagccccucauuuuuguagauaguucauuaaaucccaccacuucucggaaguuaagagggaagcaauucauucacucucagagaucaauccucucuuauccucauucauacacucccugccaccccgccccagggcaauuaaaauguuaacgggagguaagaagaaguggauugaguuguaagauaagccagaagguuuaaaaaccuaaaugaaauuccugaggggugggagacaaacggggaggggggcugcaaacaugggcagucuaaggggaagggaugggaggaaacgcuaaagcccaagguuucagaggugaugagcucccaaaucucuccagaucugcuaucucuccuuccuaauaagaguggcccguuaaauaagcugccaaugaaaaugggaaagguauccagccgcccacuuuugacaggccugggcgggcuucgcuuaccagagucgcugcugguggugggcggugucuccucauggagcaccaggggcucggggcugcccugcggggaggacuccgucgaggagagcagagaauccgaggacggagagaaggcgcuggagucuugcgaggcgcaggacuugggcgagcugcugucguugagaggguaggggaagaccaccgaggggucgaugcacucugaggcggcggcgcucagauccugcagguacaagcuggagguggagcagacgcuguggccgcgggcgggguucgggcugccgcugucuuugcgcgcagccugguaggaggccagcuucucugagacgagcuuggcggcggccgagaagccgcuccacauacaguccuggaugaugauguuuuugaugaaggucucgucguccgggucgcagaugaaacucugguucaccaugucuccucccagcagcucggucaccaucuccagcuggucggccguggagaagcucccgccaccgccgucguugucuccccgaagggagaagggugugaccgcaacguaggagggcgagcagagcccggagcggcggcuaggggacaggggcggggugggcagcagcucgaauuucuuccagauauccucgcugggcgccgggggcugcagcucgcucugcugcugcugcugguagaaguucuccuccucgucgcaguagaaauacggcugcaccgagucguagucgaggucauaguuccuguuggugaagcuaacguugaggggcaucgucgcgggaggcugcuggagcggggcacacaaagcgggaggcagucuugaguuaaaggggucuuggugcggaaaccuggcgcagcgcgcagugcgcgccacagucccgaaccucuccccuugcagagcuauccccuaaagcggcuggguggucuuggugggggaauaaagggagcacccuuucacccccuuuggacaguccccugcuaucucggagacgcacuuagugaaccagcggcuuggugcccgccgagcccccgcucccccgggagcccggagcgcaaagcccgggagucggccccgcagcggcagaggaaucgaaaucggcccuggcgcccuuaagaagccgcgggagguggcggugaggaaaacaauuugccaaaauccaaggcacaaaguuuugcgccaccugaaggagaaggcgagaggcgccugggcgcuagcggcugcgugaaccccgcuccgcgccggggccccuccgcugcggcuguucccacucgcgcccuagccgcucuccuacccccgccggcaccgcagccccucccaaccuucccucuccaccgcccccguccccacccccaguaccgcccccguccaacacuccuuuugccagcuuuucuucuuucucucgccggcuggaguggcgagcucagccgcgggcuuuaacaccccuccauaaauacaaggggggugucaaauaauaauaggggcaccucccuucgcacucaauacggagaugcaacugcgccagagaccccgcugcgauaccucccccggagccaccccaccaaggguagcagcuguucuggaaccgcccagagccccgcuccucgcaguuccuccgcaucucgggcgcgaggacacccgagggcggccgcggcaggggagucagggcugggugcggagauucgcccugguuuuuccaagucaacgauuccaggagaaucggacacauccucgccucccuuuuccccugccugcgccuacccaacaccacguccuaacaccucuagagacccagguuuuaaauuguauuauugcuuuuuaaaaagccaaaugccaacuucuuaaaaggaucagggcggguuggaaucgccgcggggacaggcgggcgggacgcgccgcaguguccgucuccggcugucagaaaugcggugagccgaaauuuaaaugcccucccggagacggggacaagucagcggcugcggagcgaucuggcucacacaggcgauaugcggucccuacuccaaggagcucaggaugcaaggggcuuucugcccaccgcaaagcaacccccagccccccaaaacccagagagcaauuaacacaauaaagcaggaauguccgaccggccgggagucagcgugaauauauucauaaggcagaaaucucgaaaggguagucuuaaaaaccauucccguuuucccucugccuucuccucucccaucuugacaagucacuuuaccccgauccaguucuggauuaccccccaccccagccccaguuaccauaacuacucugagaaaagugucaauagcgcaggaaugggagaaaagacacccuauuuaggcauucgacucaucucagcauuaaagugauaaaaaaauaaauuaaaaggcaaguggacuucggugcuuaccugguuuuccacuacccgaaaaaaauccagcgucuaagcagcugcaaggagagccuuucagagaagcggguccuggcagcggcggggaaguguccccaaaugggcagaauagccuccccgcgucgggagagucgcguccuugcucggguguuguaaguuccagugcaaagugcccgcccgcugcuaugggcaaaguuucguggaugcggcaaggguugcggaccgcuggcugggggaucagcgggagggcugggccagaggcgaagcccccuauucgcuccggaucucccuucccaggacgcccgcagcgcagcucugcucgcccggcucuuccacccuagccggccgcccgcucgcucccucugccucucgcuggaauuacuacagcgaguuagauaaagccccgaaaaccggcuuuuauacucagcgcgaucccucccuccguucuuuuucccgccaagccucugagaagcccugcccuucucgaggcaggaggggagccagggacggccggggcccggcgguggcggccgcgagcagcacagcucggggguccucagccguccagacccucgcauuauaaagggccggugggcggagauuagcgagagaggaucuuuuuucuuuuccccc

SEQ ID NO: 17791 - RNA, 433591 nt, Homo sapiens
uauuaguggcagagaauugaauucagaggggccaguugugcugcugcagaauccagaaaaaaaaagacagaagccgacaaggcacaguggcucacaccuguaauaccagaacuuugggaggcccaggugggaggauugcuugagcccaggaguuugaggcugcagugagccacaguugcaccacugcacuccagccuagggugacagagugagacucugucccgaagagagagagagagagauugauugaagagauggaagcuuauuccagagcaaugaccgugagcaugaagaaaggugggugggugaaucuauaggacuaaucaguagacagacauugggaagaggagaacucagguucauggccucagcaaguggugguaccugucauaaccacucuugaagccuugaagccuguuaugucaggcagaaaguaggggacaaacuuucaaaucauacaucuacaaagaacauucgucaugcacuccagccauccugaauugcuagcaguacaucaaccuaugcacauacacacuguucccuuugcuaaaaugcuccccauucucuuggacaaauggcaaacuccaaccuauuuuuugaguuucagcucuggccccaccucccuggggcagucuuuucagccuuugccaaauagauaccucucugugcuuccaccacaccugggguuacccccucucauucuguucucacaagaucuaggaugucuaucccuucguucacucauugguucuauauggagcuacugauaugugauuccugacccaauagaaaaugaugaggguggcuguuugucugacucaagccuuugugaaaugacugaugguucucuaggccuuuuucugcuguucucucugccuggaacacucuaacacucuaucugguuuuuauggcuggcuccuucuuuuuuuuuuuuuuuuuuuuuuuuuuuccuuugagaucgagccucuaccugucacccgguggaguggagugguaugaucucagcuuacugcaaccuccaccuuccaggcucaagugauucuccaaccucugccucccaaguagcugggacuacaaggugcguugccaccacacucggcuaauuuuuguauuuuuuguagagaugggguuuggcuacguuggccaggcuggucucgaacuccuggccucaagugaucugccugccuugggcuuccaaagugcugggauuauaggcaugagccaccacaccuggacggcuggcuucuucuuguuggucaaauuaucuaguaucaauuaucuucuugccccauuuucucuuuagcucucugccgagauuuacugucucaauagcauugaccauuguugaaauuaccuugcuuauuggcuugucugcuucuucugacuagaaugucaaccucacaaaagcagggacuugggcugucuuauugcacucauaguccugaggacuagcacagugccuggcacauaagaggaauuugauaauguuugauaaaggaaugaauggguuuuguagauaaggaugcagauauagggccaggcauggugguucaugccuguaaucccagcacuuugggaggcugagaugggcagauuacuugaggucaggaguucaagaccagccuggucaacauagugaaaccccugucuacugaaaauacaaaaaguagcugggugugguggcaggugccuguaauccccacucaggaggcugaggcaagagaaucgcuugaagccaggaggcggagauugcagugagcccagaucgugccugggugacagagcuagacuccaucucaaaaaaaaaaaaaaaaaaaagaggaugcagauauagagaagguaaagacugguacugagccuaaaauuauuuaauuauagaaccaauacuaaacaaccaugagaacugcauuuacagaauggaagugguaaucgaaagacaauagcacaacuaggcuagcgcaguggcucaugccuguaaucucaacacuuugggaggccgaggcgggugaaucacuugagcccgggaguaagccaggcaugguggcacauaccuacucaggaggcugaggugggaggacugcuugagccugagagguggaggcugcagugagucgaguuugcaccacugcucuucagucuggaugacagagugagauccugucucaaaacaaaaacaaaaacaaaaacaaaaacagaaaacaacgaacaaauacaggugagguaaagggagaugugagaaaaugugugaauguaauagcaaaaaguugccuggacuuuacaaugaugaggccuacaaguaaaacaucaucaugccacucuuuccuugcuuuucauuaucuuuucugaaccuuuguagccuuauuuagaaagcaaugcuucucaugugguaaauaaauauuuaaaacacaacaauuccuuuaguuuuauguuagcuuccuuuucuucuacuaaaaaaauuagauuucuuaaaaauugcaacuaugagacauuaacauuguaaaauauuuuuccuaucuauuugucaauccugcauccaucuauauaucuauaucaagaucuaugccuauauguauccaucugugcccaaaaaggccucaucugauauucagaaaaauuauuucuggcugauaaaauuuguuuuucuucucuauuuuuuuuucugcagaguuuuaauguuuuacaacguguauguauguguguguguguauauauauauauaauaucacuuuugcaagaagaaaagugacuuuuaaaaaaugaaagcaggccugggcacgguggcucacgccuguaaucccagcacuuugggaagcugaagcggguggaucacgagguuaggagaucgagaccauccuggccaacauggugaaaccccgucucuauuaaaauacaaaaaauuagcagggcaugguggcgcacgccuguagucccagcuacaugggaggcugaggcaggggaaucgcuuaaacccaggagguggagguugcagugagccgagauugagcugcugcauucaagcccgguaacacagcaagacuccauuuaaaaacaaacaaacaaacaaacaaacaaacaaacaaaacaaaacaaaagcagauauaccaaaauguuuauuuuggaugguaggaauauuaaaauauuauuuuuucuuuguauuuuuacugaaaaaauguuuuaauucuaaaaaagaaauuaauaaaaaggaaaaugugaaucuaagauuagugcaugagagcuggagacccagagagggcaaacagcaucaaggucaaaguugagugaguccugggugaaagugucuuuucagccaggggagauuuuccaugcagaagggacugggcaucaacugucaggacauggacagagacgucugccauuagaagcugguccucucauagcccaccagcaucccccaggaggacacuggcuuccucaaggucacagccuuugguuucuggaaaaaaugauuaagcagugaaaggauuaaggucucacagcuccuaucgcaugauguauagaugcagagguuucucaucaucuucuuuuuauauuuuaaaagauggaugacaacuagaugccaacugcagcucaggcaccugcccagucccucucagagccgggcacaaaacagacaccugucuagccccucacagagagccaggcacaaaacagacaccuguccagccccucacagagagccaggcacaaagcggagacuuguccagcuccuggcaaggagccaggcacaaaagagaugcccaugaguguaaaugaaucugugaaacaggcagaacaggagcaucaacugaguaauuguuuuuucuuuuucaaauaagaacauuugcguugagaagccgccacgggaagagaugugaugaaacacuacacagaaagagggaggagccuccggguagguuggagugaguaggauguaggguagccggcaggggagaagaggggcaaccuucuguuccguaauauugauaccacccauuuguguguccaauuuuugcugguuugugacguccuucuaggguccaugaguaacccccaccccauugccuagcugggugccugacuccccuuaagugcucaguagacguugaacuggacgggcgcuggcgugguggcucacgccuguaaucccagcaauuugggaggccgaagcgaguggaucaucucagguucggaguucgagaccagccuggccaacauggugaaaccuugucucugcuaaaauuacaaaaauuagcugggcgugguggcgcgcgccugugaucccagcuacuccggaggcugaggcaggagaaucgcuugaaccaggcaggcggagguugcagugagccaugaucgggccacugcacuccagccugggugacagagugaaacuucaucucuaaauaaauaaauaaauaaauaaauaaauaaauaaauaaaauaaacuuugaacugaacaggggcagcucuuacaucuguccagucucggguuuaugcagauagaacaagauaaccacaucccacaugggaggccaguguccacuugcuccuuuggaggaacuacugggcauuuaagggacucguugaacacacucuguaggucaacucugcccggaguggagggagcugcgcagaccgcuggcccucugcacggguuugcaacucggcuucuggaaacagcgggagacgucgaaggaggcgagaaggugcgcgcgcccuucucaccaggccggcggaugcugggugguacccaaagaggcgcucagaucacuggagcuggagcucagucggcggucuucugcgggaacugcaccuaucccggagcaucucuggcccuccuauuucacugaacucgccuuccucagcaggaaagugggaagaccgcuugcuuccaggacgguguggggaaggguaagagggcucagggaaagaccguggaaagcucggcgcacaagcgagcuggcaucaccggggauucccuccggcccggugggacuccggcgcgcuuguagcgaggacccccagcccagggcagagccuacccuccgcucccccagucugggcccuuggcggccgcagucgcccaagcccgccccgccuccgcgcgcggcccucuccggcucagugcccugcgcugccgggaagcaggcugaggggcgcaccgggcggcgggcggggaccuggggaaggccgggagcgccgggaccgaggacgcacgcggcgggccgggccgcgcgcgccuccccccucccccgaggcccgagcgcgagccgccgugacgucacgggcaacccgccagccccgcgcuccuccgggcagagcgcguguggcggccgagcacaugggcccgcgggccgggcgggcucggggcggccgggacgaggaggggcgacgacgagcugcgagcaaagaugugccccgggacccccggcaccuuccaguggauuuccuugcggaaaggauguuggcggucccugugaccuguggagacacggccagaucugcccuccaguaaguuccaauuuuguccccugcguuucuggaaacucucgagacuuggcccugaguagggaugcgcugugaguagucggacggaggaaaggggcuuucggaauccaauaugugugugcuaggcgugcacuguccucaucaccagccucaagacugguggcgaguuugggcguuuggggagggugaggggagggggaugacaccgaauggccggugcauagaggcaauucuggauuuaugaacuugaucaaaggcauauuaacuaauuucuaaaaauagaccccucugcagucagaacagauuuggagccaugaugugguuuggaggccccucuggcgaaacuagaggucugugaaugugugauccucccuccauccuuugaccaucacuccccgcuuccucucacacccccucagggcugggcgaaggugauuuccaaaaacucaguaacuccguguuuugagacuuucucaguuuuugcaucgcaugugaggguuuguugggugcuccuaaacccucaucauggucauucuucuuggcugggcuguugauuuaauuagguuugccuucucuugcuaacgugcucuuauuuaugccaguguuugugguucuggguguagacuuucaggaagcacagccaugaagcugcaugcgucuguguguggaugccucaugccuuuuccuggugguuugcaggcauggaagauucuucuguucaucuaagcuccugacuuuaggcccuucuagaacauuagagaggagaagaaaucacgugcaaggauuuagggacaagaggaugagguuuugguguuuccuuucugguauuagguuuuccagagagaggcuguuagccugucucucgcccacuccaccacugugaauccuggcuacuggggcuaguuccuugcuaggaaaaaaaaacucuagagaaauguguuuguguguggugggugggcgggggcccugaggaugcagggacugugucugcuguguugucuguuauaagauguuucagaccuauuuugcauacuggcagcgacaaguugagacuuguucaacuugacacaguccuguggucauagcgaaucuuucuaaagcucugaucagucaagaaggggguuguaucaauccucagaacccugaguggaacuuucuacaggauuuauuaggagaaaaaccuucccggaagcugcagaaggacaaauacagaauccgugucugggagaaaccucguggccuggucuccauuauuugagaugaguuacaucuuggaggugaggacgugccucguggucuaaagcuucggcacaagggcccaacuggaauuccacuuacggguaugacugugggguauaugcuguacccauugaauucccagagggauuuguuaagugguuguguugcuguuuugccugguuaagaguggcuuauucuuguugccucaucuaucuugagugcagaauuuuugcauaaacggcuucucuugaaaaauagaaguccguuuuuguuuuguuuuguuuuuuuucugauuaacuuuccuuuuccucugucuuaaacaccuucccccgccccucgccaccuccaugcuguguuucuguggcuggagcuuuucugcacuggaaaggaggaguucuccccucuguucugacauaucugauccccacuaguuuauaugauugcuggucugaaaaccuggugaauucucacugcccacaucaaaucaauucccuguucuuuaguuguuuuuuuuuuccgccuccugagcgguaggcaggcacucuggcuggauucuggagccuguguuugccaugccugggccuucugccugcccaagauggacacguuucucuggcagcuuugucaagagaucuccuggacuauaagacacccuguucuuuccuccuguuugugugaguggcccugcauuugggcagaguauuggcagaauaucugggggaaguggaagacuuuggauaguugccgguccaggucgucuggagaggcaguggcaggccugcugauggcugccccuuugcuauuuguuuuauaucagguggcccuucuggauguguggccuuuuuauuuugcauuuccuuucauaguuggcugcagacauaagauucuucuuuuucucuuguuuugcuuuuuuuuuuuuuuuuuugagacagaguuucacucuuguugcccaggcuggaguaaaauggcuggauuucagcucacugcaacuuccgccucccagguucaagcgauucuccugccucagccucccaaguagcuaggauuacaggcaugcaucaccacacccagcuaauuuuguauuuuuaguagagacggaguuucuccagauuggucaggcuggucuugaacucccagccucaggugauccgcccgccuuggccucccaaaaugcugggaggccucccaaguugcugggauuacaggcauggaccaccaugccuggcuaauuuuguauuuuuaguagagacggaguuucuccagauuggucaagcuggucucgaacaucugaccucaggugaucugcccuccucggccucccaaaguacugggauuacaggugccacaguacccggccuuguuuugcuuuuuauuguuuccugaugcagguuugugaucucuuugagggaucaggaccacaccccccaccccaauuuauauucccaguguccauggugggacccugacugaggaugggaacagagcaacaaucuggaaucauuuggaccauugaguccuguggacagucacuucaauaucaucccuagagagucucagaaauucaaggccuuuuggaaugcugccaaaauggguccuuuggcaggagcccccuuugucucuucuguuuucugaccucaaauaaucuaaggaacuaauaacgguaauaaauaacaauuaauaauaagaacaauaauagugcauguauaacauggacauuguuuaucacgcaaagcauguucuucaccuucuacucccuacaacuccaugaggcauuuauaaugaaaugucuagcaaugguagacuucuuguuguggggcaggguugguucuaacacuucaaauuauaugaucucauuuaacuuuccuauaaaauaggaugauuauuguugugguuuugcagaugaggaacccacagcccagagagguuaaaaauauccucccaggucacacagcuugggagaggcagagcuguagagauuuggaccacagucuucgacuucuuagugugacucucagaaguuagaggauaaugagguuaagaacaagcaaagggccgggcgcgguggcucacaccuguaaucccagcacuuugggaggcugaggcagguggaucaccugaggucaggaguucgagaccagccuggccaacauggugaaacccggucucuacuacaaauacaaaaaauuagccgggcaugguggcgcacacuuguaauuccagcuacuugggagucugaggcaggagaauugcuugaacccgggaggcggagguugccgggagccgagaucgcaccauuguauuccagccugggcaacaagagcaaaacucagucucaaaaaaaaaacaacaagaaaaggguauaccccuuggccuugagcaggagaacacagugugucccccacccucaccgugcaccuuaggcacaaacagaaagcugaacaucuugcaugaagauaccucaugcucugccugccgaccuuuucugcagccacggagcagucagagacaaaggggccaagaggccuuaggugagggcugccaugcuggaaaguuugggcugugggugugggcaggagucauggguagaggucagaacccuuagucuuggcugggugcaguagcucacacccguaaucccagcacuuugggaggcugaggccgguagauuaccugaggucaggaguucaagaccagccuggccagcauggugaaacccugucucuacuaaaaauacaaaaaaaaaaaaaaaaaaaaaauuagcccggcgugguggcacacgccuguaguccuagcuacucgggaggcugagguaggaagaucucuugaacccgggagacggaguuugcagugagcugagauugccagugcacuccugccugggagauagaguaagacuuugucucaaaaaacaaacaaccgccucggucuuugugcaaaaucuauaaucauuugcaagaggcugcaaucagguauagcacuggauuuugugaccaaaacuagguuucaggauuuaauuaaaaacaaaaacaaugucaggucauaaaacacaagacauauacaugauguggaaauggucuuauucauuuuuuaauugcgaaauuccgaacuaucuguuuuuuuuuuccuuuaucuuuuccuuuuuguguguguguggaguuagguggggggggagguauggcauauuguuuuguuuaucugccucuuuauuaucacugacugugaaauucuugagaacaggggcgucuaagugcccaacacagcccugguacuuuguugaaucagguggcugucaagagcugcugcuucagcccggcaugguggcuuaugccuauaauuuuugcacuuugagaggcugaggcaggaggauugcuugagcugagaaguuugagaccagccugggcagcagagugagacucugucucuguaaaaaauaauaaaauaaaaauuaaaaaauaaagaaagaacugcuuugucuucaaggaaacaagauacacagucaacagucauuaucuuuuuagauaugagacagcuugacaugguguggaaguggggggcuugccuguagggaaaguaugcugaugaaaaagaaggaaaacagacaguagcaggaggcaguggggaugugucagggagcugaggaguguagaucugguuacuuuugggcaaguuacuucucuaagcuucaguuuccucaucuauaaaaugguuugcugugaugacgaaagagaugaugaacagaaugugucuggcagaggaccugggcucauaagugagcacacaguaaaagguagcuaauaucauuacuguuccaauuauugagcuuuauuacuuccuguggcugcaugaaguagugguuucugaauagaaaggcaacauucuaguugccuagaucuuaagauggcagugacuucacuguaguucucugcaagcaucagaaacaagcccuggcuuauguaaguuagaaacagaugagaaaguaaauaaagcugcagaagugggucucaggaaggacaggaaucaaagggcugucccucggaugucagacugccuuugcaaguuacuucaggucacugugccuccauuuccucagcugcugagcaggggaggagaaucacuucucccucccugggauggugcagagcacuuagcagagcacuuagcacagaggaauaagcccuucaguaaaacauuugaguaaagcaauuauuauuuauuauucuucagggcucuuuuuuuuucuggugcauuagcccuaacauugacuacuugguucaagagugauggaugcauucauuuccugagcaguugcuguaugccuggcaccguuuuagcugcuggcgauccagcagggagcagaagagacaaaaaucccugcccuccugaagcuucuguccuaguggaugucacacaguaguggggcaggcugguccccagagacagcugggggacagauggaggcagugcaggcaaaagcuaacuccugugcaaagucuccccggccccacuguguuaacaguaaagugcuuagcagaggcucccacacauaguaguuacuauguagugguaguugcuauguuuauuauuauuauauuauucuccucccucauaaaauggcagccucccuuucuuccauuccccuuccugaguuauuuuuucucgauagggcuuaucuuccuaguauaccauaugucucucuucucccacuaaauuguaacccauucauuuuuccaggauauauuuguugggugucuacucugugccuggcauugcuguagauguuggggaugcagaaaggaagaaaaaggacagauuuccaugcuagagcuuagguuacagcuggguuagacagauaaggaacagcagacauaauaaagaaggacaugaauuguguauucaagauuaugaagugcugugggaacaggccuagcagggucagugucuggagggcuggggcguggugcugugugguuaaguuguccggucagagucagggcaggcuccauggaggagcugacguuaaccuccaccugaaguaggggaaggacaggcguuucaggcucugggaagagcuaggacagagguggaggcagaagugagccugugggggugaggagcagccaggagaagcgugagaugagaauggcgugagcaagggagguaggagaacccgagcagcaugcagugugcagccucacagagagccugcagggcauuccaaagauucugucuuuuacucuguaaaauggggagcccuugcgguguuuuuuguuuuuguuuuuuguuuguuaugaggcagagucuugcucuguugcccaggcuggagugcaguggggagaucuugguucacugcaaccucugccuccuggguuuaagcaauccuuacaccucagccuccugaguagcugggauuacaggugcgugccaccacgccuggcuaauguuuuuauuuuuguagagaugggguuucaccauguuggccaggcaggucucaaacuccugaacucaagugauccacccaccucagccucccaaaguguugggauuacaggugugaaccacugugacuggcuuccuugcaguguucuaaaaaggaaaguaauuugaucugacuuggcuuuugaaacggucagucuggcugcuguguugagaagaaacuaaaucagggucaggagcuagagcaccaggacaaacaugcacagagcguuaagugccagguccaggcuggcagugguggauggggccacaggaauggacuucuaggcuguucacuguuguauccccagcaucuuaaacugugcucuccauaugguagcugugagcccuauguggguauugagcacuugaaaggaaauugauauguacuguguguuaaacacacauuggauuucagagacuuagugagaagaguaagauaucucauuauuuauuuauuuauuuauuuauuuauuuauuuauuuauuuacugagacagagucucaccuguugcccagccuggagugcaguggcaugaucucggcucauugcaacuuccgccucccggguucaagcgauucuccugccucagccucccaaguagcugggauuacaggugcccaccaccacaccuggcuaauuuuguauuuuuaguagauaugggguuucacuauguuggccaggcuggucuugaacuucugaccucaggugauccaucccacucagcuuuccaaagugcuggaauuacaggugugagccacugcaccaggccuauuuguuuauuuauaugagacacggucucacucugucacccaggcuggaaugcagugauguguucauagaucauuauagccucgaccucccaggcucaggugauccucccaccucagccuccugggcagcugggaccacaggucugugucaccacgcccagcuaauuuuuuuguauuuuugguaaagcuggggucucccuguguugcccaggcuggucuugagcuccugggcuccagcaaucugccuuccucagccuccuauaguucuaggguuacaggcgugagccacugcacccugccaaguuaucucaugaaccaauucuuugauguuaauuacauauugaacugauaauguuuuggauauauuggguuaaauuauuaaaauuaauuucaucuguuuuuucuaacuuuauggcuacuagaaaaucuaaaauuacauguggguugaaucauauuuucgcuggauggaacaaugccuuggacgaggucagcauuuagugaaucaaaugugugggugaggcacagguguucugccgugaaugagaaaccguugccaucuucgggaaguuuccagugugggagggaggcacacugcagauguaacugcuaggagagaaagaaggcagguugaaaugggaccacagccaaccaggccugcuguagcccagaagcuggaagagacucgcccaggagggaaggaagacacugggguguugggucucagucugggucuuggugacagcagugggcuggcagugcagagguucaaggccuuggacugcaaguccacuaagguggcuggugguguggguggagguggaaaaggcagguggggcgagggugaggggcaggacauccuggagagccugaauaaccagguauaagugauuucuuuuucuuucuuucuuucuuuuuuuuuuuuuuuuuuuuuaagacggagucuccuucugucgcccaggcuggagugcaguggcgagaucucggcucacugcaagcuccgccucccggguucacgccauucuccugccucagccucccgaguagcugggacuacaggcacccgcccaccacgcccggcuaaguuuuuguauuuuuaguagagacgagguuucaccauguuagccaggaugguuucgaucuccugaccucgugauccgcccgccuuggccucccaaagugcugggauuacaggcgugagccgccgcgcccagccccaggcggaaauuauuucaacuggguccugagaacugggcacuuuucaaggauugucagcaaggagcaacuucccaaauauacaucuaaaaagaugacaaacucauguggaauguggauuuaaggaggaagguacuugacuuaagaauuccaggauuuugguggaagaaggaaauaugggccaggcacuguggcuuaugccuguaaucccaucacuuugggagauagaggugggaggauuaguugagcccaucugagaccagccugggcaacauagugagauccugucucuacaguuuuuuuuuuuuuuugagacggaaucuugcucugucaucaaggcuggagugcaguggugagaucucagcucacugcaaccuccgccuccuggguucaagcgauucuccugccucagccuuccgaguagcuggaguuacagccuugugccaccaugcuuggcuaauuuuuguauuuuuagcagagacgggguuucaccauguuggucaggcugaucucgaacuccugaccuugugaucugccugccucggccucccaaagugcugggauuacaggcaugagccacugcaccuggccucaaaaauucuuauuuuuaauuaacugggcuugguggcauguaccuguaguuccaucuuugguggcacgcaccuguauucccaucuacuugggaggcugaggcaggaagcuugcucgaacccagaaguuugaggcugcagugaguuaugauuacaccacuguacuccagucugggugacagaaugagacccugucucuaaaauaaauaaauaaauuuuuaaaagcugggaggugggguugguaaauucauaaaaaauaauauuucuugaguugaauacaaacaauacaaucacuguuuuuucuuugccuuguuuuauuuuuacuuauuuauuuauuuuugcagacauugggccucacuccuaggcuggucuuuaacucccggcuucaagugacccucccacuuuggccucccaaaguguugagauuacaggugugagccacugugcccaggcugugguuuuuuauuuuuuaauuuuuuauuuuuuuguauuauaaucauaguguauauguugcauccugauuuuuuuuuuuuuuuuuuuugagacagcaucucauucuguuauccaggcuggagugcaguggcacaaucucagcucacugcaaccucuaccucccagguucaagcgauucuucugccuuggccuccgaguagcugggaugccaccgugcccggcuaaauuuuuuuucuuucuuucuuuuucuuuuuuuuuuuguauuuuuaguucagacaggguuucaccauguuggccaggcuggucuugaacuccugaccucaagugaucccaccucggcuucccaaagugcugggauuacagcgugagccaccacaucuggacacauccugauuuuuuucuuaguugcuauuaggacacaggcauuuuugaauauuauaugcacuuuguccaugucuuuuuuuuuuuuuuuuuuuugagacggaguuucacucuuguugcccaggcuggagggcaauggcgcgaucucggcucacugcaaccucugccucccggguucaagugauucuccugccucagccuccuggguagcuggcauuacaggcgcucaccaccacgcccggcuaauuuuguguuuuuaguagagacgggguuucuccacguuggucaggcuggucucgaacuccugaccucaggugauccacccgccuuggccucccaaagugcugggauuacaggagugagccacugugcccagccguccaugucauuuuuauuggguagauauuucuguucagugacuguuucguugcuuacuuuaucauuccuuugauuuggaugcuuagcuucauaacagccuguuuauauagauuauguuuucuauuuuucaguuaauuaaaaaaaaaacaaauucucaguccuaggauuauugugcauaaugucugaauuuuuuagaauuucagguaaauauugugguucaugagauuugcacagaagcugaauuugcugcuuucuggugaggcacgugauguuuuuugcuguccgugaugcacuaacaugucauuaacauguauguacaguguuauaugcucgcacauguuuaugugcagccuaugcaccuguauuggauuuuucuucacucucauuuauuggcagguauuuguggaaugccuguggugugccaaguucugcuugaggccuuggguauucaguagugaucaaaguagaucaacuaguaccaguucuuaagaggcuuauuguuaagugggggaaacaagcaaauagacaaagaaaaaauaacauuauuguaaggaauaugaaauaauauguacuagaauaauaugaagggaugguuauugugagguaaggggguucauacugaaauacugucugaggaaucaggauuugagugagacacgaagacucaguagaaguuaaccagaagaacaaaguguuagcagaaaagacaagauugaucaauaugacuacauauuaaagaaaaaggcacaucuaagcaacaaaaacugcaaugguauuaaaagccaaauacaagacuuagaagauauuugcaauauuuauaacacauuacaaaacacuaauaucuagaauguaugcagaauucccaaaagucaacaacaaaaagacaaacagccuuauagcaaagugggugaaagauaggaccaugcagugcucauagaaagcaaaguagauggcugggcaccguggcucaugccuauaaucccagcacuuuggaaggcugaggcgggcggaucacaaggucaggcguucgagaccauccuggccaacaugguaaaaccucauuucuacuaaaaauacaaaaauuagcugggugugguggcgugugccuguagucccagcuacuugggaggcugaggcaggagaaucgcuugaaccugggaggcauagguugcagugaacccagaucuugccacugcaugccagccuggacacagagaacgacuccgucuaaaaaauuaaaaaaaaaagcaaaguggaugauaaaugugaaaagauucugaauuuugcuaacaaagucagguuuuggagaucuaauuucuagucaguaaaauucauccuuucuaggauacaaugcuaagaguuuugauaaaugcauagaacuguguuacacuguuguguaauuaccacaaucauggcuuagaacauuuccaucguucacccagauucccuccugucccuucacagccagucuccuucuccacccccagcuuuaaccaaccccugaguuguuugcugaccuuacaguguugccuuuuucagaguguccuauaaauggauucauacaguguguagucucucggauuugucuucuuucaccuggcauaaugcauucgggacccuuccauguuguucuaugcaucagggguuugguaguuuuuauugcugacugggacucuguuguauggauauaccacuguuuguuuaucuguucuccauuugaagagcaucuggguguuuccacaagauacauguuucaugcuuuacaacgugccagaaauaggaugucugacucaaguguugacaaggcacaggguguucagcagcuccgcuagugagugugugaggucacuuuagagaccaccuugccagcagguagugaaauuggaaacaugugcagccccguuccuagguaagauugagaauucacaguucgugcuguauguuacuuaaggauauuuagagaugaaagugaagguuuaaaaaaugggcuggaaagaucuauaucaaacucacugucaucaucuggggagagaaggggagugggcugauugugaaggucaaagccuacuuuaacuuugccuuuauugcuuuuuuuaaauucaauuaauuaauuuacuuguggggacagaaucucacucugucaagguugcuggagugugaguggugugaucguggcucacugcagccucuacuuuccaggcucaagugauucuccugccucagccuccggaguagcugggacuacaggugugagccaccaugccuguauuuuuuguagagaugagaucucacuauauugcccaggcuggucuugaacuccuggccucaagccauccuccugcccaguucucccaaagugcugggauuacagggaggacccagugucuggccuaucuuuaaugcuuuuuuugaaaagaagguggauaccuacacauaucacuuacacaguuugaaaauauguagaaaagaaaaaaaguuugaaaauacauaugacaagauguucaugguugucaauucuagguucuuugaauuuuucuuuuuuucuuuuuuuuuuugagacggagucucgcucugucacccaggcugggagugcaguggcgccaucucggcucaccgcaagcuccgccucccagguucacgccauucuccugccucagccucccgaguagcugggacuacagaugccugcuaccacgcccgguuaauuguuuuguauuuuuaguagagacgggguuucacuguguuagccaggauggucucgaucuccugaccucaugagccacccgccucagccucccacaguguuaggauuacagacgugagccaccgggcccggcugagacagucuugcucugucacccaggcuggaauguagugaagcaaucucgguucacugcaaccuccaccuccuggguucaagcaauucugguuccucagccucccgaguauuugggacuucaggcacaacccccgucuggcuaauuuuuguauuuuuuuuaguagagacaggguuucaccauguuggccaggcuggucucaaacuccugaccucuggugaucuaccugccucagccucccaaagugcugggauuacaggcgugagccacggcguccagccuguucuuuaaauuucuuucaaaacaguuuagggaagggauauccuagguaaagauaauagcaugugugaaggcccugaggcugcaaaacuuuugguguguucagagugucaaaagauucguguggcuggaaaggagugaacguccaggguccagaugaacagguguuuggucauggagggccuuaagugcuuuuuuaagucuuuggggguggcuaagcugggugguuccugauuugauugaccuuuuuguuggguagaugguggaucaacggaagcagguggcccauuuggggacugaauuacagcaauccaagagagagcuggacucggcucuagcaguggagaggaagagaagaggaugaguuugguauuuauuuuggagacagaaaggacuucuugggaccaggcgugguggcucaugccuguaaucccagcacuuuggcaggcugaggcgggcagaucacuugaggucaggaguucaggaccagccuggccaacauggugaaaccccaucucuacuaaaaauacaaaaauuagccaggagugguggcaggugccuguaauccgagcuacuugggaagcugaggcaggaaaauagcuugaacccgggaggcggagguugcagugagcugagauugagccauuguauuccagccugggcaacaaagugagauuccaucucaaaaaaaaaaaaaaaaaaaaaaaaaagaaagaaaaaaaagaaaaagaaaaggacuucuuggagggcaaaguuugagggaagaguuagcuagcuagagaccuuccaaacugugcucaggcauuuggauuuuacccugugggugauagggaacuauugaaaguuuucauuuuuuucuuuuuggagacagagucuugcucuguugcuucaggcaggagugcagugagccauaguggcucauugcagccuggacccccugugcucaagcaauccucccaccucagccuccagaguagcugggacuacaggugcauggcaccacccccagcuaauguuuuguuuuuaauuuuuuauaaagauagggucucacuuuguuguccaggcuuaaaacuccuggcuuuaagcgauccucccaucuugaccucccaaaguguuggaauuacaggaaugagccaucaugcucggcucuauggaagguuuugagguggggcagggaugagauuagagugaugugccuuugccagagagauuuguccagaggaagggugaccagccuggagucucuuuggaauguucuagguaauguagcagagauugugucaguuacccucuggugggaugcuuggcuuuucccauuuuuucaaaaggaaaugggaaaaggaaaagguccucuguauggaaaguccccaggaauuuauaggagaguggcuaacgaagacagaguucccuuccggcauuuauugugacugaguuuguuccauaguuuuagucccacuuaggucaugauucaucccacugggccagcagcagcauugggaucacgucagccaaucuucgcacuuagagauuuugaagagagauaucuccuauccaugugguacauugcuuuucacaaaacaaaagaguucauuuugucggugaaaagcccuggccagacccagccgguggagaccaguagcuuccucuggcaggcugggcuuccuauggucauugcagucccuccccauuuauaaggcugccuucccugagaacaccugggacagaugccccccagaagcaugcccucuggaaagggagaggagcaggagggggcuucaggcaugcugggccuggggggccacccccuggccuuugcuaaguuccuggcuggucugagcccucuucuuuccucuccccaggccuugcaaaggccauaucucuuccuuuucaugacucuggaaauuccauacauacuuucugcauuaggaagacauucucugcaugcugaucucguuaaaaaggaaaagccaaggagcauccugcaccucccuccuguaagcgagcuuugcaaaugguaaacuagauccugaaaggcaaccacuuaaaagcuuuuaauggcuucccauuauuagcuugagugccuggugcgucagaggcucucagugagcguguauugaauugcugaaugcaugguggcccugggcgaggaaucuggcccucacugucccaaggcugagugccuuugcccuguggaggaaagcacugccuuggggucagaaauaaggauuggcaggauugccugggguuagaaauagugaucaugggaucagaggcagcaggugaauguggggugugaauauuuuugaaggcuuggaaugaaaugauucuuccagacuuuagaggauuugugucugcagauucuucucuaagguuugugucucacauagugagagaaucagccagccagggaaaugggacaggauuuugucucuuuccccauuuccucuucuaaugaacuccuaccuaugcuuuaugacugcauuaaggggucaccuccuccaggaagcauucccucaucuccuuacgcugguucugagugugucguuccugcuugauccccucccagcaccaugugugugaguucucacagcucacaccccauaguauuacuauguuguuucuacaguggguuccugucagggguuccaaacuuagcuguuuaggaggaugaguagauuguacaaccacaccaggcgggccugaucaaauacaguaagaaguguccggauuggcaaaccagcgggucccucuucuagauguuaucagagagauacuguuagagagagguugcuagauguuaauagaggcugcuguuagauuccagcucccuccuccccuggucccuuuucucuccucaugccaaaagauagacccaguguugccagagcuuccacuuuuaaaagagaagccuuuuaaaauauaaacucuccugauuuuuaaauguuuucaguuaaguuuuuaaaggaacauucauaggccaaaccaaauaccugugggccguauguggcccccggggccagcaguuugcagcuccuugguuauaggugccucuaacccauugcacaagcucccucaggcauuucaugucuuuccuuuccauucccccugggccuagcagggagcuggcaugucacagugggugcucccuaauuauugguuauugacuugaaugcuagacugagcaagcaccucccugcucacaggguguuaacauuuuucccucagaacuguuuguauguaaugcuauucugaauugcuucaguuccuuacauacuuuagugauagucuguaugugccuggaaaagucaucauuccuuagauucuagacaacucuguucuucuguucuuuuccuuuuuccuuucucucuccguccccucaacauauguuuuuguuuuuuguuuuuugccaguucuuuuguaucuggccgguuaacacagggcuucauaacauggggucggcuguuauuaagcaacagugguuuccgguagcucacugacuuugcccucucugcugguaagccauugcugauuuccaucaggguaacaagcaugauuuucagauuuaccuucauuugcagugaacaauuauagcaaaauugcuuaaagaaaugaaccuucagguguggcggcucgugccuguaaucccagcacuuugggaggccgaggcgggaggaucacuugagcccaggaggucucuaggcugcaguaagcuguaguugcaccacugcacuccagccugggugacagggugagacaucgucucaaaagaaaagaaaggaaaagaaaagaaaagaaaaggaggggaggagaggggaggggaggggaagagggagagagggagggagggagggacggaggaaggaggaaaggcaggaaggcaggaaggcaggaaggaaggaaggcaggaaggcaggaaggcaggaaggaaggaaggaaggaaggaagagaaugaaaggcugggcgugguagcucuugccuguuguaguccuggcacuuugggaggcugagaugggaggaauuggaaaccagccugggcaacauaaugagacuucaucucuacaaaacaaauuuuuuuuuaauuagccaguggcaugcaccuguggucccaggaggccaaagcuggaggauugcuugaggaugggaaguugaggcugcagugaccuauguucccaccacuguacuccagccagagucacagaacaagaccuugucaaaaaaagaaaagaaagaaaaggagagagggagggaaggaaggaagaaaaaaaagaaggaaagggagagaggaaggaaggaaggaagggaagggaagggaaggaagggagggaagggaggaagguaggaaaauggaaggaagggagggaaggagggaagaaaagaaagaaggaaggaaaaaaccggucggcuaucuugacgaaaaaagucucaguccacuccauuuugugcagcauuucccgucuuguuaucuuucuggaaaaacucaguaagucucuggcugggaauuauagaagcuuaauaugcacuuguaacugugucaggcucucacagggaacaaacaagaggaacuauagauuuuuauagucugcaagagcccaguccaugcauuuaggaggcacagagugagagaaagagcauugacaaugauaauauagcauuaauauagguacaaucuggaguaauguuaucuaguacuacuaauagcgauauuaaaauggcauuauauagauauuaagcccugacuucgugccgguuugaacuuuuccuguauuaauucaugugaaucaauuuugagacucugucucaaaaaaaauauauguauauaauauauacaaauauauauaauauauacaaauauauauaauauacaaauauauauauauaauauauacaaauauauaauauacaaauauauauaauauauacaaauauauauauauaauauauagaugucauggugaugggaagacugggggaggagaggagcaguuuaaucccaggaucccauggagaggaaacuuguaggucucuuacccagugucuucuccugcucucuggcucugauuucugaacuaagaaaagugugcaaacaucaucugcucuccugguuguauuuguaaaugccuccccuagacccagcucuacuuuaggccacgugagugacagugaccacaucagucagggauucuccuacugucccugacccauguccgcuuuugucuccucccacucuaauaacagaccguguggcuugaaccucagcccugcugccaaguagcugugugagcuucagagccuggugccucaguucccucaucuguaaaaugggaauacaaauggucccuguguguuuggguauucaagaaaauuaagugaguugcugcacaccucaccucuggcuccuucaacaaaaacauggucacccucaaaccaaacgugaacaggaggguggugacgcaaaccacauggaaacgagaggcagacccaggcuggagugcaauugcacgaucucggcucacugcacccucugccuuccagguucaagcaauucuucugccucagccuucugaguagcugggauuacaggcaccugcugccaagucuggcuaauuuuuguauuuuuaauagagacgggguuucgcuauguuggccaggcuggucucgaacuccugaucucaggugauccacccgccuugaccucccaaagugcugggauuacaggcaugaaccaccgcccccggccgcagaugggaaauuauuuuugcacuuucaguuguccuaaaucuagaguuuuccuuuauccagacagcuggugaaaguggacgugagaauagagagauuuccugguggggaagaccuccauccuccuucuccagccccuuccucauuauucccaagaaaagagcuucuggguuucugggagaggcugagcagguggagacaccugggccauaucugggucucuccagaauccaggagccugccugacgcgucagccggggaggguuucugugugaagucggcuugagugagccagccuuucaugcauccuugucuuuauuucuuccccagcucaggaggggcugaguugugucuuaaugagcaguuccagcugcacgcugggcaucuccuaauuuacucucauuuauuuagcuccugcugcaugcugggcaaugcucuaagugcucugcagguuuuggcuaauuuaaucucccuagcaaacccuuugaggggacugacaggaugaccauccucauuuuacagauguugggauugaggcacagacaguuuauuuuuaauuuuuauguguaaaauguuuuuacugugguaaaauuuacauaauaaaauuugccauuguaaccauuucuaacuguacaauucaguggcauuaaggccauugguauuguuguguaaccaucaccgcuaaucuaaccaucuccggaacauuuuucaucauuccaaacugaaacucugcacucauuaaacacuuacucuccucucccccuccccucauccccugguauccacaguuucuaugaaucuaacuacccuaagcauccguauagguggaaucauaguauucauccuuuugugacuggcucauuacacuugguguaaacuuuuuuuuauuuuuuauuuuuuuuugagacagaaucuuguucuguugcccaggcuggagugcaguggcacaauuucagcucaccacaaccucugccucccaauucaagagauucuccugccucagccucccuaguagcugggauuauagucgugcaccaccacgcguggcuaauuuuuguauuuuuuaguagagacggggcuucgccauguuggccaggcuggucucaaacuccugaccucaggugauccacccuccucggccucccuaagugcugggauuacaggcaugagccaccgugccccaccuuaguguaaucuuucaaagguauaucuccguuguagccugugucacaauuuuaugcccuuuuaagacugaaugaguuuuuaaauucauucccauuuaacucuuuguuuuguugccugugcuuuuggugugaggcacagacauuuuaagaaacuuagccaaggccauucaaccagaaguggcagagccuggaucuugaccacauggcuuugcugcucccagagucuugacccugugcuggggcugacuucugcuuuuacaugaguucuugucagugcuuucggcagcuugaucagguagaugcugcuuuuccacuuugcaaauauggaagggagcacccagcucucuugggcauggcagaaauucaucaggggcggaggaggcacaggguacccacccaaaaaaucccaacauauugaaucaccuuccaauaaucuauagcaucauuuauguuaugcugcccacaacauaaauggcuagcaaauaauuuggaugcgacagaauuggugaaugaauuuaauguagcuucaaccugaagaccauuauacacuauuaauaccuacaaaauuauagauguaaggcugggugugguggcucaugccuguaauuccagcacuuugggaggccaaggugggcagauaaugaguucaggaguucgagaccagccuggccaacauagugaaaccccgucucuacuaaaaauacaaaaauuagcugggcuugguggcacaugccuguagucccagcuacucagcaggcugagggaggagaaucucuugaacccgggaggcggagguuauggugagcugagaucacgccacugcacuccagccuaggcaacagagugagacuccgucucaacacaaacaaaauuauagaugucaccuacaggccaguugggaggcauauugguaaguaaauacccaugaccucuccacccugccuaggauccaaacuaugaacacugaugguugacucuaacuccauauucuuuucaguuuucucccaugccuacccccugcccccgagcauucucccucauugguggcccugauuuucuuuuuguugagauaggaucucacuauguugcccaggcuggucccaaacuccugggcucgagagauccucuuaucucggccucucaaaguguugagauuacaggcgugagccgcuaugccaggccaacucuuaucuugaauguugauguuuaucaugucauggaugaaaaaaaaaaaacccaugcguauucuuuuuuuuuucuuuuuuuuuugagaugguguuucgcucuugucacccaggauggggauggagugcaauagcaugaucucggcuaacuguaaccuccaccuccuggguucaagcgauucuccugccucagucuccugaguagcugggauuacgggcacucgccaccaugccuggcuaauuuuuguauuuuuaguagagaugagguuucaccauguuggccaggcuggucuugaacaccugaccucaggugauccacccgccucggccucccguuuguauucuuaaauaguguauuguuuccuuuacuuccuuuagagcuuuacagaaauuccaugcugccuucagcuuccuuugccgcucugcaucauguugguaagucucugcugaugccugcugcuguagcuuauuuuucacugugauaaucuguuccauugugugaacugaccacaguugauugaucuguucuccaaggacaugugaguuguucgcagguguccccccacccccucccgauacaaacagugcugcuguggacauuucauacaucugguugccuaugucagaauuuccaggguauacagcuaggacgcaguacugcuguuggauuuuccugggauuguagacucucaaauuuggaauggacuucuauggccaaguaguucaccuucagcaaucaucucaaaagaaaugcucuuggugugaugguugagagcgcuguucuggaauaggagagacacagaccugcugggccuuugccucauuuuauuacuuaguucauuaugcaaugaacuuaacaucugucuaccucaguaguuucccugucugugaauugagucuguuacauauauauauaucuauuuaaauauauauaucuauuuaauauauauuaaauaauauauauuuaaauagauauauauauauuacagacucaauuuaacccuuagggaaauauauauauauauauguguguguguguguguauauacauauauauuuaaauagauauaucuauuuaaauauauauauauauauauacacacacacacacauauauauauauauuucccuaaggguuaaauaagauagagaccugguaugguggcucaugccuguaauuccagcacuuugggaggcugaggcaggagagucacuugagcucaggagugggaaaccagccugggcaacauaguuggacccugucucuacaaaaaugaaaaauaaaaaaaaaaaaauuagcugggugugguggcaugugccugcagucccagcuacuagaggcugagaugggagaauugcuugagccugggaggucgaugcugcagugagcugcaacagagugacaccuugucucagaaaaaauagagagagaaagauccggcauguguagagauuaacucggagccuggaaauaauaaacacagaguaagugcucccugcuguucgccuuguuccuguugguguuuaaagaucacuuacacuugcagaggcagaacugaugcccaggagaggggcaguaacuagcagaagggaaacagcccggguccaguuuacuuccccucaacgugggccaaggacgccaggcaggaucauaguccggcuggauuguggcuuuccucaaggugaucuugacuugcccaggugggauuucacccccacuuccuuccaggcuucccauuuuagacuugaaauguaggccuguuggggccuccuccaguagaugugugcccuugagcuuggauaccccccugccaagauacgccuuucaaaaacagauaaacuuaucgcaacugaauagaaggggcucccaaggggucccacccugcuccggaagucucagugaggaaucaauagcuguuaauuccugugcugcccccugccugacauuccauccacacuugaggcccagauuguaagaagggagagcaggcaggucucucuuccaggagagggacccgguucaucagcaggauuuauucauucauguauuacgucaggcucagcgccugggcuuuuuauaaaugagggcucugcuggcguucuguguuauucagauauucggugagagaccaccagaagccacaaaaaauugcugacaucuguuggaaggcaaucaugcauaauggauaagggugcacucugcaguuccagcagcauugauuugaauucccccucugccgcuucaaaacucugagaucucagcgaguugcuuacccucuagagccuccacguccucaucuauaaaacuagaaaauaagugguacucacuagauccuuaccuuguugugagaguagaaugacgugcauguagagcuuucccagagcuggcaugugguaggugcucaauaaacgcugguuauucucucucucucucucacucuguugccuaggcuggagugcaguggcgugaucauagcucacaacagccucugucugccaggcucaagggauacuccugccucagccuccugaguagcugggacuugcaggcaagugcuaccgcuccuagcuaauuuguuuuauucuuaguacagauggggucuugcuauguggucccugcuggagugcugguugcucucuaacuggcugcgagccccgggguaggcacacugguacuggggcuauagcaaaauccgugcucgguaaaucaucauugaaggagcaagggugcuuuacaguuguagaaucucauaguacacguuacuuugguuuuucucuucccagcucuggaguccugggauccaagugugagccccaugucugcaaaaugaggcuagucacuugaauccucuuggaucuugcuuuccucaucuguuagugagcuuguagauagcucugacugucaccaggcuuugcucugagcacucugcaucuguauucaaccuguauacuuaaucuucacaacaguugaggugguugauccauaguaauuucucguuguacaaacggagaaacugaggcagagagauaagugucuucccaagguuaacagcuaaccaguagcagggcacgcugggauuugaaagacucucuauguguccuaacugguaugcucuccugucuagaggugaucucuuccuccaggguuccagguagauugguugagaugugcaaugcggaagagccucgggauaagucggcuaaugacacccucaggcuacccagcccucgggagcucacagcagagcaguuggggaugccuugcaagguuaccugugccagaguuccugggguacauauuaaauagguaggacccaauacuacuuugcauuuuccuggaauccuagacucuuaacauuggaaaggauuucuuugccaaguaauucgcccucaucauuaaccucuaagaaaugcagagguggaauuagaaggugcgugucucuuucuuuugcaccacagauucuaucgagucucaucuggcagcuucaaggaucauccgcauucuuucaucuucauggaaugucacuagauugagaugauucuaagggugaggucaagcauuuggaguuuggaacucugccuuuuguagagaugcucccgugggacuugcccugcacccaguucagcuugcuugggaugcaucugcugagccuggaagagaaguauggguucaaggccagcgguccagcacucccacagaccugaucuguaauagggaaggguugccucuguguggguugggaguuuaaucagcaagaguggauuagcagcaggcucauucuguuuacuccaguaggucacggggccaagggcaaacauacaccccucccagcccagaaacugauagcugcaaaguugcacacccuucuccccaaauugacaaauaugguuuucauuguuggaguaauaaauuaugcuuuuuaaggauaaaaauguugcccagcuguugagugguuuaaacuuccagauguuccucugcucaguaaucagagcaggaugcaugaugggaucucuuuaaaaguugaugaacagaaugguucauuaaauuucaacaaugugccuggaaugccaaggggagguguagcaucucccucgagggaaggagguacacauuuccuagggugcuugggugaagaauuagcaagcaguaacugaagaccaguuacuggucaggcagggaagcccaaguucuggccccugcugacugugugacuuugggcugagcaguuggccucucugagucuuagguuuuguuuuuuuuuuuucuuuuguguuuuugagauagagucucgcuuugucgcccaggcuggaaugcaguggcgcgaucuuggcucacugcaaccucugccucccagguucaagugguucucaugcuucagccucccgaguagcuggauuacagacaugcaccaccaugccuaacuaauuuuuguauuuuuaguagaguugggguuuuaccauguuggccaggcuggucuuaaaguccuggccucaagugauccgcccgccuuggucucccaaaguguugggauuacagacaugagccacugcgccgagccugagccucaguuucugauacuugcaacugggagcauguuuugagagcuagagaaaguauuguugucuuguguaacaugaaaaaagcugugcggauacuagcuaagaucaaugaaagguuaucaaacucaaucugauggugaaagaagauacagagaucaagcccguccgcauuuuuaacguggggacacugaggcccaggaaacuuggggcuucuucaaguaguagcuaggccugugcugucccauaugguagccgcuagccacuagccgcauguggcuauugagcagucgaaaugugcgaaaauucaaauuaaaauauguuguauauguaaauugcacaauggauuauaagacucaguuuaaaaaaaagaaaaaauucauaacaacuuuugaaauauugauuacauguugagaugauaagauuucgauauacuaaguuaaauaaaacauuaaaaaugaauuucaccuuugguuucugcuuaguauuuuuuaauguagcaacuagaaaauuaaaaauuacugccgggugcgguggcucacgccuguaaucccagcacuuugggaggcugaggugggcugaucacgaggucagaagaucgagaccauccuggcuaacacggugaaaccucaucucuacuaaaaauacacaaaaaauuagcugggcaugguggugggcgccuguagucccagcuacuggggaggcugaggcaggagaauggcgugaauccgggaggcggagcuugcagugagcugagaucgcaccacugaacuccagccugggcgacagagggucucugucucaaaaaaaaaaaagaaagaaaauuaacaauuacauguguaguuugcauuauauuuccacugggcagugcuaugcuaaacugugacacaaacgguggacuuuagaguugugcaggguacaaucugcacggccauauguggcaggccuaccagguguggaugaggcugucuggguucgaauccuggcucuaccaguaaucaguugugugguauugacuaaauuguuuaaacucucagagcuucaguuguucuaucuguaaaaugaguauugcaauagugcaugcuucauagagcuguuguaaggauuaaaugaauuagugcauauaaagugccuagaauagugucuggcccguuuuaagagcucagugagucuugguuguuguaguuguuacuuuagugguuguuuuuuagaaccugaggacacaaggauggaaagacucagucugucuguggcaaaccacgaaaggaaagauuaaacaauucaaugcaggcugggugcagugggucacacuuguaaucccagcacuuugggaggccaagacgagcggauaguugagaucagaaguucuugaccagccuggccagcauggugaaaucccauaucuacuaaaaauacaaaaauuagccagacguaguggcgagugccuguagucccagcuacucgggagacugaggcacaagaauugcuugaaccugggagguggagguugcagugagcugagaucacgcuacugcacuccagccugggcgacagagcaggacucugucucagaaaagaaagaaagaaaaaauaaauucaaugcagugauuauuagagggguaaguccaucgggacaaaucagggggcauucccacugaggcaggacuugagaugaaucucggaagcagaaaugcugagcuuguugggcuggccagagauaagaaggacauugugggcgggagaaacagcaccuacagggcugagauggaugaaagcucaguucagucugggaacugcagaaacucaguuugccugagcaaacugcaauguggcaagugggaaaugaacccaagcuaaaagaggacagcagcuggguguaaauuuuguccuguaacccauggagagccaagaaggauuuugagccagggagugacaugauuggauuucaugaucagaucauucuaacugcuuugaggagguugucuuggaaggaaagcaagagucuuuggcaagaagaucaagagaagaaagauugcuauuuccaaagcucaaguaguguauuuuucauuguuguuguuaaaguucaaaagucuuuauauugaaaguggcacguaugcuaugaucucacaccuguaaucccuucccaguuuaucugcaugagaaaagcgcuuggaauggugcauaucuaaaggugguuucugcucaauggggauguggauucuugugucagguuguuggggaggcuuuaggcuguggcugccagcccaucccacugacagccaacuucauauggaugcagagcuuuuuaaccauaucaaagagaaggauaggagcuuaaaauaugaaacuccugcuuuugauaugcuuaaauucugggucugauaucuuuuugaaagaauuagguuuuuaauugaaauagcacaugcauauauuuaacaucaaauggguaaggcuuuuauggaaaauccagauuccccugcccuuuuucugccuguccuuagcccuguuucccagagugaaucagggacaggucaguaccucuaaagaauaagcucauguugcuccuugucuguugacuuagacuucuggacccucagcaaugucccgggacucacacugggggaggcagggagaccagcaugcccccucuugccacuuguacuucccauuuucccccuggcaagguguggaacauuuauacucccacgcccacacuuaagacuccugugcuuuaucugcaagguuaauuccaacaauugauaaauggaugaacaguguuuacauuaagaggcuugucaauggccuucacugcccgucgaagcagucggcuuugaucacauguccuuuguguucagcucucucuuugcccucagcuuucuaaucgcccuuuaaggggcuaucugaggcugggugagguggcucacgccuguaaucccagcaguucaggaggcugaggcgggaggaucucuugagcccaggaguucaacacuaaccugggcaacaaagcgagagccugucucuacaaaacauuaaaaaauuagccauacaugguggagugcgccugugguccuagcugaggugagaggauugcucgagcccaggaguuugaggcugcagugagcuguaauugcaccacugcauuccagccugggugacagagugagacccuaucucaaaaaaaaggaacuaucuggcuucauccuaagaguaguugcauuuuaaacucucagucagcuucuuuuacuguaaaaugggaauaauaauuaacagucuaaauuccuaaagugauuaugaaggcugaacaggugaugccuguuccucaggccccucccuuggggccccuucagccccaugugucccaggcuaaucucaaacuccugggcucaagugaucugccuacuuuggccucccgaaguguugggauuacagacacgagccaccacucccagccagguugcuauuaaauuuuaccuuuuuauccaggagcgugggucaucauuucuuucaaauaaugcuucuauuuaugagauuuuucuuuguagaaaaugugggaaauguuaagaguauaaggaagaaaauaagucguguuaacgcaauugcugcauuuuucuuuuuuucuuugcauauuucuuuuaaacuugagaucauguaaugucaacaaguuuauuggauuuuucuccuaauguaguauuaguauuuccauguguuguaaagagcaagcuuuuagguaucauuuuuaaugcaauauaauguuguaacauccuauugcaaugacagcuugucuuucucccaauuuuaucugcacuauuagguauuaagaauauuuaauguggccgggcaugaaggcuccugccuguaaucccagcacuuugggaggccgagguggguggaacacuugaggucaggaguucgagaccagcuugggcaacauggugaaaccgcaucuccacucaaaauacaaaaauuagcuggguguggugaugcaugccucuaaucccagcuacucggaaggcuaaggcuggaaaaucauuugaacccaggagguggagguugcagugagucgagaucaugcacugcacuucagccuggguaacagagccaaacacuagcuaaaaaaaaaaaaaaaaaaaaaaagaacauuguguauuuuccucuuuuaaauaauguugagaugaguguuuugguguauaugucugugcaugugugcacauaugugugcagaaaccuauaggauagauuucugcaagaauuaucaagucaaagguucuagacauuuuuaaggcucucaaugcauguuguucaguuguuuccccauuugguuacaccaaguuacagucacaaaauuacaccaaauauuuuuuccuccauggaguugcuuucucaugaaauuggguuucugaggccaggaagacuugggucuuguugaggugaaggggauaauucuucagcauuugucacuauuuuucacuaucauuuugaguuugauuuaaauagcacaguuugcugcguggaaaaugagaguagcuuugaaggggcacagcuuugaagggcacacaguagaugaugacaucuacuucagaacucuggcugcuacgugggguacgaccauguugcauuuucaggaugcuuuaguggaaaucaaaagcaugggaugcgaaugcaaaaccaaagggcuuagguucugcaucugacauauguggcuagcuguauguuccuagccgcgucacucaaccuugcucaguacauaccuucuucauauggcgugcaucucuuccucagcuauauggguguccucgaaaaugcugagcauaagaaaagugcauuuguauccucuuuauuuauuuauuauuuauuuauuuuuugagauggggucuuacucuguugcccaagcuggagugcagucgcacaaucaugguucauugcagccucaaauuccugggcucaauggauucucuugucuuagccuccucaguugcugggacuacaggagugugccaccaugcccagcuuuuuuuuuuuuuuuuuuuuuugauaguagagaugaggucuuguuauguugcccaggccaguuucgaacuccuuggcucaaacaauucccccuccucugccucccaaagugcugggauuauaggcaugagcuaccgcuacacccagccuauccuguuuaccuacaacuugccaguaaccuugggcaaauugcuuggccucaggaucuugguuuuguuuucuguaaaaugggaauaauaauaauaauaauagucccuaauuccuaaggggauugggaagguugaacaaagugcuuccgcuagauugcuugaccuggugccuaauccuggugauuucucguaaaaaucaguuguucucacuaguggaguccaccagaccugaugauuccccagcguugaguucagccaaccugcacuuuaguucuucaggcugguuguauauggcuggcuagauucaucguuuggaaucuucagagucagaagggacccauccaaguuugucacucaauggaugacaaaguaaggcuccagauggugagugucuauuuuggaauuucauaacuguuuccauuuguguguaaaggaggauaacacacacagacuuacauauacacacaagcauauuugcauaggcuggauuuggaagggugcacaaagaaaauggucauaguggcuguugcuaagaggccacccgggagcuuucuggggccaggagagaaacuuagccuugacuguaugacuuuuuuacaguccuguuggaaaauuuuaccauguguaucuuuuaguucuucaauuaauaagcaaugaguucuuaaaauucaccagguaguaaaagaucuuugaaagccaauccugcuucuuaaugcaaggaaagaaucccugggaguaugcaaaaucucuguugguuuuguagcugucuaucugaacucacgugcccuggauccuggccacagggcuuucuuuuucuuucuuucuuuuucucuuuuuuuuuuuuuuuuuugagauggaguuuugcucuuguugcccaggcuggagugcaguggcaccaucuuggcucaccguaaucuccgccuccuggguucgagcgauucuccugccucagucucccaaguagcugggauuauaggcaugugccaccaugcccagcuaauuuuguguuuuuaguagggacgggguuucuccauguuggucaggcuggucucgaacccccgaccucaggugaucugccugccucaagccuccaaaagugcugggauuacaggcgugagccaccacacccgaccuagccccagggcuuucuaacacucacauggacugucugcugucucuugcuggccucccagucugucuccagaauauguuagacugaguccuagacacuuagccucugguccccuggcagccaacugcuccucugguucacccccuggggcucccuguauaggggagccaucagccugacugagcagcccugaggcuggaguuuuuggcuuccuccuaaccagcccccuucacgguccaggagccucccagcacagaagggagaaucugugcagcuuguuccuuauccuccuuugaaccaaggccuguuccaagaacuccagggccucucugcuugcacgucaggguugagcugcucccccaggccccaugcacggaguuggcagcucccuggaaaaauuuccuucccccuuucuuucuggcaaauacgauggauucccugcauggccccagaccaugagucuugaguugaguucugcaggagcaucuugcuggguggcuucagcaggggcagggguggaaagccugaaguccuccucuguccugaaagccuuugaucuucauucuggcccgaagccccugugccguauuucccucagcaccguuguaacaucuggugagccaggcuguuagggccaagugccugcucuuuggagggcaucuaguucaaugugagcauuuuuuucuacccagcgaccaauucuggaaacaucaaaguguuuaugagccuacuuuuuguuucuccauucaaaaugaaaauagcuuuauugaucccauggugaggggugggcaggguguguaucuucuugcugcugggauguucuacuuuguuggacagaaggcuaugugcuuucuggcagguuacaccuggguacauuucagucaagccgagcuggcucucuccucauuucauucucaaaguagaucucuugcuaagggcuucuuacugagugucuaguuccuuguuguacaggugagggaaacugaggcccagaguggaugugacguuuccgaaggagaggcucuguaaaguucugaguaggugagacuuauuauuagcugcaaauaacaacaacaauaauuagaagaagaagcaucuucugcccuaaaucauggggcuuuuauuuuucagcuggauggugaagcuuaguggccucuccuuuucucuucuuggaagcacaagcccuguguuguuuauauuucucuuuggccagagauguauuuugaaauuuaaaugauaaagcaaacaaguccuguuuucacugacgcuuuagaaaacuugcaugaaaccucuucacggugguuuugggagccaagcgaggccagguuuuucuauaaacguggggagagggauguugaggacaguccauccucagagagugaaugauugcauucaucuugauuaaacucagugaauccgugaaaggauggugcagguccgcccccccagacucauccuuccauguguguccucguggccaauuugucuuugcacgggauggaaagcugacgagauggacuauuuuuuuccccuuaaaaauaauuacaugccagaugcucguuccaaguucugugccuccaccaguuaaagauuuuuggaucuuuugcugagaaugcuuguucagagguaaacuuguuagcaucugagacaagcauaauaauaaugauucaggucaggagcuacaaaggacucugugaugagcaaaaaauaaugauugagccuggcgcgguggcucacgucuguaaucccagcacuuugggaagcugaggucaggaguucgagaccagccuggccaacauagugaaaugcuguuucuacuaaaaauacaaaaaauuagcuggacgugguggcaggugccuguaaucccagcuacuagggaggucgaggcaggagaaucacuugaaccugggaggcagagguugcagugagccaagaucacgccauugcacuccagccugggcaauaagagugagacuccaucucaggggaaaaaaaaugcauauugcauaaaauaaaaccuuauauauauucacacacauguguauauaugagauggggugguccuguacaugacagcuaugguuuuaaggccccagugccuuuaaguuuguucuugaaaugguugguagccaguucuucucuccuuggcuucccagaaauccuuuccaacccaagagcgucagagguacuuuaaguaagcaagacuuucagguguugcuucucuggccucccucuuucacaucuauucuauaaaaagaggguggcugcucagcccaauguaaagaaagcgcuuucugaaguugaaugaguuuuacauuucagcucugccaguguggcaguaugaacuugagaaagagacauccccucucugacacuuaauuucccaucuguaaagugagauccacaauuuuaccuuugcggguuggcacauggacuggagacaauauugguaagaugcuguguucauuuccuagggcucacauuacaaauuagcaaugggcuccuuucaacaacagauauuuauucucuugcaguucuggaggcuagaaauccaaauucagggugucaggagggccaugcuccacaugaaggcuccgaaaaauaaucucuucuugccuccucuugguuuuggugguugcuggcaaucucuggcuuguggcugcagcaaucugccuccaucuuuacauagccuucuucccucugugugucucugaauucucucuucuuguaauaaugccagucauuagauccagggcccacccugauccagcagaaccucuucuuuacuuaacuaauuaccugcaaagacccuauuuccaaauaaggcuacauucugagguucugaauagacaugaauucuugggagcaaucaacccaguacagaugucuggcauuuuauugcagacaacaucugggcagaugacagcaucugguauuuuuaugauugucacuuaccagagguauggauagacauuucuugaagaagauaggagcaagccugauuauuugaggaacacgagggccagauagcagaaguggagggagaggugugguuggcuuggcagguggagaggggcagggauggaagcaaggagcuugcuaugugggggugugggagugggguuggggaaaccauauugcuuuauuucaggagagagugauguggccugugucuuggugguagcaaagaaagcggagagaaaaacguagauuuuacauuuaucugggcaauugugccaauaggacuugcacacggauuggauauggaggugagaaaauaagggaaucaagaaugacuccuacgagucaggcugggugguucaugccuacuauaguccuagcacguugcggggcugugaugguuaauacugagugucaacuugauuggauugaaggaugcaaaguguuguuuccaggugugucugugaggguguugccaaaggagauuaacauuugagucagugggcuggggaaggcagacccacccuuaagcuggugggcacaaucuaaucagcugccagugaauauaaagcaggcagaaaaacaugaaaaugcaagacuggccuagccucuuagccuacaucuuucucccauacuggaugcuuccugcccucagacaucggacuccaaguucuucaguuuugaggcuuggacuggcucuccuugccccucaaacuugcagacagacuauugugggaccuugugaucguauaaguuaauauuuaauaaacuccucuuuauauacauacguguguguguguguguguguguauauauauauagauaaaacuccucuuuauauacauacguguguguguguauguauauaucuauaucuauaucuaucucucucucucucucuauauauauauauaucuccuauuaguucugucccuccagggaacccugacuaauacagaggcugaggcaggagggccguuugaggucaggaguucaagaccagucuggacaacuuagagagaccuugucucuacaaaaaauuaaaaaaaaaaaagaaugacuccuagguuuuuggcaucagcaaccuggcagaugcuggugucuucaauggacacggggaagaugggcaguagauugugggcgcagagaguucugugcaggcauguuaaauugcagaugcccauuaauggccacaggagaugccaacuagguacuuggcaaagugagucugggaauugagaccaucaugguaggagauagcauuuggaagauuuuggcagaggugggauccaaauccaugggaguggaguauagauagaaaaguggacauaggacuagacauggccacuagugguagggguagaaguuggggagcuggaaaaggugauuacaaggagccacuggugaggcagaaaaacaugccgggagccuagagaaggaagaccuucuuaaggaaggaggagagucaucacuugcaauguugcuaagaggucggguagaaugagucacacagaagugacuguuagauuuggcaucaaggagguuguugacuaacuuggcaagagcgccucaugggagcaaucaagaggaagccagugaccaaugaaggugacugcucuugcguucugcucucucuucauugccuuuugcucuuugcuuaggcaaaucagugucuucaguagguuccuugaaggcuaaugucaccauuaguauuuaccuacccauuagcucauuugauucucaaaacaacaucuuugcagaaaaggcugggcagggcaggcagguauuauucccauuuuacagaugagaaagccacaacuuaaaaacgucaaguguuuuuuuuucaggcuguuucuuaaaaguaagaguuaugugucaggcaccccuccuccacccccaucucggcauacaucccaguguuuugugguuugcuacauuucuugguuuucuuagcuagauugugaacccagugaagggaggaucugaaugacaucucuauauucccacgcagagauagcaaaugcuugccacacuuguuacuuucucuuggguacccauggcaggcaucacuagcugaucaugaccuucucuuccuuugagcccagacucagcuuagaauucuacccagcauuccagauagccugucaaccugcugacagauaagguaucaucaacaggcauuuuuacuguaguacuuaaugucaugccugguucagcaagugguuuugugacugauuuagcaaauaagcauucucugaaaacacagugagugaguucuaugucacuagagguaaucaagaagagaucaaauucaugcacauggccgggugugguggcucacgccuguaaucccagcacuuugggaggccaaggcgggcggaucacgaggucaggagauagagaccauccuggcuaacauggugaaaccccaucucuacuaaaaauacaaaaaauuagccgggcgugguggcgggugccuguagucccagcuacuugggaggcugaggcaggagaauggugugaacccgggaggcggagcuugcagugagcugagaucgcaccacuccacuccagccugggcgacagagugagacucuguuucaaaagaaaaaaaaaaaauucuugcacaauuggauaagguaaauagaauucagguauuggguaaaagguuauccaacucugagauuaucugauauucauggaguuauuuaaugaacaguaguaucucuuaccauucuggaacaaaacaagaaaccuuugagaggaaucuccccccaccuccccagauauauaggaggggacagugggcaacacuauuauggcuccuuucuuguugucuuggccacuuggggcucuggucucagccuuucuggauugccauaaucuguugggcccuauggagccaaagggaguaaacagaauaguacuguucuggguuguugagggauucggugagauucccuagguagguuuuggucaacaagcaggcauuucauaauccucucuaccuccugcccugcccuggggauugugaggauugucugcauuccucuguggaacuggaauguggcugcagugauggugucugcagagauguugaagcugcuccucucuccugcccucuaucuuggccucgcccgguccuagccgggguaagugaacaucaaucccauggacagagucuucucugaaaacugcuuuauggauuuuuuuuuuuuucccagacagggucuugcucugucgcccaggcuggagugcaguggcacaaucucacugcaaccucagcuuccugggcuuaaguaauccucccaccucagccacccgaguaguugggacuacaggugcaugcuaugaugcccagcuaauuuuuguaucuuuaguagagacaagguuucaccauguugcccaggcuggucuugaacuccuggacucaagcgaucuaccugccucagccucccaaagugcugggauuacaagccugccuuauggaucuuaaugucuuggcccgagggcauuggcucugccuggcuccagagggauaugaagccauuccugggggacaccauuguuuucuaguuaauauuaucaguccuguaguccagugauuuucaaauuuuaguguagucagaaucaccagaagggcuuguugaaacccagacagcuggaccccucccuagagacuuaggaugaggccugagaauuggaucuaacaagcucacaggugacacugaaguugacgaccuuguaucucacuuuaagcaaagucuucccauaggaaccauuguuccucccugcccauagguaauaucuucuacuugggcccucugcuuccacuguggccugcuuacaaccucaccuacacuuauuaacuagcagaguucacugagucugcuuaaaaccuuaaacuucaaacuauaccacaaggcuacaguagccaaaacagcaugauacuaguaccaaaacagagauauagaccaauggaacagaauggaggccucagaaauaauaccacacaucuacaaccaucugaacuuugacaaaccugacaaaaacaagcaauggggaaagaauucccuauuuaauaauggugucaggaaaaccggcuagccauauguagaaaacugaaacuggaccccuuccuuauaccuuauacaaaaauuaacucaagauggauuaaaggcuuaaacauaagaccuaaaaccauaaaaacccuagaugaaaaccuaggcaacaccauucaggacauaggcaugggcaaagacuucaugacuaaaacaccaaaagcaauggcaacaaaagccagaauugacaaaugggaucuaauuaaacuaaagggcuucugcacagcaaaagaaacuacuaucagagucaacaaggaaccuacagaaugggagaaaauuuuugcaaucuauccaucugaccaauggcuaauauucagaaucuacaaagaacuuaaauuuacaggggaaaaaacaaacaaacaaacaaacaaaaaccccaucaaaaagugggcaaaggaugugaacagacacuucucaaaagaagacauuuauauggccaacaaacaaaugaaaaacagaaaacaaaaaacaacucaucauuacuggucauuagagaaaugcaaucaaaaccacaaugagauaccaucucaugccaguuagaauggugaucauuaaaaagucagggaacaacagaugcuggagaggauguggagaaauagggacgcuuuuacacuguuggugggaauguaaauuaguucaaccauuguggaagacaguggggugauuccucaaggaucuagaaccagaaauaccauuugacccagcaauccaauuacuggguauauacccaaaagauuauaaaucauucuacuauaaagacacaugcacauauauguuuauagcagcacuuuuuacaauagcaaagaccuggaaccaacccaaaugcccaucacugauagacuggauaaagaaaauguggcacauauacaccauggaauacuaugcagccauaaaaaagaaugcauucauguccuuugcagggacuuggaugaagcuggaaaccaucauucucagcaaauuaacacaggaacgaaaaaccaaacacagcauguucucauucagaagugggaguugaacaaugagaacauauggacacagggaggggaacaucacacacuggggccuguugggggauggggggcaaggggagggauggcauuaggagaaauacccagugcaugcggggcuuaaaaccuagaagauggguugaugggugcagcaaaccaccauggcacacgcauaucuauguaacaaaccugcguguucuguacauguaucccagaacuuaaaguacaaacaaacaaacaaaaaaccuccacaaaaacccuaucuccaggcuucccauuguaucuccugacuuuuuugaaauccugagcagccuguuccuguugaucgagugaaugagcauucucugaaauugcagugagugaguucuccaucacuagagguagucaagaagagguuggaaucacacacaauuggaugagguaaauagaauucauuuguuagauagacuaugcaggccuaagauuguuuaguauucacggaguuauuuugugaacacuagugucuuccagccucaucaaguggucccucccucuguagccccacauccuggucuuugaucaguucccugacacccuucccugggcaccacaggaccuuugcacuugcuggucccagauccuagaaugcuuuuuccccagcuuguugaaaagcugauucucauccuaacuucaauaucaccuccucagaccaccccuucuaauagacucauucccuaaccuccauuucucaucacuggaugcugcugaauuucacuguggcaccagucauagucuguaaaaaaaauuuauuaaauuauuuggcucuuugauuuuggugugacuccuccccuagagaaaagaaacugacuuuguccuugaacucuguguugucugacacucagugggugguucauacauauucuuuuuuuaaaauuaauuuuaauuuuuauuuuacauuccgagguacaugugcaggaugugcagauuuguugcauagguaaacgugugccauggugguuugcugcaccuaucaacccaucaccuaguuauuaagcccagcaugcauuagcuauuuuuucuaugaaaggugagcaaaugcuuguauacaggcugcagaggguuaggucaaggcugaaccauguagucuaaauuuuggagugacugcagugaagccccuccaugguggaagaaaauggaauguccuuguuggagcuggccagaacugggcagauccagaggcuggagguaauggcaauaacucugacugcuaauaauaaaauaagaacguaaaagagugcuuacaguguguuacaggcacugcuuuaagugcauuacgucauuuaguuuccacaguugucuccauguuacagaggagaggacugaggcacagaguauuacaauaagaaacuuggcccacagucagcgagcaagaaagccuagauucauaccugggcauauggcuucagaguccacacgcuuggcgccugcacugcaccgagaggggcugcugggccgggagucccccaccugcucucuguuuucaaacuccccauuucacacccaugccaggugugaugaaauccucuaggugaugggcaguggacaugagugguucugguuacaguuggacuucacuggccugucccacaccugaggauauggauucuagcccaugggaccauaagccaggcccccugagggucuguuauuugucugggaaguggcagcgcucuuuggaaucuuguucaugacugacaaacacccccacgccccuucagccauaauuaucaccuaguccccagagaagggccaugggugggcugacuguagagauagacgcuugggucucuggcugggaacaccacaugcaagagaagaggccaugggcucgccuuccauccagcugaagucuuucuggccgggcugcaggcuucaugcaacaccuuucaaccuguaaaaggaaaaaagaaggccgggggugggccucagcugcugccacuggcauuguaucacugaagcguuuuuuguuguuguuuuuuuuuuuuugaauaccggaaauuaaggggaaauucggaaaccucauaauggcuucaugaaccauugcacuuggaaaauguacuuuugaaaaauucccuugauuuauuguuuuucggaggcuguagauaacauuagaguauauuauuccuauauaauuuccugaguuuucuaugucaauuacuuuguuuuauuaaagagaaaaaaggaacuaauauugauugaggcccuccugugugccaggcuaaauggucaucccuuucaguuguuaguuacaaagugacccuaugaagcagagaagaugaguauuguuuagcgauggggaaacggagccaggggaggaacuugccccagcucauggcuaggauuuggaauucugucccaguguucauacucuuuuguguugucagguaugaucagccuauguacugcuuccuugacuuagauuuuugugggguagagaauaucaguuguagcucuaaaggggugugauuauuuaugauuuuuuuuuuuuuuuugaggcggaguuucacucuuguugcccaggccggagugcaguggugcaaucucggcucacugcaaccuccaccuccuggguucaagugauucuccugccucagccuccugaauagcugggauuacaggcaugcgccaccaugcccggcuaauuuuguauuuuuaguagggaugggguuucucuguguuagucaggcuggucucgaacucccaaccucaggugauccacccaccucggccucccaaagugcuggaauuacaggcaugaaccacugcaccuggucucauuuaugaauuuuaaaaauauauguguauauguaauaucugauuauauaucacaucacaauuugcugcagagugagguuguccuuccuaaaguacuugucuugcaaggcuauggacagauacugguaauggaaccugugcucagaauuguugggaaucuguaguuuaaagguuugucauuuggaggaauaucaaguaaacccuauggggucaaaaacaaggucuagccaggugcggugguucaugccuguaauuccagcauuuugggaggcugaggcgaguggauuaccugaggucaggaguucaagaccagccuggccaacauggugaaaccccguuucuacuaaaaauacaaaacuuagcugggugugcuggcaggcaccuguaaucccagcuacucaggaagcugaaacaggagaaucacuugaacucgggagguggaaguuucagugagucgagauggugccacuggacuccaaccuggucaacagagugagccugacucugaugauaguaauaaauaauaaugguagcuucuauuuauuguuuacuacuaugugccagacacuauucuaggugcuuuucaucaauuagcucauuucaucuucguuauaacccuauguucuaaguacagucauguaccacauaaugauguguggaucagcaauggaccguauauacaacgguggcccuaugagauuauaauacaguauuuuuacuguacuucuucuauguuuagauaugauuagauacacaaaugcucaccauuguauuaaguugacuccgauguucaguacaguaacaugccauucaggacugcagccuagaagcaguaggcuguaccauauaguccagauguguagugaguaggcugucaucuaguuuuguacaaacucccucuguaauguucgcacaacgaaauugccuaacgccgcauuucucagaauguaucucuacccuuaagcaacgugugacuguccuauuaucaucaccccauuuuacagaugaaggagcuguggcaagaaauugacuaacuuggcccaaggucacccauauaauaaaaggcgggcugggugcaguggcucgugccuguaauuccagcacuuugggaguccaaggggaauaggaucacuucaggagaggaguuugagaccagccugggcaacagagggagacccuaccucuaccaaaauuauaaaaaaauuagccgggcaugguggcauagacuuguggucccagcugcccagaaggcugaaguggaaggauggcuugagccugggaggucaagccugcagugagccgugauugugccacugcacuccagccugggugagagagugagauccuaucucaaaaauaaaaaauaaaaaaaaaaugaaaaaaaaaauaaaaaaaaauaaauaaaauaauuaaaaaaagagcugggacuugaagccagauaauaaggcaggcagagggcauacgaaacacccagaugggucaugagcccgugcaucagucagggucuaauggcucagcugaggaagggagguuuaaggaagagacuguggacagagguguuagggaaggugucagagaagguuaaggagccaacauggaucaugggggugguacaguguugccagggcuggggaggauuggcugcagugugggguacccagccgcugccauguggagagggaccugucacuccugcugugaacucucccuucuucugcccucugaccuccugcuggugccucccauuggcuaaacacaguugauggccagugcacuggggagcuguucuuggagcccacaggcaucugcuucuuggcacagagcagacaauggauugagucgggagggaggggaacuagagaauacccaagucccaauggcuggagaggagugagcagguaaaggggguagaaggugaagucagagaggccgggguccacacuacacagggccuuuggcuuucuucggaaggagcaggaagccaguggaggguuugagcagaugugugcaucacggccacugccaucaggagaacgucuuucucuaugcuaggugugaacagucaccccuuccucucccuuucucaggaugagugcugaggaggaaaaggcccuuuccuccaaugucuucagaggagacgucugcccaguccagacuacgugccucaugccagccagccuguaaaugacaggaaagagaaaggagcagugucucaaaagaggauauucuggaacguuugauaaucagagcccauuguaaagucauguuuugaguuacagcauuuaaaucuuuguuccaguggaaaacuuuuacaggccguccugggcaaggcuugaauccuguuuggaucuccaaaggccuuaaaauagugugggaugccgggagacuggcuccaaaagggaggagaccugugcuggcagcccuggccacaccuuggugggaccggcuccuggccuuggggacccugccacucuccuagcugugcuuccgcagagcuggacacacaaaagcuuucuugucuggauuuguuccccuaagaggguggcaccgaacugguccugcccaugcaggaagcugguccuguccaaccagggaaugaaaaguuggccaguaucuucucaggccacgcuacagccaagucucuuuuaaugagcugguucucuuaggaugcccaggggagggagaacacacuugagugggauggcgaaugaagaaggaagcggcuguucagacagcuuccaguucugucagguucugcugcugugaccaaggcaccaagucaucuggaaacccacugcaggcagcaaccucuuuuucaccuuugugugccccaaagcuugcuccgggaaucgaugguuugggaaacaaugcuugcugucuuugaguccucaguccuguaaaauggggaaaguauacaucagagggcauuugagaguaaggcaagaagcgcuuggcaugugccuggcacauaguaccuguucagcagauucccuuucagcucaggguuagaucuucauccaccucuuguuggccugaaggaaggggagguagguacuauuagccccauuuauuuuauuuuauuuuuuuauuuuucuugagacagucuugcucuaucacccaggcuggagugcaguagugccaucuuggcucacugcaaccuucaccucccagguucaagugaucuucccgccucagccucucaaguagcugggauuacaggcaugcaccaccacgcuuggcuaauuuuuguauuuuuaguagagaggggguuuugccauguuggccagucuggucuugaacuccugaccucaagugaucugcccacuucagcgagauuauaggcgugagccaccacauguggcuuauuagcuccauuuuauaggaggugaaauuagacagcaagaggcuaaaugccauggcugagguaagaucugugguagcauccaagucuugaccccagacuugguguacuucucaucacagaugcaauuuugugccucaucaucugacccaggagcuacacaucugcuuuuuuuuuucuucuuucugagacagucucacucugucacccaggcuggagugcaguggcacaaucuuggcucacugcaaccucugccucccagguucaagugauucucaugccucagccucccaaguagcugggaccacaggugugcgccacuacccccagcuaauuucugucuuuuuaguagagacgggguuucaccguguuggccaggcuggucuugaacuccugaccuugugauccacccuccucggccucccaaagugcuuggauuacaggcgugagccacugcgccuggcuaaaguuguuauuuuaaaauuauuauuuauuuauauuuguuauuauauuuuuuauuuauauauauuuuguuaucuuauuuuuaaaaguuguauggcccauuuaaacuuuugcagaaauaguuuuuugaauccauggauuuaaugcuuuccucuuuaaauuuuuuuuaagucaauuuagaguuuuuaagacaaaaacuggaaaacggcuuugcucuuuuguggaacugcucuggauuuuuuuuuuuuuuuuaagaaagaauuuugcuccaucacccaggcuggagugcagaaguacaaucauaucucacugcagguuucaacuccugggauccagugauccucuugccucagcuuccugaauagcugggaauacaggugugcgcuaccgcaccaggcuauuuuuuuuuuaauuuaaauuuuuuuuguagagauagggucucucuuuguugcucaggcuggucuugaacuccuggcuucaagcaauccuaccaccucagccucccagcgaguugagauuaaaggugugagccacugugcauggccuguguugaauuuuuugucuccccauucccaaguagcaacucuggacuccacagaaaggccgagucucuccaagacccagccgucuuggagggucaucuguccacuccuccaaagagggugagacagggccaauaaugaagugaucacugugcaccaacccucccucuugcuucagaagagaccuuuucaucccugagccaauuaaucaauuucaagagauagcaucugagugagaugggucaccaagucacagaggcccucagcuccugugccggcucucaaaggggguugaaugagguggccuuaacagauugccuaguacccaacuuccuagaguucguauaguagagagcaaguagcauagggcuagaaggccaggucacaauacccucucuggagucuucugaauguaugaccaauaggcaagagccccaguuuccuggucuacagaagugacagaugggacccuaccuaccacacagguucugaggauaaaaauagugauaugggcugggcacgguggcucgugccuguaaucucagcacuuugggaggcugaggcggguggaucacuugaggucaggaguucgagaccaaccugggcaacauggcaaaaccccauuucuacuaaaaauacaaaaauuagcugagugugauggugcaugccuguaaucccagcuacucaggagggaacugcuugaacccgggagguggagguugcggugagcugggaucaugccacugcacuccagcuugcgcaacagagcgagacucugucucaaaaaacaaacaaacaacaaaacagguaauaugguuggaagagguuuauccuugccaaguuuuuguaaaucaaacagcucuugagagaugccuguuuggcuguuuuuauuuuuuuagagauggagucuugcucaguugcccaggcuggagugcaguggcgcggucucggcucacuguaagcuccgcuucccggguucacgccauucuccugccucagccucuugaguagcugggacuacaggcgcccgccaccacgaccggcuaauuuuuuuuuguauuuuuaguggagacgcgguuucaccauguuagccaggagggucucgaucuccugaccuugugauccacccucuccggccucccaaagugcugggauuacaggcgugagccaccacgccuggccuguuuggcuguuuuuuuaauaggaggugggaaucccuugucuuccugggcagacuagaugugauguguucacagggagcuuuguacagauugcuugagagaagcaccuuucuuuccagaguggcugcuuggacgaugccuuccaaagcugcuaaguccuguggcaggggauuguugauauucuucaugguuucucuggggagccuccuagccucugaauuauugaugcaugucuacauuauuauuauuuuuuuuuugagacggagucuugcucugucacccaggcuguagugcaguggcgcaaucucggcucacugcaagcucugccucccggguucaugccguucuccugccucagccuccugaguagcugggacuacaggcgcccaccaccaugcccggcuaauuuuuuuuguauuuuuaguagaguugggguuucaccguguuagccaggauggucuugaucuccuggcaugucuacauuauuaaaagggucucuuugcaugaguuagcagaauguagugcccucucgugaaugagaaaagccgcccaguccugauugcagccucauaaugggucugaaaugacaagugugaagcagugggcagagccaagaccaccuuuauuugugcauccgugcucuuggguggguauguuucacacaguuuguuguccuucugucccuugcccaugaggccuuagaaacucagcuugucuccacccauuccucuacaacccacacaacaacuuguaaccuuuuaaucuucuuugcuuccuaaagaugcaacucaugccaccucccccaggaaguucucccugacuuccaaucuuuagaauaggcugccagagaucccuguguuaacugugaacagagcccuuuucauccucuugcaucagaauuccugucucauccacucgacugaacuucuuggguaggaauggagguguguuuuuuuuuuguuuuguuuuuguuuuuuuguuuguuuuuaagauggagucucacucuguugcccaggcuggagugcaguggcacgaucucggcucacugcaagcuccgccuccuggguucaugccauucuccugccucagccucccgaguagcuggaacuacaggcgcccaccaccacgccugguuaauuuucuguauuuuuaguagagacgggguuucacuguguuagccaggauggucucgaucuccugaccucgugauccaccugccucggccucccaaagugcugggauuacaggcgugagcuaccacgcccggccggagguguguuuuacaugcaucucacugccugggacagcgccuggaaccuagcagguguuuuaugugugggggguguugguuguaguaguggggaaagguuucuuaaaugagguguguuuagaauuuagcccuuugcaggguauaaaaucugagaaauaagguguguguugugacgagggauggcacugggggccugccuaaagcacuggcuucauugugggggcugagguggcuuguuuccuuggagcuaauggucagagugaggagcuggggacugagcuuggaucuagauuauuguugcaugaauggccuaaaugaagaguguuuucucaagucccuauagaagagggagauccucauggcuuucaaggagucaugcccaagauacaggaauggcucucugguggacuggcugggacagaggggagagggugaaaguggggaggaggaggaaguuuaacaguauuugaagcauuugaaagccuagacccaucguacgcugaaacagagaagaauggcuagccaaaaauacugugugagucuaggaacuuaagaaugcuaguccuugaccccaaacauacuuauauagcagacucaacauuauugucuuccaccuaccggaugggauuaugcaagugauaugacccagagcauucuggaagccggcaggggcauaaauaauacauuagauaugcagaugaacugcccagggugucucuggucuugggaagaauucuuaguagaccugagauaauugcagaacagaguguccuguuuucccauccacagccuccaggccuggcgaggauuuuguguucaaaagagauuuccaagguggacaucucucugacacuggcgauuuuucucucucacuugaacaaaacucggcggaaaggucacuccuauuugucuuagcuucucugucacaucccacccacacuuugaaaggucuguucuuagcggggucccaggaaggcugugcuggcccugucagcccugagcugggugguaguccuuuaucagagauacccaugagaaucacucacccuggagccuuucccaagcacacaucguggaccccuccagggcugcacaugugcuuuguaagggcucuucaggugacuggagcuuuaagagcuacugaacuaagugguaauaaaagugaacaaaguaaccagucuggaaaugucaguagaauggaaagaaagaacaggugggagaguucuccauuuuuucacgguaagacccgguuacuuggcuuuuguugagucccugguggguguccauggugucuuuggccuuaucucccuacuaaacaggauuaccuguguggggcaccuuuccuggucuccucucucuccaaggagcagguaguacuuggaggccgugguuaaucacauuuccuaagugagcuuuuccuuucuagaaugauccuugcucuuacccuugcauuccuacugcauguucccucaggcugaagccuuccuuuacaugugagcauucuccuggaucaacucccugaugacuggagccugugccguguguuuccaaguugcacccaccacccacggagacuagcucauggccgaguggcagcugguguagcugauagcugugugggaaaugggucugcacaauauaaagacagcucacaggaaaggggccccaaaugguacucucuuuuuuuuugagauguugcccaggcuggagugcaguggcgcaaucucggcucacugcaaccucugccuuccggauucaagcgauucuccugccucacccucccaaguagcugggauuacaggugccugccaccacacccagcaaauuuuuuuuuuuuuuguauuuuugguagagaugggguuucgccauuugggacaggcuggucuugaacuccuguccucaggugauccgcccaccucggccucccaaagugcugggauuacaagcgugagccauugcacauggccuuuuuuuuuuuuuuuuuuuuuuguuguuguuguuguuguugagauggaguauugcuuuguugcccaggcuggagugcaguggugagaucucagcucacugcaaccuccgcuucccagguucaagcaauucuccugccucagccucuggaguggcuaggauuauaggcgcccaccaccacaccuggcuaauuuuuguacuuuuaguagagacaggguuucaccauguuggccaggauagucgaacucuuggccccaaaugacacuuugauaaguugcucuacccaauccuaaaaaaggaaauacagauaaaaaauaccaacguuguauaauacacauguuguugaugcgcucuguuguuggcaaaagcuguguugcuggacggaaugcaaguggauguggcccuuugggaagaauuauggccuuuuggcauucucuauccaaacuacaaaagcaugugcccuuugaccuggccaucucauguugggacauugggauauuuccccuacagagauaaccuauagauauuuguaggaaaagaacagugcccaagguuauucauggaacauuuuuauaaaagcaaaagacugggaguaacucaaacaucugugaguugaagacuggcaaaugaugacacauugugcuaggcaagaugcggaaaggaauaaggaagugcugugugcacaaacacggggagaucucaggauguauuguugacacaaaaagcacaauguggagcggggaguauggcaugccaucuuuucuguaaaaaaaaagcauggguguagaggggauguaaaaaugugucuuugcacaaacucuguuaggaugcacaggaaaccaacacaagugguggccugugcguggugggaggagggagaugcagggaggggagacuggguuagggaggaagaugcaugaagaagauuuuuuuuuucuuuucagagauaagguuucacucuguggcccaggcuggagugcaguggugugaucauagcuugcugcaaccucagacuaugaaggagacucuugauugcguaucuuuggguaucauuugaauuuugaagcaugaauauauugaaaucgggagcagcucaaacauugaguauauuaucuaucauacauuuaauuuaaaaaguuuauaaccuugucaugauuaggcugggguuaugcauuuuuaggagggagaccccagagguaaaacgucaguucuuaucacaugucaagguuauguucuauucacgcgacugauauaaaucccgguugcauaucccuauaauacaccugaccaaagccaggugugguggcaugugccuguagucucagcuacuggggaggcugaggcaggggguugcuugagcccaggaauucgaggccagccugggcaacauagcaagaccucaucucuccaaaaccacaaauuuggcugggcgcaguggcucacgccuguaaucccagcacuuugggaggcugaggugggcggaucaccugaggucgggaguucaagaccagccugaccaacauggagaaaccccaucccuacuaaaaauacaaaauuagccgggcgugguggcacaugccuguaaucccagcuacuugggaggcugaggcaggagaaucgcuugaacccgggaggcagagguugcagugagcugagaucgcgccauugcacuccagccugggcaacaagaccgaaacuccgucucagauaaaaaacaaacaaacaaacaaaaaaggccaacaaauuugaccaauacuccucaaaacuggaaaagcuggugaccaccaccccuagugcuccaauaaagggcugugggaacaguugugcucagggugguacugguacagccuggcagaggacaugaugcuugcauaguguggaaaggcccucugagauauugcugggccuuaggggaggagguccaggccuagagaggacugaagcccuccccagggcaugguguggaccacgcugaagggaggugggguuggagacacagcugggagucagaucccaggggcucuccugugugaugcugaauugcugggaaggggaugccagcuagucucuuucucugugccaacccugauugguuggguggcugcugagagccuuauggugcccuggcucaguaggaagaguguguguucauuuagugaguuugccaaagacaagggaaggggguuagagaguagguggcagauaaugccggccuggggauccuggagguuuuaggcuggcagacccuggcugaggcuguuuucuguucuuuuccuuaggccuugggagaccuuuaccuuuucagugccucuaagacagggucagagcaguuuggugacaaaguggaaguaaaccaugggugaaaaacagcucuggggacccucauaggcuuccacuuauugaggauuaggcagaacuugcagcuuggcccagcuuucgaaacaagguguucccaggagguggaaagacugguuuucaaucagauaaagguaggauccuaugaaaaacuccuagggccuugccguuccuaugaagugguagcuaucauucacacuccuaguuaugccaucgagguaaaaagagguggaauaagaaucagggacacuugaaaauaagaaaagagaaagacugcgugcaugugcaugggugcacagccuguacauaugugugugugugccccugcgugcacgugcaugggugcacagccuguacauaugugugugugugccccugcgugcacgugcgugggugcacagccuguacauaugugugugugugccccugcgugcacgugcgugggugcacagccuguacauaugugugugugugccccugcgugcacgugcgugggugcacagccuguacauaugugugugugugcuccugcgugcacgugcgugggugcacagccuguacauaugugugugugugcuccugcgugcacgugcgugggugcacagccuguacauaugugugugugugcuccugcgugcacgugcgugggugcacagccuguacauauguguauuugugcuccugugugcacgugcaugggugcacagccuguacauauguguaugugugcuccugcuugcauaugcauggguacacagccuguaacuacaugugugugagccuguggguaugugaggggagugagggacccugagggacuagaaacuuccuuaaaggccauuugagagagugcugcuuucuauaccacccacccuagggcaguuaggcaaaggugugccucccuuuaagaggaccuagcggucggucugguuuacaacauagguuaucagggaguaguacuuuggccuggaaaaggaaccuuuauuuuggaaaagauuuguaaucucuguggcuuguuugauacacauuggaaaccugacuggaaacucaggccaccagcaucuguugggggcacauguuugcacuuuugguuaugaugccacggcccugguucagguauccuaaagaagauaauuaaugaugaaaaugauugguguagauuucauaccacagagcacugugguuuguauaguaagacacagugaugguguggacccaugcacagccagcuuugcagauguuaagaauagcgacuuugccugacauaauuggugucugcacaugggauuaaacaaguaagauugaugugaauuuuauucuuucauuuuuuauguagacucacugauuggguaacuguggaaauaaugucacagugccuuuuuaaguuaagaacauguaguugugaucaggagcgguggcucacgccuguaaucccagcaguuugggaggcugaaguggguggaucaccugaggucaggaguucaagaccagccuggccaacauggcaaaaccccgccucuacuaaaaauacaaaaaguaggugggcgccuguaauuccagcuacuggggaggcugaggcaggagaaucacuugaacccaggagcuggagauugcaaugagccaagaucgugccauagcacuccacuuugggugauagagggagacucugucucaaaaaaaaaaauuaaaaaaaaauaaaaaaagauaaaauguaguuaugaaaagauuucuaagcauuuuuaagcauuuuauauuaaaacaggaauucagaacaaaucaaaacgaaacaauaaaacuggggaugaaggaaacucaauuuuaaauauaaacuuuggcagguggguggugaauccggguguugugagucauuugcuggcuuguuugucacauggccugcucuauaagugucacccuaauugauguauucguuuggagugggugcucuucugagguuuuuguuucccccuuucuuuggggugcacugugugugcaugguaagaacaagggccauggaauuagagaaucuugaguuucuaaugcaaauucaguuccaagcagugugaccugguuguuuaacuccuuugagccacccccgcccauggcccucaucuguacccugaggauaauagugugggcuuugcaggcuuuuggugagcaagugagaugauguagcaaaacacccagcccagagccuagcaccaauuggucuguaauccaugcugcacggacacagccauucucuggauguggccucuucugccuccacugugaggucagagacugagucacugcaggaguaaccucuccuuggcaagcagcgggagucauuucaucccagccuuucaggagggugaaucugcaccugggguccagagucucagagaugagacgugagccaggcgcugauucaucaugaugcaggcuguggagacucuagccaugguuucuccaugcaggagugagguugggauaaggggucuuucugggggcucugugcucuguggccccugcugcuccggacugguucauuggagaaaccugucacauucucuagaccgguugccacgccaugcucacagucucuguucuugccuuccuaggugggaagugagugaugacccugaagugaggacucaucucuagaucuccaagggcugcagcucagccagcacuuuacaagggugaucuggagccaaacuggccuguuggcugaccauaggugacucuggguagcccauacccaggcucagcagcaguuggggagcugccucgauuucugguuacagaauuccuggaacugagucacugcaguaauugcugugaugaauuguguuuacuuugugugggauuccaaacuguagcagcagugacuacagcuggaagacagcaugaucagcagcuuccaaggcagagccuggcgucagaaagcugcauugcgcuaaugcugaagccugugggagccuguuggagagacacuuggauguuuagcgagcuggugacucuccuugucaugaguaagcuuaggaccuugggcaagucauccaaacucuucugggcaagucauucuccugcuuggaugccuugaggcagagaggcagugaggugaaguggucagugcgucgacucugccucuagccugcugggguuugaauccaccugugugauguuguaugauauugaccuuucuggcucucagcauccucuugugugaaauaggagauuuuaacaguaucuauuucguaggguugguguuugaaugaguuaacauauguaaagugaaugguacagugccuggcuuccuggcaagauugcuaucaggauuaaggcagguuaagcccuuggcacacacuaagagcucaauaaaugugagcugauguuauugguccuuuauuacuauucaagaagccugcccagcccuccucccucuccauccacacagcagccugguacccgcuguucucuagguucuggacacacguuaugacauguucugaugaucuggcuuagacaguggggcccucgagguaggcccagaggacuugguccucacugccucuguggcgccuugcacuggguccagcugacguggagagagacucaggaaacaguggcugagugugacuuuggcuggcauagugguugcugagagaacagacaagguucucucucacgacauacagauuucagaucagggaaagucccagcuggcauaaguuuaucgagcaucucccauggacaagaucagcuguggguggagccuugaaguacaugguagaaggacagcgagucuucccaggccagggcuucaagugaggagacaagauauagccucccagagaauuccuauaaugcaaucgugaaagaaccauacccagcaggaggccggggaaagugacuccugcaacucuaggaaggcuuccuggaagagguggaacgugagcagcauaggauuuugagagaagaaauggaaugggcugagggagauucugcugguggagguucagguugaccuaagggcuggcagcaguggaggccccccacgagugaguuugaggggccucuuuagcucaguccaguugaggcagcagagccuuuccauagggguguggugugaccugaauguugggcacguggucguaacugagcuuuaaaagugaaugagaggagccaugcgugauggcucgagccuguaaucccagcacuuugggagaucaaagcugggggaucaccugaggucaggaguucgagaccaaccugggcaacauggugaaacccugucuguacuaaaaauacaaaaaucaguugggugugguggugggugccuguaaucccagcuacucaggaggcugaggcaggagaaucgcuccaaccugggaggcagagacuguaaugagccaagauugugcugcucuacucuagccugucucaaaacaaaaaacaagaaacaaaaacaaaacaaaacaaaaaaacacugucucaaaaaaaaaaagugaauaaagagagaagaaaggcggggcacgaugcuuuuuaagucuacgagcaucuuauagcauuguuuacaucccagcuuuucacugacccuuccuuuacccccgcccccaucccguggcccuugcucuguccugcccuuucuguacggcguuuucucuucccggcuccucugcccccagccccacgugccaacuuguuucagccuggcaaggaggccugcugguaucccagccauuuccugccccaaggccgcccacccuccuccgaucuagcauggccuugcccuccguaggcaggccucaccccugcggcagccgggaagcagggcuccuguuuugccuguuuacccuggcgcagggacagguagaucauguagcacugcugggaugccagcugcguaagucuccggcagugggcacaggcggagggcagggggcauuccucugggcugacucgagcccggccugccuggcacaagacccccugcuccuggaggcagcucaggggcuugcucauggcugcccuggcucugcgcugggccgcugagucaucgcucagcagugaggccucugagucacagugcagcccuggacuggacagugagugccuugugggacccuccugggcuuuccugucccucagagcauuuaaaggggucccaaauugucaugugacccucucugaugccagagagacacucuaggucuuucgcgcccuggucauuuuacagaacuguggcuggaugccaggcauucagagauacauuccucaaucucgguccgccuuacaggauccagcaucgaagaguucaguucaagucagcagccgaguuacaggaaagcagccagggcaaugauucagcaaguccaggcaggagugaaccaggcaagauuucgggaggagagggcugggucgcguguccuggcagggccacaggaagagcauacacaucuccugcgucuucguauuuugugagugucuugaaaugaccuugagaaucuacgcaauaccaugaagaagcaggagcaggaauaccauuuauccauuggcacaggguagcaugcucagugugcacugagguugugaauucuuguccugacccaaagaugcugaugcuguccuuauacccauuucacgguugaagaaacugaagguguaguaggagaagauacugacucagaggcacagaguuagaaagcagcaugucugggauuugaccccagaccugucugacucaguuuacuauuuuaaacuacccgauucaaguuaaguuucucuccucucucucugucucucuuucucccacguggcugcuggaaucuucccuaaggaccauagcugucugcagugcaggaagccaacuauuaaggggaaacaaaaguguucuuaggaguccugcugucacuguggauugagccggugaagcccugagggauuucaucgcugagguggauggagaagcagcugggggccuuggcuguaaggaccccuaaggguuagugucuggagcuugggggaugggaaugggucccggugugcggaaauuggauggcucgcugaccccaaggggaaacccuuguugacgcuguaaagugucuucuggccuuagagaaacccucuaggguucagguuccagcuucacccuccuuuagucagguggcuuugggggggacauuucugcuggcccuggcagacacuggacuagagcaguguuucuaaaguguagccccuucucucucccgggaagggagacaagugggugaggggauuggaaucugcauucauaacacacuccccaggagagacuggagagcaccuuucccggugaacucccgucaugucaggccucagcagacugagcgggaacccccaccagcgagguugcucaggacagcguuucucuugggccuguguuuggaacaaguauccuuugaacuaaucacuaaccugugaaaauggauagaccucgugugaaaaugaaaaugucuggcuucccuucugaggagcggaggcaugaaagguguggccgguaggggugggggccccacaccugugcagccgcccuggccagagcccacaagcagcguccccuggucaugccccacucccuucuccauaaucucgccccucccugaccaggccaccugacguugccauuuauauucaaguucauuccguuguuauucuuuuagaaaagagagaugagaaauauuucuugugccuacaucuuuaucaaaaguagagcaagaaacuugaggacucuguuucuagaaaaaugagagugggcaucccucuucucugaaaggaagaauuuccauaccugcccucuacccaauguguagacgaaaggaugaguguccuuuugguguguggagagcuuugauggggcaugugauguguagggcuuaggggguaugcugggguggcugggaaaggugguuggguguccugggaaggcuuuuauagacacugcguggcaggccuaggacucuaagugcuuccagccagcuguacauacguauauauuuuuuuuucuuuuuuuuuuuugagacggagucuugcucuggagugcaauggcaugaacuuggcucacuguaaccuccgccucccagguucaagugauucuccugucucagccucccaaguagcugggauuacaggcaccugccaccacgcccagcuaauuuuguauuuuugauagagacgggguuucuccauguuggucaggcuggucucgaacucccgaccucaggugauccuccugccucggccuuccaaagugcugggauuacaggcgugagcuaccacgcccagccccagccagcuauauuaacucaauggaauucuuguugaggacuaaaauggaguuuuuguugaagacuaaauaaguaaaugacaguggaguauugucauuauccccauucaauagauaaggaaauuaagguuuagagagucacaguaacugguccuggcuacacagccagucaggagcaaggcuaacauuuaggccuagagugcucuccuaaccgcuaugccuggggugaggagggaaaccuuccauccuugugucaucccauuugauauauuaguuacugaagcugaagcuaaaauaauccgagggcugggcgagguggcucaugccuguaauuccagcacuuugggaggccgaggcagguggauugcuugaggucagaaguucgagaccagccuggccaacauggcgaaacccugucucugcuaaaaaugcaaaaauuagcugagcgugguggcaggcaccuguaaucccagcuacucgagaugcugaggcaggagaauugcuugaacaugggaggaagaaguugcagugagccaacauugugccacuguacuccacccugggauacggagcaggacucugccuaaaaaauaauaauaauaguaauauaauaauaauccgagagugcuuaccaugugccuacauuguucugggauacugagaugaauaagaccucuuuugggcucuugaugacuugguuauaagaagaggcagcucgguucccccagggacucucaacaguuagggacaggcuggggcaugguggcuccugccuguaaucccagcacuuuuagaggcugaggcaggaggauggaguauguccaggaguuugagacuagccuggacagcauagugaggucccaucucuacaaaaaauaaaaaauuagcugggcaugguggugugugccuauagucccagcuacucaguaggugaaagaggaggagaugggagaauugguugagcucuggaguuggaagcugcagugugcagugaucacaccacugcacucagucuaggccacagagugagacugccucaaaaaacaaaacaaaacaaagcaaaaacaauuagguacagaaagggaggagcauccacauuuucugacauuguuuauugcuuuuuuacccucauguucuccccucuccuggcauugccuggcacuugggagaaguuucauaaauauuggucgaaugaaugaauggauauuaaaucauuuguguuuucuuuugugaguugaaaccgucuucaaaugagucuucaaagugcucugauucguaugguggagugugaugaaguuaaacucuggguugagaagagaggaaaugugaguuaaggaaauaaagagaauggaguugaauguucagaaucuuuggagugcugucagggauccaugauucugaauucaguuaucaucuuuggugugagaaauccccaaagauucaaacuugucaccagaaagguggucuuaggcugggugugguggcucaugccuauaaucacggcacuuugggaggccaaggcggcuggaucauuugaggucaggaguuuaagaccagccgguccaacauggugaaauacaacaugguguauuuugugucucuauuggaaauacaaaaauuagccgggcaugguggcgggugccuguaaucccagcuaccagggaggcugaggcaggagaaucacuugaaccugggaggcggagguugcagugagcggauauugugccauugcacuccagccugggugacagagugagacucugucucaaaauaaauaaauaaauaaauaaauaaauaaauaaauaaauaaaagauggucuugagguuucgguuugggcauagguuaccuucugcagaaugcaugugagugauauggagacaaguuuuaacaugggcacuuuuugaaaacagacaucuuaaauauuggccaaaaggccagaugucaaaguggacuuucuauuuuugauggaaaauuucaagccuguuuucuguaaaggaaugauuauuguacaaggauuucuggaacugcaacuggcccauagaugguggccauuauaguaguuuccuaugaaaucuacuaauguacagcaagcaguucugugacuuucagucaccacuugguuucuuuuuuuuucuuuuucucuuguggacuacacuugaagauucuuuuuuuuuuuuuuuuuuuuuuuuuuuugagacagggucuugcuuaggccggagagcaguggugcuaucauagcucauuguaaccuugagcuucuggguucaaaugauucuccugccucagccuccugaauagcugggacuuugggugugugccaccacgcuugacuaauuuguuuacuuuuuguagagacagggucuugcuauguugcccaggcuggucuucaacuccagagcucgagugauucucccgucuuagcuucccaaagugcugggauuaccagcauaagccaccacaccuggccugaaggcucguuuguaauggcacucuuaagugagauaaauugaguauuuucuuccucacaaccuucuuaugcuugucuguaguuggcugucucauuuuggacaauuuugauugucggcuuggcucuucaacugccuguguuguuguauucuuagaacacacagaacaaccaggucugggcuucuuaucuugcgaggcaggugaagaaagacuaggaacaauguauuugggugcccaccucauaccggccaugaccuucuauugaggaacagcagguagaugaagcagcuuucucauauuacgccguggcugacuccaaacuugaacucuggucucuguuuuuggagcuugcuuccuuccuacgacccuagacugcuccuccuaaauaauuaaguggcaaacauggcacagacaguaaccucacauaagaagcuaugagguuaggacagaaauauccacugcuggccugcgaacuauucacacaggucugacuccccgccagaguccuggcugcccugguccuguggaaucccgucauggcuucugucuaaacggagcaggcucagggccaugcugaacuuggagaaaucugugcaggagucagauuugggcuuuagagucaccugggguugaaucucgggccugcuauuuauugaaccuguccuagccucaaucgccuuaucuguaccauggggaugauaccaucuaggucgaagguaguugcaggagauucucaugcacggaggcccuuggccgucauuuguuucuuugucucuacaagcagagaggcugagucauacagauccugaggggagaucacuuucucuucccuccuuucgugugucaucuccaccuggguguggugagccccaggaauaaugcugugacaucaagccccgugaacaccuccuuucacacggaccccgugacuggcugcggcugccagcggugaugagaacugaugacacuccagggcuaccaggaacggugugugugccucugggcagggccacuuccuagaaccauggggcugcucugugaagagaaccggcucccagugagcuccaggagacgaggagcagguccugguggcggaggugcuggcgcaggaggccggcuccuggcagaaucggcuuccagcucugggcacuggggugcggugugggaccagcaacaggcugcuccucugccaggaaccgccagaaccaaagucuucucgaaggcaucuucagaaggcaagcacagggcugagcacuccggagaggagccuuugggggaaaacuuuuucucggagcuucggagcucagggaguacuaugggggagauucacuagguugaugcuuugcugauaggcagcccuguagagaagacaaggcagcugggcaugguggcucaggccuguaaucccagcacuucgggaggccaaggugggcggaucacaaggucaggaguucaagacuagccuggucaacauggugaaaccccgucucuacuaaaaauacaaaaaaauuagcugggcgugguggcacgugccuguaaucccagcuacucggaaggcugaggcagaagaauugcuugaacccaggagguggagguuguaguaagucgagaucacgccacugcacuccagccugggugacagagcaagacccaaucucaaaaaaaaaaaaaaaaaaaaggagaagacaaggcgacaacugugagcuuucugucuccuguggaguuuagcacuuggucagguggccauuucucucccuccuacucggugaccuucucaagggcaaggggcuccuugaagagugucuuucacauugaaacaugcacagaaugguggcuuaugacccaugguagaggcgugaacuugggaugccacuguggacguguccccagccucccuccucauugguguacugauaucguguugccuuggaccuauuaccucaccucuuccuggugauuucaccucaauauccccuuucuccuaugcuucuguuuuuccuucuacccuuccauguuuuuuucucccaaccauucuucuguauuuuauuccacccagccacccuuucaucuaaccagccuuccaccuagcuaggcuuccaacuaacuauccuuuuuuauugagacagaguuucaaguggcacaguugggccacuuguuucugaugggagccacuucucaaacaggucgaugacuaggacuuuggacaaaagcaugggugcaggcugggcgccguggcucacaccuguaaucccagcacuuugggaggccaaggcggguggaucaccugaggucaggaguuugagaccagccuggccaacauggcaaaacccugccucuacuaaaaauugaucaaauauagaucacccguaauuaucacccaucauucugacacuuagcaauagucacccuuaacaucuuguugucuugcuuucagaugguuuuguuuuugacauguuuuuuuuuuuaacuuauauuaugaccaucuccucuaugucuuuuaaaguuuuaaaaacuuguuuugaauaucuuuuccauauuucauuaugcaccuguacaggaaagguacuccauaaguagguuuuucuucucuguaaaauggggaaaauaagaaccccuucuacaugggguuguugcgaggaugaggugaagaaaguugucaaagccccucgcuaguaccaggcacagagcagguacugggcgcauguugccugcuacugguauuauugucauugucauugcuaaucaucagccaagucaguccugcggggcuuucagauuuccucugcuuuuaccuguugcaagguauaaaccuuuucaugugucucugauuguuuucuuggcagagccacccacaccccaggaauuuaauagggucuugaugcauucccagcuugcuguugaggaguauuuaaccagucaccacuccacaggcaauauuagggguugcugaggcagccuccaauagugugagcauucuaauuacugcagcaaacucuuuuaaaaaaauuuuaacuuuucuggcugggcgcguuggcucacgccuguaaucccagcacuuugggaggucgagguggguggaucacuugaggucaggaguucgagaccagccuggccaacauggugaaaccccaucuuuauuaaauauacaaagauuagccaggcgugguggcaggugccuauaaucccagcuauucaggaggcugagacaggagaauugcuugaacccaggaggcagagguugcaguaagcugagaucauaccacugcacuccagccugaaagacagagugagacuccaucucaaaaaaaaaaaauuaacuuuuaauuuuuauuuuuuagagacagggucucgcuuuuucacccaggcuggauugcaaugauacguucauagcucaguucauaguucauagcuuagaccucccaagcucaagagauucuuccaccucagccucccacaggugcacaccacuaugcccagcuaauuuuaaaauauuuuuuguacacaugaggucucacuauguuaccaggcuggucucaaacuccuggccucgggcaauccuggacuccccagaugcuggaauuauggguugagccauagccugcagcaaacucuuaaaacaugaggggaacuaucuuguuauaaaguugcuuuucuuugacuacuggugugguuggccagcuuuucauguuuauggcuuauuuguguuuguuaacuggucauuuccuuugggguguuagcaauuuuuuucucauugauuuguaagaucugucuugauuaacuugugaauuuugcagaugguggaaccggggugccccacaguaaguccccuuuguuaggcauccugucccuggauucgacaccuccauuucuaugggggacauuucuuuacaaaucugcaucugauugugauaccaaaccaugcuuugcaagugaauacaaggaucuaccccauuaaucugggcaguugcuaguuuuauuuauuuauuuauuuauuuauuuauuuauuuauuuauuuauuuuuccgagaccgugucuugcucugucacccaggcuggagugcaguggcaugaucucggcucacugcaaccuccgccucuuggguucaagcaauuauccugcuucagccucccgaguugcugggauuacagguguccgccacugcgccagcuaauuuuuugcauuuuuaguagagaugggguuucacuauguuggccaggcuggucucgaacuccugaucucaugaucuuucugccucagccucccaaaaugcugggaugacaggcaugagccaccgugccuggccaguugccaguuuuuaauguucucaggugaguggcauuugccaaggaacuucucucuucccuucugucuucauaaacaaaaaauccuacuaacuucaggugucaguuuaaaagucaucucuucugggagccccaccuuaaaccccuaaaucagcuguuggcgucggggguggacuucuccuuuguugcaccaauugcaauuucuuacuuaggugugugcuugugggaacauuuuuguaauaucagcuucucugcuaaggacagcgaucaugucucuuuuaucauuugguauguguugcugcagcacuuagcacagugcuuagcuuggaagccaaagcccagagggguagaaugacuugcuugaggccccucagcuuggaccuggcagaucugggacccggugucugggcccaccuucaagcuggaucccucaggacccuguguaccuguggccagggcuuugcuuuggugccuggaugagagugguaagaguugcugaggugccaggccuuugcccccaugcccgcuggcaucacugauuccagguuauuuuggcucagcgcggauggagcgagauguaggggaaagguugggaccggcuuccaggugauuggcacaucccugcccuaaacccugcauggcuuuccugggccugccauccaaggggaaagaagccucuuuccucacaagcugaagcuugaaaccaaucaagcuccaggccagagaagcugcagguggggugugguuugcaguggggguggggcaggaaagaaagguuacguggggugaaggggucaggucaauucaguguggguuggaaugcugggguccugggugagcagggaugaaggacaccuggggaggggagagagccugccggcuggaacuggggcccugccagucccccgcugcaugagucugggcaugcuuccaaucucugggagccucagccuccugucuguaaaauggagcuaaugaggccugccgucaggguuugugggcaagauucaguaacuggaugccugcuccuggcccuuggcaagcauucaauaaauguugauuucucucccaccccucgcuccuucucuuauucuuuuccuguugcuuuucacacggacauguguugaauguggcaggauauuucuuucuuuuuuuuuugagacagagucuugcucugucacccaggcuggagugcaguggcgcgaucucggcucacugccagcuccgccucccggguucacgccauucuccugccucagcccccugaguagcugggacuacaggcgcccaccaccacgcccggcuauuuuuuuuguauuuuuaguacauaugggguuucaccauguuagccaggauggucucgaucuccugaccucgugauccgcccgccucagccucccaaagugcugggauuccaggcaugagucacugcgcccagccaggauauuucuaacacagagaaauucucaguggaggccgcgggaacuagagauagagguccucuugccuaccaaagcaccagauggaggugacagaggccaucuuguccuagagggaccuggcuaagaggaucuaagaccagaacuagucugagugcuugggauucauauggggcuguagacggcaggccugcuugaacaccaguguuccaaucccacaucucauucuuagagcuguguggcccugggcgagucucuugccacuauuucuucauccugaagugggcaccacauuacugcaccucaauuuggacgaggauucucaggauggggaggugguugaaaucauccaggggucacuggaaucaggaugguccuggcuuuuucagaaggacaaggugguaggugccaaucugggggcuuugcagauauugaacggcagccugaggauggggauaaaccuggguguggcagacagaauuaugcuucccccaaagagguucacauccugaucucuggaacauggggaugucauaugccauacagagaagggaaauuaaagucacagguggaauuaaagcugaccuuaaaagagggagauccuuuuagauuauccagagggcccagucucaucacagaguccuuacaagugggcgagagaggcagaagaaggguucagaaacaugugaggugacaaguaacauugcuggcuuugaggauggaggaaggagccaugagacaaggaauaaccgucccuagaaguuggaaaaggcaaggaaauaggaacucccccagagccuccaggaaggaacacaguccugcuaacacucagugagacccacuuugaacuuuguauguucagaacuguaucauaauaaauguggguggauuuaagccucugaguuuguacuaguuuguuccggcagcccuaggaagugaaugcaaugggcgcagcauuugauggccagccuggcauccagccuguggggagugggagcugagggcaguccaagggaaauguccuuugaguguggcaccggcaggcaaacccuuguuugggugugaucaucagugaguugggccacugaagcugccuggugaccuggcagggauggcuuaaguaggcaggguuugcagaucagcgagauaaaggggcuugcauaaauucacaugcccauggcuucucccucugacagcgcagcccugccuccggcugccuggccaggauggcguguuggugcauuagggaccccuuccucuccugcccugcuguuuaaauuguuggucuguuggcguucucaggagcccuuuaccaguacccuuaggccccagacgaccuacuccucaagcugaucauaucugcuggcugugucccugcucugggcccagcacccucaugguuuuccauaacacguaucccaacuccugcugaugggacccucgugagcugucuguguagggagcauggcugccccugggucugcuuuccugccccugacccacaggaauaggauguggcagagugggggccagaugacagagaugcuggugcucucugagcugaggcccacugcugaccugcugguggcuuguccugcucuuggaucauaggcacugggacauccugccuuccuucaguguccccucccacucccucuccuucagcaucagaggaaugaaggaggccuggaggaguagccccuaucuaauagagacaggagugggcugggugagcaugggguggucgcagggggaaggggauaggagauggagagaggaaccugcuaucugguggguuccaggauggugacagacaguggcagaagcagugcagagaccuuaguuugugcuggagguucaguuaaucacuggugaaggcagacaucacugcaggagaccagacuguuauguauugucugugcauucauauuaguacacagggaagaucuugggcuccgagaccuaggcagaucuugccucccaucugccgacccuccgcagaugcuacacauuaugccagguaaacacauuaucaaggagccuugggccguguuagaggaaggcuccuugugccugugaggaguuugcacuaaugcuauguguguuuguguguaaggcuugcauucacugauucacuguagaggaugacuugaaacccaagucaucagcugggcagugcaugggcugcucgccugaauggugaagcucuaccaagugguuuccaccuagggccuggcuuagcuggccucagaugcccuucucaguucugcucaagaccugccugcggccuuccucgggcuugcuugcccagaaugcuaggaauggccagggauacugccugggcauguguuuggccucagccaaggucaggcugucaggaaggaagaagggggaggggcacacuugccugggaggguggaggaggagggguccaagccgccacagccuggcaguccuuuuuugugcaaaggagacccaucagcuccucugccuggaacacccccauuuacuccuccgcaguuagaggggugggaggugaggaauuuugugaggggaauuaucucugaucuugaugugcacauuccucggcaguaucccgggcuuggccagcuugcugacaccuggcuggaauaacaaugagcgaugcuucuggaggaugcuccgcuggggagggcucugcugaaccagcacuuacucccugcuuuucgauccucacucugccuuccugucugacaaaggccgggcuguugggaugguaaugcccucugggcuggccuugauugaagguaaaaaaugaacuucgaggauagccccuguggcugugcagucucauuuuuuaugcagauauguugggggaugcagagacaugguggcgggugggguggggagaaggggacugggaaaucugagaccugaagcuaagaucugagaugucauccuuuauggagcaucuccggaugaaaaugucccagaggcccuaggucacucacccucugcccccuaauaaaaucacuguugcugccuccugcugaaucugaaguaugccuucacugagggcaggacguccaucucaacuauuaucaaaggaaaacauaacaagaggcaacagcacagcccccggggcaugaggcuccuuccucugugaucccucuguccuugucugccaguguuuuuuuccuugacuuuuaaaauaaucuuuuucuuauuaugaaauagauauuuauuuugcuuaacaaagaauucuguaguccuucuagaagcuagguaacucuucuaaguccuuugcaaauauuaagucauuuaauuuaauccuagagcaguucugcgagguggugggaagaccuagagagguuaggguccaccuuagcacuagcucucugagcuauaaggccucagggucuguggcauucccuacucacugaaaagaagggaauuuaaaacaugaguuccaccacccagaaaugaaacaguguucauuuccagaauccaggcauaugguugauuuuaccaauuuccugucacuugaaucacaguuuuuuuuguuuguuuguuuuuguuugagauggagucucacucuauugcccagguuggaguacaaugguaugaacuuggcucacuacaaccccgaccuccuggguucaagcaauuuucgugccucggcuuccagaguagcugggguuacgggugcaugccaccacacccagcuaauuuuuuuguauuuuuaguagagauggguuuucgccauguuggccaggcuggucuccaacuccugaccucagguuauccacccucagauuauccacccuccuacaccucccacagugcugggauuacaggugugagucacugcaccuggcccacagguuuuuuuuaauaguccuguguguauaauuuugcauccuauuauuucuccuuccuuuuaacauauauauauauauauauauauacauauauauguacauauauauauauauguauguauuaucucuuuacuuuuuaaaaguuucucagacuuuaagaauuacuuaaaauuucccaaaacaaacccacaggcacugcugugaucuucaggcacacuuugguauucaggaguugcuucugcuggaccaaagucaauaacaaguagcuuaagaagcuguagauggcagagauaauauugacuggaggcuuaggggucugguucaggguggacucaacaauuuugcaaguucuauauuguuaaaauuacaaugaauuauuuauaagcaguuguuaguaaaucaugaaguuggcauuauuauucuuuauuuauuuauuuauuuugagauggagucucgcucuguugcccaggcugaagcgcaauggcaugaguucggcucacugcaaccuccaccucccagguuccagugauucuccugccucagccuccugaguagcugggauuacaggcaugcaccaccacacccggcuaauuuuuguauuuuuaguagagauggaguuucaucauguugcccaggcuggucucgaacuccugaccucaggugaugcacccaccuccuccucucaaagugcugggauuacaggugugagccaccacgcuuggccuauuuuuuauuauuaaaaaacaaaaugaugcugaugcuuucaaauauguauugcagucuuauuacuuaguauugagcuuugcaguguuggacuaauaucacaagucgaagggacaaagaagaugguagacaauaccaacuguuucccauuaggcucuuucccuccucuuguuuuucugagaccuuaagggccugguuguuucuacuguucccugcuacuucauaaccugcaagcuugagaauguuugucauuuacaaauuuuaccuuauaguagaagaacauaguaaauaauuguaccagauugaguaguguccccccaaaauucaugccuguaugaacuucagaacauggcauuauuuggacauaggguuuuuguuuuuguuuuuguuuugagauggagucucgcucugucacucaggaaggagugcaguggcgugaucucggcuuacugcaaccucugccuccuggguucaagcuauucuccugccucagccguccgaguagcugagauuacaggcacccgccaccaggcuuggcuauuuuuuguacuuuuaguagagacagggugucaccauguuggccaggcuggucucgaacuccugaccuucagugauccuccugucucggcuucccaaaguguugggguuacaggcacgagccacugugccugguggacauugggucuuuuuagaugucauuacuuaagaugauaucauauuggauuagggugggggcuaaagccaaugacccauguccucagaggagaagagagggacauaggaaagaaggauuuguagagauacagggagaaggccaugugaccacagaggcagagauuagagugacacagcuacaagccaaggagcuccaaggauugcaggaagccaccagaugccagaaagaggcaaggaaggaucuuucauggagccuucagagggagcacagucccgcugacaccuugaucuuggacaucuaguccccagaacugugagagagugcaucugcugauguaagccacccaguuuguagcaauuuguuauggcugcccucagaaacuaagacaguagccaacacagaaccaaauacccuuuggggauugagggaaguggagcgggagaaugagcggcacucccucccuuuacauaggacuacuugguaaauauuuacugaaugaaggaaagcugaaguaucuguagaacuggccauuucauucugcauuuagagcucugggagcucuugaaaugucuagacaaacauccucuucagcuagaggaagcuccuucucccacuuacuagcuaugagaucuugggcagauggcuuaacauuucugggccucagugaccuuacuugcaaaguugucugggucaaggcaaugauuaaaugcgaugaugcauguaaagccccagcaugcagccugaaaaugugagcccuuauuauuuauacuguuugccaaaguggugaguaguguugcugaauaugccguguguccuauuaacucugugacggccacagucacgucuccuuucugccuccuccuccuccuccucucuguccagugacuagggagggcaggaaguucagagggugaaaugcugaauuaauuccuguccuccuggucuauauuccagaucacccuguggguggguugaaaaccaugcccugucuaccuccucugcaaggaaaaaauaaagacagagagcaaaucuaaaacacgcaaugcagaggaaugguuacugccugcugugugccucuccagggagcaccaggaggggcugugugggacagggacacugcguauaagugacacuccuccacauuuuggccuggaguuagcacauacaacugccuuuuugcugacgcgaugcccaggagcccucucaggggauggcaaaucucagaauaaauguguuuuuuacucauggaaugcaggggaauggauaugaaaacuuuuguaucaaauagacauuagcgaggagagggaugcuucacauccuagguuugugugaugucggcacagcugaugaggucuuugcaaauuuugcugcugaggaagggaugcgcuggacucccaguguccaggggcccucugcuugucuguccuuaggcagaguccaccagaaucggguaaaguaugugacugccucuuaguguagggcaugacgucaacugugaggagaagagaucaagauacagcucuuuggugguguuuuuugacccauauccaggaacuguucccacacccagagaggaauaucugcaaguucuggugccagauguugauucaaaaacaaaacccagcgaagcaucuguacuuuuuuuucugauuguauuagaaguacaguccacaauaauauauuguacauuuaaaaauaacuggcugagcgcaguggcucacgccuguaaucccagcauuuugggaggccaaggcaggcggauccccugaggucaggaguuggagaccaaccuggccaacauggcaaaaccccgucuccacuaaaaauacaaaaaaaauuagccagacguggugaugggcaccuguaaucccagcuauucuggaggcugaggcaggagaaucacuugaagccgggaggcggagguugcagugagcugagaucaugccauugcacuccagccugggggacaagagugagacuccgucucaaaaaaacaaaaacaaaagaacccucaaaaaacuaaaagaggccgggugugguggcucaugccuguaaucccagcacuuggagaggccgaggcaggcagaucacugaggucaggaguucaagaccagccuggguaacauggugaaaccuuaucuccacuaaaaauacaaaaauagccgggcuugguggugggugccugugacccaagcuacucuggaggcugaggugggagaaucgcuugaacccaggagguggagauugcagugagcugagauugcgccacugcacuccagccuggguggcagagagaguauccgucucaaauaaauaaauaaguaaauaagaguuuaauuggauuguucguaacacaaagaaaggguaaauguuugaggugauggaugccccauuuacccugaagggauuauuaugcauugugugccucuaucaaaauaucucauguacccuauaaauauauaugccuguguacccacaaaaauuaaaaauuaaauaaaaaguucauuaaaaauaacuucaaacacuacagaaauguuaaaaguagaagugaccuuuccguagaaugucaugccuguacuuuggcagagaauuucaauggaagcauccagaaaacccuggcucggaaucugagcuugauuauuucaguguuucaggucucacaugggggacagucuugccacugucaaaggccaucaugagaguuacagcagacuuuugaugaaauuauguccacaguggucccugguccuuugugguuugagauauauucuuuguccccacgccugccccuugcuucagaucuucuaggaauccagauacauuaaagcaaagugacgggacagcccuguccauuuccugaucuguugcugacuguaccacugagcugcucucuccuacugagccccgcaugguuccuccuguuuuccugcccucucacuugcugguguuggccugcucuggcuguucugcuugggguuaggugaggauauggggcagaaggcuuccagccuggagcgccuauggugucccaagacaagggccugccucuggccucuggguguguccuccugcgaguuuuagagaaaucugggcaggcucagacugaaugccugcuucuccuugcagccuucugaagauucccaugacacacaccugauuuaccuucagcucuuuuacuugcuggguaagcacagcccuggauuacuuggcaucuggaauuaacugaaggguaacacuuucuuaaccuuauuuggaaaaugaauaggaaggagaccccuucuaacuucuggaagcacaaaaguguguuuauccuucaggagcauucuuggcugcugaaaaaucaucauggcuagcuuucacuuucacguauugagcuaguaggugguaucaauaguagcuaauaucuauuucauguuuuuuuguguaggagggacccggcgugcaauuugcauggauugucucauuuuauccucccagcagguaaaagagcugggagggaguaaagggaguuguuaauuucugagaaggaaggugaaacuuaggaauguuaaauaccccucuugguguacacaguaugcaauggaggcagggugcaaaugugcuauggagauuucagagccugggcuucccagaggaggccuuugccccacagaaucuuugcuccauuucuccacuuugcugccucuaugaaucaaugauucuguguuguccauuuuuccuuugcaaucuuuugccaucucuucauuaaaaauggucuccaucauucuggccaagcacagugacuaacauacaauaggugugcaguaaaugucuaguggaugaauacccagugugaacauuaauugagcaccacuagcugccaagcagccaagcacccuauaucugggagauguagaauuuaaggcuguguagucacuguccucaagcugcucacagcuuuguguaagacacucaagggaacaugcaaagcucagggcagcucaauuuggggcgaggguuauggagaaaauacagucugcaugcuuuuaguacaugcaguucugcaucuuggggugcagugcuagagugaaugacacaguagaggugacaggcuuaggauuuaaauuugauaaugucaugaugccaugggagcacuggagaaggggcagcaguggauucagcugagagucgcaagggguuaaugagaagauugggaaaggcugcacagaggaggagaagggcuuuguaggaugaguagagguucaccaaggguggguaacaguuagaggaacagcagguacagaagcccagaggagaaucagugaaugacacauccaccauguccagagaucagggaugguugcagcugaagcuaaaaguguaagagcuuggacuguggaucuucaaucccaguucaucuuauucccacccauauggcuggugcuaugguuuugucaccuguaacacaaguaugagacugguaccuuccuaggagggguguugagagucugagccacacucaaauucuuggugugcagugucucugaucugaaaugugcaccgugaauguuagcaguggguauuaccuuuggccugauugugaagcggguuugagacagaagugaagcaguucaauuuguugugugaucuucuucuuccccaaaagaagguuuucauccuccuuaaggcuuuugcccacccuucccuuccuucacaucccugguggguacccuucccaccugcaggaagccuacugaucuuugaguuuuggccugccaccuggcccuucccucgcucugcagucuugguuggccuccagguguguguguguguguguguguguguguguguggguguguggcccugggcugcacugugccugcuggagcaggugcaguugcccuuucaccaugcgugcuucuuuggaugugaccccuugggugccuguguauuuagaguggaggaacguccuccacuauaaugaugagaagugucauugcuaguugcacucaguuuucuaugguguuugggggagaaauuggggugcuggauuuugguuuuaacucuuucccaccuuaaccagugacuguggaaaguugcacaucguccccuuccucacagcuggggucuguucuuccuccggguguuacgguuugugagagccaggaggguacacagagguggccugauuucuggagccauagcaagaagggagagguguguguccucucugucucugucucugucucugucucugacucugucugucucugucucugucucucucucucucucucucuucuuucucccucucccuuuuucacauguuguuuucugauuauaagaggaauacuucaucauuagacauauuucgagccuccguuccucaucuaugaaauaagcauaguaaaggacugaaggauuuaaagggauguggccaagugugcaaagucauaugugcucaauaauuuauuuuccuuguuuucuuuuccauuuccuucuucuccucuaaggcgcuccacaucuccgugauauagcguguacuccuuuccucauuuucuuuucucugagacaaagggaaguuccuaguucugcuauuuccuaguucagugaccuuggacaaggcacccuggggagccuuagcugcucauaugcacaagcuucuagcaacugcuuccaagggaaggguggggaggaagggagacccugaguguuuggaccccgccugugcucagcacagaauggagcucaguaagggcaggucgugggcuccuucuucucccuuucagcaaccaucacucguauucuuuuuuaucuccaaggccucaugcuggaaagagauugauugcucucugagcaguaaguccucugaaacaggguuucucuggggaguucuguggcaccccugccuuaccugggggaccuggcaaagaggcacccuccacccccccucacccucagccagguuuacugaacagaguuacgggguugggccuccggaucugcauuggagcaaguccacagguggugcuuaggcacacucagguuugagagccacugaccuagaggggaagacugggagaagccuuuuaagagaccaguacugugacuugcaccauggagacaccuggaaaacauacagugauucacacacacgccccaaacagcaguguguguguguguguguguguguguguguaugugugguuucacacuugguuugcuaugaaugcuguaaugccacccaguucccacagagcucuggggacucagguuccccaagucaggguucuuuucuggagugcuauucugacagguuuuuauuuuuauuuuuuuaauuauuuuauuuuauuuuuauuuuauuaguauuauuauaucugacagguuuuuaauacagugaauuuguaugucuccuguguauuuauuuuagcugcucccuucuuuccccuucucucccuuuccucucaucuccucccgcuuucguccuuuaccuuucccuggaugauauuagcauuacccguacacucuucccaucuccuggccccuccaguucugaagggauggggacuaagugggaucuguccucuaagcaggcggaggagggaaccaugucagcuccuaggugcccccagagcaccugcugccaguuuuccacaacuccuguccuccguggcgcuugggugacagcagagcagagccgaugugccugcuccuggucaugggcuguucgugcugucaucgcuuucauuugccccauccccccaauuuggacuuacccagaauccuugggcaagcuagauggcugccaaaguuuacuuagcgagaugugccugcgugacuugaguagagaccugcuucugagaaagucagaagugcauuccaaagucaggagcgugaccuccccggaagcccagcuaauccagguuuuaaagaggaguuggaacaaagguggugcuuaugggauguauggagcugugggaugugggagaggacagguuuagcagaguggcgugguggaaaguuuccucucgccgaggaggacaacuccccagcgccugagacagcgggagcucagagcgccuagaaugugcccagauucuaaagugaagcaggcuguggugugaugauggcccccgaggggacuugcagucuuauggaccuggguucaaggccacccucuucagccacacaaacugggcaaggggcccgcccuuuucacgcugcuguuucuguaacuuucagauaugagaccugucugugggguugugaggauacauggggauuaagugggaaauuaaaaggguuuucuuugugacuggugacugauaaaugccauuuccuuucauccuccuuauuuugacauuagccccaaccucuaccccgagggucucucucucucucuucccaacuuagauuccucucaggggacacauagacaacccagaaaagcagcucugaucucucguggagcuucccugaacuccacaccgcacaucuacuacuguuuaggauaacauuuugacuuaguccuuaaacggacuauuucucauaguccuguuuuguaaaugagauuuuaagcucuuugcagacagggaccaguauaaacucuugagucucugucaaacuuagugaacuuucuuuccagccugggcaacaugaugaaaaccucucucuacaaaaaaaauacaaaaauuagcagggcaugguggcucgcacccguagucccagcuacucuggaggcugaggugggagaauugcuugagccugggaguuugaggcugcagugagccaugaucacgccacugcacuccagccugggugacagaaccggacucugucucaaaaaaacaacaaccccccucccccacaaaaaaccuuacugaacuuucuuggagaacaugcacacuguagaaccuucuguauuuggaaucuucaagugcagguccugcuguucuguaaagaacugucaccuugagucauuguuugacggcucagguccuuggcacuuuaccccuuuguucaugauugauugacauuuggaccuuugcugaccuuucccugagggauuuugugggcauagucaaacaaaaggaaauugaaaaaaaaaaccccacaaauuuugaaggucugucacuuggagaagaacaguguucaugacucuucuucgucauuucagcaucuuaaucaucuugagccuaaagaugaaggagaguggaggugagccugauuaaaugggagcuuuuccuauauugaggaucuacuaggugcaaggaccucacuuggguuaucucuagccuucccccaacucugcaaggcauuucacagauauggaugcagguucaaagaacugaagcuuaaagcuucgcagauuuggaagccucagagcuagaauucucccccuagccuguuugucucugaagcguugguuauugcuugacauugcaucccucccucuuuuuucccucucuuccucuuucccuucccugccacugucugccugucuuccugucugccucucuuucugucuuaaaauuacuguugcuauuccuuacuggucuggucuggucuaguuaauuaaaaagaaggcuaucgugagguaacccugggauccuuauuggcacagucauauucccauaacuuuuaggugccugaguccuaauggaucuguaagacagugcccaucagcgagaaauacccacagccucccuggaugcugcccacaggcaucuugcagaugaggguguuugccuucucaccugcaaggggguggggagaaguggccaggggugggcuguucuggggacgccugccuccccacucccugagccuagggggaaugauauuauggcuucaggccacaacuagacacauuaucuacucugacagggagccagucuggagaaggaugucauggaugacgugaagaaauuacugagggaaaaagagcaaggcgugagcccuauuggggcuguuuuggucaacuccuggcaguagaugauauugaugcuuuggaaaucucuauuuuccuugcauuucccagcaaagugccauucccaucucuuucuuuuagaagcuucuuauccuauggcucugccuccagucuuucucaucacauaauucuucaaaggcaaggcagacuagugguuaagaacaaagacccagggcugggcgugguggcuccugccuguaaucccagcacuucgggaggccaaggccgggguaucaguugaggucaggaguuggaggccagcuuugccaacauggugaaacccugucucugcuaaaaauacaaaaauuagccgggcgugguggcaggugccuguaauccuagcuacuugggaggcugaggcaggagaaucacuugaacccaggagguggagguuguagugagcugagaucacgccacugcacuccagccugggugacagagcaagacucuaucucaauuaaacaaaacaaaacaaaacaaacaaacaaaaaagaacaaagucuccggaggcagugccugggcucguauccuagcucugucucuugcugacuccugcauggcuugggcauacuugggcuuugcugugcaccaguguucucguuucuuagugaguucguaucucacagcauuguuggagauuacaggaacacaaccaaugcucucagaaccagcacucaggaagugugguaauuacaugcucuucugggcuucuggucaugccaccuucgacggacaaugcgccagcacccaccaguuuaaggaccaguuccuccucuaggcauugugcccagcgcacccuucucauggagauuugcuucucacucugcaucugcaggucuucgcugggugaucuugggcaagucacuuuacuucuccaggccuuacuucucagcucuucagugaggacauugaacgagauuauuuccaagguuucuugugugcugacguacuggggccucucacauucuaugugguccaaccuuuccuccuguuccucagcuucugccagcccgccagggcaaccugguuaucaacaaauguccucgcuuauggacauguccugcuucucuggaaaucuuaguacagccugaaagcuccaugaagucaggauugugucuuucauguuugauaugauuucuggcuucuagcacugugcuaggagcuagcacgugaacacugucuguguagcuggaauuaaucacccacuauuccagucaacaauuccuuuuuucuuugagacggagucuugcucugucccccaggcuggagugcaguggcaugaucuuggcucacugcaaccuccacuuccggguucacgccauucuccugccucagccuccugaguagcugggacuacaggcgcucgccaccacgcccggcuaauuuuuuuuuuuuuguauuuuuaguagaggugggguuucacuguguuagccaggauggucucgaucuccugaccucaugauccgccugucucggucucccaaagugcugggauuauaggcaugagccaucgcccccggcccuuuuuuuuuuuuuuuuuuuuccgagauggagucucacucugucucccaggcuggagugcaguggcaugaucacugcucauugcaacuuccgccugcuggguucaagcaauuauccugccuuagccucccgaguagcugcgacuauaggcgugcaccaccaugacuggcuaauuuuuuguacuuuaguagagacgggguuuugccaugcuggccaggcuggucuugaacuccugaccucgugauccacacgccucagccucccaacgugcugggauuacaggcgugagccacugcgcucagcuuuccagucauuucuuaagcgauguugaguucccaagcacugugccggacacgcauggguugcuggaggcuggcagaacccgaaugucaguauuccugaagaauggcucuaagcaauguaccuugcagagcucaagcagggcucugcugcaucaugcccaugaaggugccugcugguagaaggcugguucuauacuggcugcuugccuccuccuuguggagacccacauugugucuggcaaagugcagaaggaaaucaagcccuuaauaacauuagggaacuggacuggguucgguuugcaucucccgagucugacucgugggaguaaccaccauaauagcagcgcugugcuguugagggugacuuugacuaucugcuuguguugugagcccacugugugccggagcacucucuauacauucagucuuguccgcagaugaacuccaguggacacauguuucuauuccuuauuauuauuauuaucauuuguuuuucugagauaauaauaauaauauuauuauuaauauuauuguuauuauauuauuauuauuauuauuauuauuauuauuucagauggaguuucacucuugucgcccagguuggagugcaguggcacaaucacaaucucagcucacugcaaccuccgccuucuggguucaagugauucuccugccucagccucccgaguagcugagauuacaggugcccgccaccacacucagcuaauuuuuguauuuuugguagcgauggaguuucaacauguuaguuaggccggucucgaacuucugaccuuaggugauccacuugccuuggccucccaaagugcugggaucacaggugugagccaccacacccggccuauuauuauuauuuuuugagacagggucuuacuuugucaccuaggcuguuggcucacugcaaccuccacugacuuccuggacucaaggaauccucuuaccucagccuccugaguagcugggacuacaggugcgccaccacugccagcuaauuuuuguauuuuuuguagagauaugguuucaccauguuguccaggcuggucucaaacuccuggguucaagugaucugcccgccuccaccuuccaaagugcuaggauuacaggcaugagccgcugugcccggcuuauucuuuguuuuauugaacagaugaggaaacacuuucaaugagcuuaagggaugugcccaaggccacacgguugugaccacagcaugaggauucacaccuugguuccuguggcucccauccccccuccccugaaugaggaaucgggugagugugacgggagcaggcacucgaaggcuugggaauuccaaagcagcugauccaugucaucccagcacacguuagggaggaagugaaacgaagcaaaaauagagccugucagcggggggacagcugccgcuuucucugggaacagaucuccccgauuuaucuuccagguuaggaaagccccagcuccugggguaccacagagaaauaaugugagcacagccagagaaauugccaccucucccuuccucagaagaagauaaaggagacaucgucuuuuuggcaucaguuuugaagaaaucuuuuuuuuuuuuugagauggagucucgcuccuguugcccagccuggagugcaauggcacaaucucggcucacugcaaccuccgccucccagguucaagcgauucuccugacucagccucccagguagcugggauuacaggugcccgccaccacgcccagcuaauuuuuguauuuuuaguagagaggggguuucgccauguuggccagucuggucucgaacucaugaccucaggugauccaccuccucggccucccaaagugcugggauuacaggcgugagccaccacacccagccaguuuugaagaaaucuuacuucacaauccugagagaaagagaaauugaggcacacuuagcaugugagacugauuucucacuucugcugcuacaacugcugccccauugaccgggucucagagguguuauaauuaacauccucugacucuugcugguacuaaaauuaacaacaugacuggucccuucugcaagagagggaaagagauacacacaugugcacauacacgcacacacaugccugcacacacacacuugcacgcacacaugcaugcacacacaucacacacacacacacacacacacagacacaugcggaguccagaaggcucagagacagagagagagagaggaaggcacagccacacacacacugggagacacuuauuauggcucccccugcaaacggugcuccccucaaagcuuuaggaccagggacgccuucccucacuuucuguguucuguaccucauaccccauuuaccagccugugccaacccuguauacuuuaagucuucaguuaccaaagcauccaucugcccguccuauauugagggggaguggaugcgcagagguggucuguugguguuggguagggaauagacgcagccuguuuuucguuuuucuuccaaaugucuucggcagggccucagcuaguggaaauaccugguggggagggucaagaaggaaaugacaguggggggaauggggagggauagcauuaggagauauaccuaauguuaaaugacgaguuaauggguguagcacacaagcauggcacauguauacauauguaacaaaccugcacguugugcacauguacccuaaaacuuaaaguauaauaaaaaaaaauaaaauuaaaaaaauaaaauaaaaaaagaauuccuauuuuaacuuuggaaaaaaagaaaaaaagaaggaaaugacagauuugguccugacagccugggaggcagagaggagagagauggagccaagagaauggggcuggggccacguuuucuuguggggcaauuccgugucacugggccagagcaugcuuauugugaagacuuccccucaguguccucuggggaagggucagcugugaggcaguggggcgugagaauacgaugaaacagggaaaccuggaagcugccgauucccaggccuugaagggguguucugaugucuuugacauuccagcaaacauauuuucacaggaaaacucaaaaaauauaaacucccuuuuuauagaaauaaugugcauggagaaaagugcacaugucauauguguaucgauagcuugacgaauguucucaaacugaaccugaguguggagccagcaccuggaucaauagaacauuuccagcauuuuggaagcccccucccagucagucacucaggagaacuuuguccugacuucuaaccacacagauuaguuuaaccuguuuauguacuuaaucuaaauaacaucaucacacacuccccugugucuugcuucuuucacucaaaauuauguuugugggauauauucaugugguacgugcauuuucagaucauucucacuggucgcuagauugugugcauauuuuaaaaaauccauucuacuguugaugggcauuugaguaguuuccaguguuuggcuguuaugaauagagcugcugugauauccuuagacuugucuucuggugaacauaugcacacauaucugugcauugauaccacggaguggagcugcagggucauaggguuuggguauauucagcauuaguaaauagugcagaacaguuucccaaagugguuguuuauccuuuuucagagugucuguucaccagcacguaugaauuccaguuccacaucaaagccaauuauuggcauugugugguuuuuaaauuuuagccaacccauuacagaaagagcaaaugaaaggaaucuaacagcaaguaaucaggagagaaaagaaaaugcucccugagaaagcauuaugauuucaugauacgggaaaucccgguguacaaugccacacauuguguacuuuugcaggcggagggcgaggugcagccaccuucuugugagcaucagggcaguccuugccauuggucagggaccaccacuugacugcaguaauacccaacagaccaugucauaauucuuccucaggugacagagcuuuaauggauccgaccccaacagaacaaacuuggcuucagacuugccugugggccucaguaaauauucaacagacuguguccccuguucacuccccugucauuagcugaggcugguaccauaaaucacagcuccccuuccuguuguaaguggccccucucagcugacgguacuccaguccugacauucaggagcagugccucuccugggcugcuucccagggcuggcaggucuugguggucacuuguaggagccgaggagugagugugugcaguccuggagucacugcuguggggugacuugcaggagccucuuccauuugaugugagaaugauagauccgucaagcucuuaauaugugcccagcaacaugcuaaguccuuuauguuguuuauugcaaccugucacaguccauucaggcugguauaacaaaccaccuuagacugguagcuuguaaacaacagaacuuuauuugucaugguucuggagguggggaaguccaagauuaaggcucagacauauuuggugucuggugagggccuguuuccugguuuagcaaugaugccuucuuguugggucuuuauauggugaaaggaucaaauaagguauuuuauaccucuuuuauaagggcacuaagcccuccagccucaugaccgaaucacuuuucaaaggccuccccuuuugagaucaucaccuuggcaguuaagaguucaacguaugaauuuaggggucggggguguagguaacaaacauucaaaacaucauacaaccucacaguaguucuaugaaaugaguagauguuguuuaccaccauuuucagaugaggaaauuaaggguuaaaaacauuuccccagaguaagaaacguaguaaauuugggagucuaacuucaaacuguaauuuuuaauuacuguacuuccuucuucuuuucucuuaggggcuguuuagauacuugagcuuccuuuugaagccaucuuccucuugggucuaaaagcuuucagguagauuuaaaugggacaagaaggccagaugcaguggcuaacaccucuaaucccagcuauuugggaggcugaggcaggagaaucacuugaaccugggagguggaaguugcagugagcugagauggcaccauugcacuccagccugggcaacagagcaagacucugucucaaggaaaaaauaaauaaaauaaauaaauaaauaaaugggacaagaggaagugaccugcagagcacauauuggguucagauguaauuaucugcuuuuucaaugauuuuaagaaauuagaaccacuguuuuucucuggcucuuuucaugacuuuuuucaaauguugguuuucagcaguucaacuauuauauacuuaggugugauuuaaaaaaauauauauccugcaugggauuugcugauauucuuauaucuauaaauuaaugucuuucacugaauuuagaacacuuucaucccuucccacccccgauauugaucuugcuccauucucuucucuccuuuugggacuaaaauuacaugucuguuaggcuuuuugauauuguccuacaggucucugaggcucucuucaauuuuucaaauuuuuuucuguuauucagauuaaauaauuucuauuggccucuccucaaauuguacugacucuugguuccucuucagucugccguuaaauggauccaauugauuguuucagauuuuuuuuuuaauuguagaauuuccauuuggcucuuucuuugcuaagcuuucuuaucuuuuuauuuacuaagaauacauuuuccuuugagucuuugagcauaguuauaauagcugcuuaaaaaacccuugucugcuaauuccagaaacugggucaucucaggaucauggggacgguccccauaacuaucuuuuuucuuaagaauggauuacauuuccuguuuuuguuuucuuuuuaguuguuuguuauauugagcuauuauaaauuauaucacagacauugugagugauacuugguaaggacugauucuguuuuguuccuccaaagaguagugcuuuuuuguuucaguagguaguuaauucaguaaucuaagacuucaaauucugacucccuaguauugggcagcaauauaaauugcuguuuaguucuuuuggcuuuaacugggcuacuccauacaaacuuggcucaggagucacuuagugacuuagggaacauuuguacacagaauuugaacuccccuuuuuggaaacucucuuuuuaccaggauuucuucuuucacuuucaccuauuguguugccuugaucucuguccugauguuucagugcagcaacaccaucugaguguuagccacucacauguugcagaaccgggccuacucucagacuaaaauugaccaaaagcaggaacucacuggcuugcugaauguccaggucuugaucacacuccagaauguccuacuuuuggucaucaggugccuagauuuuuuagaaaucuuuguucuaauuuuuagaaauauuuguucagaguuuauaguugcuaucuaccagggaacugcuucaauaggaacuacucaaccauugccagaaccuucuugaacuuucuagaaacacugucuuauuuauuuuauuuuauuuuuuagacaaaaucuuacucugugcucugccacccaggcuggggugcagugguguaaucuugguucacugcaaccuccaccucccgaguucaagugauucucguuccucagccucccagguagcugggauuacaggcaccugccaccacaccuggcuaauuguuuguauuuuuaguagagacgggguuucaccacguuggccagucuggucucaaacuccugacuucaggcgauccacccaucucagccucccaaagugcugggauuuacaggcaugagccaccacgcuuggccuagaaacacugucuuauuuaaauaagaaagagugucucucagaauggaaagaaaacagcuuuggagucaaacccaacuuggaugcagaaucucacucuaucuuguuuuuuuuuuuuuuuuuuuuuuuuuuugagacugaaucucacucugucaccuaggcuagagugcaguggcaugaucuuggcucacuacaaccucggccuccuggguucaagccauucuucugccuuagccuccugaguagcugugauuacaggugugugccaccacgccuggcugauuuuuuguaauuuuaguagagacgggguuucaccguguuagccaggaugaucucgaucuccugaccucgugauccacccgccucggccucccaaagugcugggauuacaggcgugagccaccgcacugggcuggauauguuuuuuaagaagaaaacguaccuuacuguuuccuucgugauuucuucacuagccgcugcaaguguguguggcucugugcauugugggcagggugaggcagcuagcuugauuuccauuuugggaaugaguggugccuccucauggaagacuucuuaaaacaggagaugggugcccucuguuauucuuguauggcaggcagaauaacgucccccuaaauguccacauccgaaucccuagaaccugcgaauauguugcaugucaaaagggacuuugcagaugcuaguaaggcuaaggacccugagguggacggaugauuuuggaucaucugggugagcccaauauaaucacaugcguccuuaggaguggaagagggaggcagagaguuauucagagacagagauauggccacagaagcagagucagagaugccuugguguuguauuugaagauggaggaagaagccacagccaaggccuaugaagcagccuuuagaagcuuggaaaagcaaggaaacacauucccucucagccaccagaaagaaaugcagcccucccaacagccugauuuuagcucagugagacccaugucagacuuccagaaauguaagaucauaagugugugcuguuuuauuuuuuauuucuuuuucuguuuuaaaccacuacguuuguaaacauuucuuuggcaguaaucguugcuuuugauggaaguuggagcaguggucaagcucgugggcuuuggagccagucugccaguccgccuuguuucaaaccccuuuuccuuucucucuuucuuucuuccuuccuuccuuccuuccuuccuuccuuccuuccuuccuuccuuccuuccuuccuucccuccuuccuucccucucucucuuucuuucuuucuucuuuuuuuuuuugagauagagucucauucuguggcccaggcuggaaugcaguggugugaucuuggcucacugcaaccuccgucuccuugguuuaagcgauucucauuccucggccucccaaauagcuggaauuacaggcaugcaccaccacacccagcuaauuuuuguauuuuuaguagagacaggguuucaccauguuggccaggcuggucuugaauuccuggccucaagggauccaccagccucggcaucacaaagugcuaggauuacaggcgugagccaccgcgcccagccucaaacccuuuuccugugauuuuuuuuuuuuuuuuuuaaagcugugugaccuuguggaaguugcuucacuucucugggccucaaauuucucaucucuaaagucgguuaacaauaaucuacaacucauaguuuuuugugaggaugaaaugaggguuucauacaugcagaaagccuggaaguaaguuuuagcuguggccauucugggcaggaaucccucacuagguaacuuagagcggcggaucagggcacagacuugggagacagacugucuagcuucagauuuaggcuucuuacuagucugaaguagaaugguuguuuguuccuccacugcuucaucuggaaaacaggggcaggcaucccaggguguuugagagaucauaucagauggagaggccagaguuuuuagccgauacaucauagacauuccccaaaggacaguuauuguuaucauuggguggauggggaauauugagccuccagcccuaggcauuguggaucaauuuguucuucaguuaucuuuggaauaauuuaaauacacuggauugggaagacaaagcuaucacccuccugaugggagagugcuggguaccuagcaggugcucaguaguuagugaaugaaugaguaagaacagaacagguccuaggcccugcccugaagaggcucacagugcaggacaaggccuggagucaggccaggguuuugugguugucuuuaaaaagaaacaaaacaaagaacuacuuccuaccagcugacccuaaaccccucagcucccugcagggaccucucagcccugcaggggagcccaggcuaugugccaggccuggccuugcugucagcuuucuaagccagucacaaacauucuccucucaacuuuauaauggaugccccccagccuccucuccccucucagggugcuccugaggcuaugagcagcuggcaguucccugucugagagguccuucguaccgcaggagaggcagcucucaccugaaggccucccuggacaccggucucaacuuuguguguuaccaguuauggagaauuauuuuuagugaguuacacucuguuagggccaaacacaaggaggaaagagugacugaauacugcucugagucagugacugugacaagacuguuuuuuucuucuucccuguugcaggccugaucuuuuggccagaaggagauuaaaaagaugccccucaagauggcugugccugucagcugcauggagcuucguucaaguauuuucugagccugauggauuuacagugaucuucaguggucuggggaauaacgcugguggaaccaugcacuggaaugacacacgcccggcacauuucaggauacuaaaagugguuuuaagggaggcuguggcugaaugccucauggauucuuacagcuuggauguccaugggggacgaaggacugcagcuggcugagaggguugagaucucuguuuacuuagaucucugccaacuuccuuugggucucccuauggaauguaagaccccgacucuuccuggugaagcaucugaugcacguuccauccggcgcucagcugggcuugaggugaggcuguccuggcuggucacggaggguucacugggauguggcugguguucucaacgagguggcauuuaaugagcacccucugugugguuggcgugaugcugggugccugggggagacagauggaacuaaagagguccuuccuggaagccguuacuguucccugcccugacguguguuauuguaccugucaccauuuucugauguucccaguuuacguaucugucaccaucuaccucccuauaaagugccucugcuguugguucuguguccuuaagacauuguguggcauuuggcacagucucucaugcugcagaaaggguaaauuaagacaggauuguuaaugaaugaagacaugggagauucaauggaaagauaugcauggggggauaauuucuuggcucugugcucagagcuaggaacaacauaaggccauauggcuggugcugugaggguuguaugugggcagaugcauguggaggcagacaggccuggguaugacucuuuaacacauacacacugcaugccuccaggcagacugauggauuccuuucccugcagugaaggguuaaguauuaucacacgucacaggacuggaauugaagaucgccaaguagacauugaaaugcugaccacaugacagacacucagcauguggugggugauguuggcuggggguagcuuuuggggaugguggacauuucuuggcccugaucuuucugagcagagccagggaggcagugcuggacucugaccugggcacagcugguuggcguggacaguugauuaaaggucacaguuucccugcagcccaugggaaggcagagugacaagucaguggcagaugaggaaauggagucucaugccagcuggagggagggagcagcuggguuggccacaaaggccuguugcaguucugcagcugacaaguggaaggacuggccucucagguccaggccugguggccugggaggcugcuagcucugagcgaugaguggugccaaggugccugaaggagaguugcagcucaaacagcaagugguccagcucucagaccacuugaggccaccuggcauguggcggccaagaccacaguuggggcggggccuugagucugauuuugauuggauuccuaguucggcucaugccugacagcacuuucucagacaggcuucccugaccuccuaagguaaauaaugucccucuggguguuacaugcuguucucacccauagcucuuagauguguucuaauuguauauucauaugugcaauuuacuggguuuccugucuuucucucacacuagaaaguaaucuuucugaguugaggaaaugcauuugccuugcacacaggcuagacacauacauaguaggcauuuuauuuguugcaucacaguugccuugaucaaauauggugacucuccgugguuuucucuugguuucuuugaaaaggucagacagaagggaaacacucuuuucuugaguauauauaugacuuagcccagcaaucccacuaggagagcaaugguuuauccauuauacaguugagcgccuggaggcucugaggggccauguaccuuccccaagguuauuuauccaggagaagacagagccagaagcugagaacugccucguguuuuauaccaaacaaggccccuucagcugaagacuuuuccuugcggucuugggaagggugugugugacggugagcugcagcaggugcugggcugugcuugacuguggucacguaggggcaggcagaggagccauuucggggggcugcugagggucuggagagaggcucacaguggugagcaaagagguucugggaugggaggggaucaguugggaaagacagaggcagauacuccccacuccuuugugccuucccaguccucucucaccccuuccugcccucuccccacacccuaucgugguggcagcugugccucacuuaucacaugguccauagcucuguuuuuuccccuuuuaucaguuacugccuagaacaacccaauugugguggucuggguuaucucccacucuucacaguagggccagagugggcucagacaccaaaggacacagaaugguuauggcaaugaauaagauuccuucucugugucagcaaggaugcugauguaguaauaaucuccauuuauuaagccaugcugucuacagggcacauagcacauguuuuuccauucaaaccucaaaacagagcuaugagaugcgcaccauuaugaugauuaucuguuuuacuguuuuuuguuuuguuuuguuuuuguuguuuuuuuugagacugagucuuacucuaucauccaggcuggagugcaguggcgcaaucucggcucacugcaaccuccaccuccuugguucaagugauucuugugcgucagccucccaaguagcugggacuacaggcgugcgccaccaugccuggcuaauuuuuguuggccaggcuggucuugaacuccugacuucaagugaucugccugccucggccuccuaaagagcugcgauuacaagcgugacccaccuugcccggucuguuuuacuguugaaguaacuggagcacccagagggaaaucaagugucccuagagaauacaagcagcauuuggacagcccugucugacuccaaagccacugcacaacauugccuggagcugagagaugcacauucucccuucuuggccacuggugacugugaccuugggcaaacuaccucugcuuuuugggccuuaguacauucauucauagagaagcuggcuaauuucucuucucagccuggagacuugagagugaaaggggcacuguaucacuuacucugggaugacagguguauacgaggauguagcugggcaagccaggccuaguggcucgcacacucaucaguuagauggugggugcuggugcugcuggugcaucaugcauacaaggcuggcucucccaguuuucccuggacuuuugccugaacaguuugcauuucuacucguggugcaggagcuugcuguucugauuucaugucacaagccugcuuucagccacuuagaagagcccuguuaucccugacugccgcuacagcagucccaaccuguguuguuuucacuugaugggcuccuggaauuauugacagcacacucucuagucguacgggcugcccugccaccuacacugacauccuggccagguuccuggagauggccuggcaucuuggaccuguuccccacggggugccuggagccucugauggucuacccaggguggcaaugagggaaaggcugugacuugaucaucuccagggguucuucggugaacagcccaagguugcuuaacagcugguguguaugaauaccuggaaugugccaguucaccuucuaaucuggcaaggagaaugugucuccuccuuaugcauaugaacaaacugagguucagugagauccagaaagcugccacgguuacugauggagagagcagagaagcugguguuugcagucccaucugucagccuugacaccccuacuccuguccagccaguguuuuccaaagcgugcugaugagcaaugcaagaugauuucauguuauagauaagaauaaaaaaauuguuuuguguuuaacucaaauuagaaaaaggcaacaauugguaugugcgaccugugguuuugcagaugauacugcuuaggauguugguacuuaagaaaaggucaacuuuucaaaaauacuauuagugacauguggaccuaguccuccugaagaggacuacauuggggcaccgguaauuguuucuauuugcgguacucuggcuguguggcucuggccacgccacuggaggcagugucugagccugugacuugaguaguagcucugugucaugucugcugauucuccccaaauccugaagauucaugaugaagugacuggccggcuuggucugaagcuagauugaaaacaauaaggaucccagaacgauagcacuuuacaauccuauaauuuggcucaaauugccugcaguuacuaucucagcccugccuguuauguucauugagcacccaaaguuuuucagucaauuccugaguuaauuauucucugggauugaauuaugaaauaguaaauauuuccacuaugcaaucaauuggugacuuauucauguauucauuucauucauuuagucucaauaaauugaagauaagggcugagcacaguggcucacacauguaaucccagcacuuugggaggccgaggugggcagaucaccugaggucaggaguucaagaccagccuaaccaacauagcgaaaccccaucacuacuaaaaauagaaaaauuagcugggugugguggcaugcgccuguaaucccagcuacucaggaggcugaggcaggagaaucauuugaaucugggaggcggagguugcagugagccgagauugcaccacugcacuccagccugcgugacaaacugagacuccaucucccaaauaaauaaauaaauaaauaaaagauaauauuaccuaccccaugaguuuauuaugagaauuaaauaagagaacauauuaaaagguuucauucagugccaggcauauaauauguacucagggaauacuaguuuuuuuuaaauaaaauuuuaaaaugggauuagaaggucaaagcauauaggcauaaagguauaaaaaauauugaagaugagugaguuacuaaaauuuaacauuacguuuagcucugagcuuccuaauuagcacaacaugcuaaguagguuauauuuguaucuaaaguaaagauuggcaaacuuuuuauaucaaggguuaggugacaaauguuuucagcuuugcaggccacacagcucuguacugcuugucaguucugccuuuguaucuggaaaguagccauagauaauauguaaaugaguggguguggcugugugccaauaaaacuuuauuuacaagaacuggcaauaggccuuuaggcuguaguuuguccuuggccuaaauaaaggaaacauguuugucuuucaaaggcagaaacuccuccuggaucauaaacauugaaaaaaaaauuguuacaagaugcaauauuucugugagacuuguuaagcaguauaugcgcagugcuuucauuaggauuuuacagaaaacuuagaagauggccuucacauggcuaguuuccuuacuguucauucagcagacauuuacugagggcuuacuauguccuaggcucugauauccauacaugguaaaacguaaaggcaugugcauuuuggcagggggugcugcauugacaaggaguggucucggugacaguuuugggaagucaguuuagaacaguauuggacacacuguuccaucccugaauuacacacaggccucaaugcuaacuugagugggcuuuugguccagcaggccugggcuccaggggcagucacucagcguccugccucaagagugguugugucaugaaaucuuggcccucuuugacugauagcuacaauuauuugaagagugugguuuuuagaacaaaacuaaaucuguuuugaagcucugcuguuuuauaccugcugugugaucuugcucaaguuuuuauuuuuauuuuuuucuguauaagggauuuuauuuuauuuuuauuauguauguauuuauuuuauuuuaaguucugggguacaugugcaggaugugcagguuuguuacaugguagacgugugccaugugauuugcugcaucuaucaccccaucaccuagauauuaagcccagcaugcauuagcuauuuuuccugaugccuuuccuccccccccccgcccccgacccacaggccccaaugugcucaaguguuuuaaucucucugagccucacuuucuucaucugcaaaccauaacaccucugaaucuauuuguuacucuaaugcuagcuaucuaguguuugcucucuaaauguuaguuccuccaccugggggcugggcgggcgguggcugaccucaccccaugaagcugucuccuggcuuucccagcuagagccuguggguaugaagauugcagcccccuccuccugggggaguauucaguguaacaagccuugagaaaacacuggccuguggaauuccaaaguuaaugaagggaacagauuccaagagggucucuguuugaccuuccacucuuuccccaaccccguuaccccugagcgaguuugggggcaagcauagguuuguaggcacugcaaagaagaacucucacgcuguggugcaggaccguggccuuggccucuggauaucugggccaggugggugcauuugggccucuucccuacagcgccuggucagacugcaagagacauaggaagcagccagggcaggcuaucuuaagaggagggagcauauuugauaaaguuagaaaaugauucucagcuguccauaggaagagcagaguaaggggcuaugugagaaguuuggaagauggcccaguuccaaaaaugaagaaagaaaguaagaaagaaagagagaaagagagaaagaaaggaaggaaggaaggaaggaaggaaagaaagaggaaagaaagaaagaggaaagaaagaaggaaagaaagaaggaaggaaagaaagaaagaagagagggagaggaaggaaggaagaaaggaaagaaagaaagaaagacagacaaagaaagaaagacaggaaggaaggaagaaaggaaagaaagaaagaaaaaggaaggaaggaaagaaggaaggaggggaagaaggaagaaagaaggaaagaaagauucauuauucuguccucugaaccugagugaagaaaaauacccuguccuuuguaccugcgugaagagagaaaagaaaagaaaagaaaagaaagaaagaaagaaagaaaagaaagacaggaaggaagaaaggaaagaaagaaagaaagaaagaaagaaagaaaaaaagacagacaggaaggaagaaaggaaagaaagaaagaaaagggaaggaaggaaggaaagaaggaaggaaggaagaaagaaggaaagaaagaagauucauuauucuguccucugaaccugagugaagaaauauacucuguccuuuguaccugcgugaagaaagaaaagaaaagaaagaaaagggaaggaaggaaggaaagaaggaaggaaggaagaaagaaggaaagaaagaagauucauuauucuguccucugaaccugagugaagaaauauacucuguccuuuguaccugcgugaagaaagaagagaaaagaaagaaaagaaagaaagaaagaaagaaacgaaggaaggaagaaagaaagaguguaaagaaauaaaaggcuguaaagaaauaaaauaauguaaagaaagaaaauaauguaaagaaagaaaagaaaggaaagaaagauucauuacuauccuuuggaccugagugguguuuucaguuaaaaugaguggaguagaacccagagaucaggcuuuugaggacgguaaagccucaagauacauucuguuucuggcucagggaaccuucagggaaaaggcuuuggagaccaagcuaggcagggaagcgccuuugcuuaucaugcuggagaccagacugaggcagugaagucaccauaauugaugggccacacuagacuggagccaaccauggcccauugcugagacucugggccucaggguggccuuggcuggaaccuguauuccaguggcccugguggcucucuucccucucaccuucccaggaggcagauuauuucccuguggugggggugaggcgguggcgugggggcuucuucccucucucucugucuuguagccuuguuaaaauaguggccacacgcugauagcuggauuuccagugcaguugcuggggaugggggucuuucccucucaucugucugucacccuuuaucacuccacaagggguggggguacuggacagaaagagugugucccaccugauuacugggaagugcaauggacacccccaccccccguugacuuaucuggcuccaaccgaagaacagcuguugguggucaggucucugagucacucaguagcuugggacuggguucagugggagaugauggcauaaacaaauaaacacuggcuggcccccagcucucagcuuucugcucacuggggggccccagaagcuuccuguugcgucugcagggaaaauaaggauacccauaaugaaaauaguuuuccugauggagaaaugcucuggggagguuguugaggcauguuagaaaaucccugaggcuuucuggcucugugagcuaagggaggacacuuggccucucugggcuuucgcuugcuccuuugggaagccuguuauugugaaagugagaugaucugggagguaaaacuggccaguuguccaucuccccucucugaacaugaugcauaguaagcccugaaucucauuuaaauuuggaagucagacugacuuugugacuguccuaguuuccggcuguugagucagcucaggcaguucuugggacuucugugagucucuggcuccccgucucucaauggggugacaguccucgucuugugccccucacgcgcuuguugagaugacagaugagucaccucugggaaacugccugagagcuggaugacaccacucugugggauugcauuucauccacagagacaucuggaaaaggaggcagagcagagccugacuuuugauuauuuggggagggagccuggagcugguggaagugagggcauagagcacauuccuuucaggccaggcagugcuuggcugcugaggcaccgguggagaccucaugaucuggugguccgccucccucuugugcugugugugccuggagcucucuggcuuccuuggcuuuccacugucuuucccaaagccuccauguauucuagaaucugcuauggaguuucagggggaucucuguauagugugaauaucuagcucugaaacacaaaagagaaagcuacaaagggcaacguaacaaaagccguauucccacccaaggauuagcacaugcucaugagguggcaugcuuugcuuuggaucauugucuuuauuuuauuuuauuuuguuuauuuauuuauuuauuauuuauuuuuugagaugcagucucgcucuguugcccaggcuggaaugcaguggugcaaucucagcucacugcagccucugccucccagguucaagcgauucuccugccucagccuccugaguagcugggacugcaggcgcguaccaccacaccuggcuaauuuuuuauauauuuaguagagaugggguuucacuguguuagccaggauggucuugaucuucugaccucaugauccccccaccucggccucccaaagugcugggauuacaggcaugagccaccacacccagccuggaucauugucuuuaaagaaauuuaaaaaaaaaaauagauaaaugggaagucuaugagccuugucucccauuccccauccuucucuucauacaaguaccucuccugaacuugggguauaacaggucaugcucuuacaauuucauuacaaaucuauuugaagaucacugguagcaccauuuuguguguuuuuaaauucuuagguaggugacauaacguauaagaugucugcacuuuccucuuuucucccggcgcuaugcugggcagaugaugcuacuaugcuuguucauucauucccugggccacagagucuuggguuguuuccagaauuuugcuuuuguaaacaaugcugucaugagcauccuagcacagggcugcaggugcaugucugggugugucccaggaguacagggcacagagcaugcacauuugcagccugacuggagguugccacaucacucuccaguuggcacuauuuccuagguuccuucccugagagccugggaacuucuggaaggcaggagugggugguguucaccacuauauaccucugccagucagcaugccccacaccauguaccagcucaugacacgccugaauggggugaauucuggaaggggacaaggcaagugccagggcagguccagagucuggguguggaaggagcaacauaaugggggccccuugcagaagcagcagaaagaacaaagaaauaggggccuggagugggggugugaaugaagacauugcuguugagaagauacuugugaagaagccaacagcguugucugggccuggcuggauaucaugaggcuggacauggaggucccaggcaccauugcugugggcuuuuggggaguuggaugcacaguggagagcugaggaggaaguugggcuugcugcagagggcugcuggaggggcuggcuggagucuggcucuggcccucacucacugaggguuauccaagugacccauugcaggaagaggggugggggacccagaguuacuguaaccacuuuaugagucugucucagccaggaucuggggcuucuagcaaagcccacagcacaggcacauuuuaggaaaggcaagauugagaugcccucgguggcccagaaggacacuucagggcagcagggcuguaaaggucaggagggggaaacuucuggaaggaaguugaauguugugggaaaaagcugacauaaaugaacaaggaaugauuuuuuucuuuucuuuuuuuuauuuuucuuuuuagagagacagucuugauauguugccuaggcuggucucaaacuuuugaacuugagugauccucccaccuuggccucccaaagugcuggaauuauaggcaugaaccaccauuguacagccacaagggaagauuaaacauagacaguuugagaagaguuuuuuuuuuuuuaaauuucuaauuuuauauuuaauagagauggagucucacuauguugcucaggcuagucuuaaaguccugagcucaagcgauccuccugccuuguucucccaaagugcugggauuacaggcuugagccacugcaccuggccaaggguacuuuuuuuuuuuuuuaagaaaaauaucguuagaaauagaaaauuuggauuugguaauggauagugcauacuaugaaauaaccuuuuuacuucuucaacacuucccaugauaauaacacuaauacaagaucuuuggugaaaacuuagaaugcguagaaauguguuggugguugaaagagagccccauaacccuccacugaggaguaaccucuguuugaccuuagaaauaauaccugugaacagaauggccaacuuguccugguuugccagagacuuuccugguuuuggcacggaaaguccaacacucugggaaccuccucaguccugugcaaacugggauggucguucacccuaccugugaauugaaugauaccacugagcaucaagcacuuugacaguucacaagucauuucuagugcugucauuguguauacuugguuccggcugugugcaaggcauugugcgaggcugcauguucuggagcuacaccagagcuccagagcugaaguucuauuuucuuuuuuuuuuuuuuucacuuuuuauuuuagaaucaagagaugcauaugcagguuuguuacagagguauaugggaugcgguugaaguuuggaguaugauugaacucaucacgcagguacugagcauaguauccaguaguuuuucaauccuugucccccucuuuuccuccccuuucuaguagcccucagcaucuauuguucccaucuuuaugcccauguguacccaauguuuaguucccacuuauaagugagaacaugcgguauuuuguuuucuguuucagcauuaguuugcuuaugauaauggccuccagcugcauccauguugcugcagagagcgugauuccauucuuuuauaugguugcauaguauuucuugguguauaugugccacauuuucuuuauccaguccaccacugacgggcauuuauguugauuccaugucuuugcuauugugaauagugcugccaugaacacaugggugcguguguacuuuugguagaacaauuuauuuuccuuugaguauacacccagguaugagauugguggguuaaaugguaguucaacuuggaguuuucugagaaaucucuaaacugcuccucacaguggcuggacuaauuuacauucccaccaacagugugucagugucuccuuuucuacacaggcccaccaacaucuguuauuuuuugacuuuuuaaugaaaaccauucugauuggcaugaaauguaucucauugugguuuugauuugaauuuuuccaaugacuagugauguugugcauuuuuucauguuugguggcugcaugaaugucuucuuuugagcaguguccguccuugugcuuugcccacuuuuuaaugggauuauuugcuucuuugcuuuuugauuuaaguuccuuaucgauucuggauauuggaacuuugucaaaugcauacuuugugaauauuuucucccauucuguagcuugucuguguacucccuugauaguuucuuuugcucugcagaaacucuuuaguuuaauuaggccccaauugucaauuuuuguuuuuguugcaguuguuuuugaggacuuagccauaaauuccugucaaggccuauauugagagggguauuuccucgguuuucuucuaggauuuuuauaguuugaagucuuaagucuuuaauccauguugaguuauuuuuuguguggugauaaauagggauucuguuucauuuucuucugcauauggauagccauuuaucccagcaccauuuauugaauaggaagucuuuuccccauugccucuuuuugucaaguuuguugaagaucagaugguuguagauaaguggcuuuauuucuggauucucuauucuguuccguuggucuguguauuuguuuuugcaccaguaccaugcuguuuggguuacuguagccuuguaguauaauuugaagucagguaaugugaggucucuagcuuuguucuuauuucuuagaauugcuuuggucauucaggcucuuuuuugguuccaugugaauuuuagaauaguuuuuucuacuucugugaaaaaugauguugauaguuugaaagaaauaacauugaaucuauaaauugcuuuggacaguauggccauuuuaaugauuuugauucuuccaaucaaugagcaugaaauguuuuuccauuuauuugugucaugucugauuucuuucaacaauguuuuguaguccuuguagagaucuuucaccuccuugguuagaaaguauuacuagauauuuuauuuauguguguaugaagcccuguuuucuauccuuaaggagcuuacaacuugucuuugguaugcaguaggggcauuucacuugugagagugggggucuuacuguagccugggcaauacccucuuuuauuauuggguacuaaggauuuaaggauauuuuuguucugguggguuauccaguuuugcagguugguaccaaugcugaauuugacugccccuggcccugcugugcagcacuuucagaccccuaaaugaugugacccauucuggggccagcucaguguuuuacagugaugaagaugauguugaugaugaugaugaugaugucaacauccaucauucugaggugugugucuaucucuggccucguuauaccugcagaacauucaugugguagccaauaccugggaaaauaaucccacuugccaggcagcaaaccguggcccuccguuagggggauggcaucucacacucaugaaguguugaguguaugggucccuggccagcuuuggcaacugugaggcaggcauuaugcuuccauuuuaccacugacagacugaggccggugauggggagcaccugggccuguuggcuugucugugguaggccaggcuggcuacauaauauguggggcucagugcaaaaugaaauaugggcucucuuguguaaaaauuaggaagaauuucuagaugcugacagcagagcuuuaaaccaagcucgggccccucugagccaggagcccugugugccugcacaggcuguauguccaaggagcugguccuagggcaggacuaagguucaggcuucguauugacuuccaugaccaagcauccuggguccaggcuguguuuugugugucugcagagcucuggucuaucugcugauaagucccuguggugcucaaagguaccuggcuuccuuggagaaaaguuucucucuccccugcccuuccccagccucaaaauacacaaaugcucagaugaauacuuaagaauccaacuggaccagcuucugucugugacuugaugacuuaaugugauuuugggggaugcaacauugggggugaugcuuuagcaugccuucucucucccacucaggaacaugggcaaaugccaugggcugggagcucucaccugcucuuuugugcugagcuucacuaucucuucugggcacagauugguuacagggauauagaccaccuguguggugcccuggggguuauguccacggggagccucacaugaagaagagaauuuccuuugggauguguauuucuuguggucuuagcaugcuggcaauucuuauuuuuggcaucauuuaauccuuacaacaacuuuguaagguuuucacauccauuggucauuucugaguugagcaccucaacucaggugaauguguuuguaugaauguuuguugagcaccuacuaugugcagggcaguguaguaaaaaauugaggaccuguggguuuuuuuuugaguauauauaauuguguucuucugucauuuuacaugacuuucaccucauuucauugcuguagcaacacugugagguuguugcugucacccccauuucucaggcgaggaaauagagguugagucaaucucccaucuuggauuuaccugacaucacagucugagucuuuuguggcaugugcaagagugcacuggcuuucggggccugagcuggcuggccuggauugaauccuggcuuugccauuugcagcuguggucugaggcaaguuauuuaacuucucuugaccucgguuuccccaucuguaaaauggggcuauacuaguugcucuguguaggaagggucugagguuucaguaagauacauuuugcacaaaccccacacacaccaaguauccaugaagccugguuauccuuauaaccucagagcgguuuggagaggguuaggaacuugcagauggucacauaaucgguguauggcagaucuugggcagagcuggacuggucuuccuaaugagagcuccuuuccccacucugcuuucauggacagacccuaaugaccaccuggguuauguuuuugucccugucaauuccuuuguccuugcugauaaccuaagggaaccuugagagccagaacgagacaggaagaaaaugccuggcugcugcuugcgggguuaauuaaaccauuccugggguuucauuugcucucuaguuagcaccaaaauaaauccuccaaauggcuuugagccuuccaguugacauugcauuuugaauucugacagcaccagcauuuuacaucuuccugaggaugauaaauguuuagauagcaccgaagauaaugguaaaaggagaaacuggggguaguucaggcuguggcugagcagauuguaacucuuuggugugacgaaugggugagaaguugcuuaaaggacacaucugauguccccugcuccuagggguugagagggggaugggggguggacucuguuuugccauccggagaauccauugccuucccgaugcuucuggggucucaugcuugagucuuguuuccaugcguucugucagauguuaaggucuugugcauaaugguugaggugucaaugugcaggcguuaaugucaccauucuuauguaauuguuacccuuuauugagugccuacuaugugccaggauuuaaauauuucucucagcaacccaaagauguaaaugucauaucaccuucauuuuacagaugugaaaacaggcucggagaggcugagacacccagccauuaaggacucagcugggauucccagccuucccuggcacucucucuuuuuuuuuuuuuuuuuucuguuuugagacagagucuugcucugucagccaggcuggagugcaguggcacaauaucagcucacuucaaccucccucucccgggcucaagcaauucuccugucucagccucccgaguagcuggauuugcaggcaugugccaccgcacccggcuaauuuuuauuuuuaauuuuuuuugguagagacgggguuucaccauguuggccaggcuagucuugaacuccugaccucagguaaucugccagccucggccucccaaagugcugggauuacaggugugagccaccaugcccggccuucccuggcacucuugagcauguuuccagaccgccugcuuccuaccccagacaugucaaaaugcggugcuguaaaugacagggcucuggucccagauggacagcccgggcccuuugaagacacucuggccuucaggagucuggaucuuuaugccugauggaacugacacgggccugcuauguuuacagugccuguucuccugcagggucuccggaagucaucagccgugcuggccagcacuccggaggaugacaggaaauucugcugcagcucugugggcuggcuggggugcaugcuggacagggagcgggcggacagggcugguagggaggaaaacaccacugaaauaguucagaccguauugucagugaauuccuggauuaguaugcagugcugccaaugaucagauuugggucaggaagcccagauggcagaaagauuguguuaaaucuuuauauuuuuccacgaaauccucaccguuucagacccuguuuucuaagcuaucacccuaauaauuguggauuuuggauuuccaaggcacguuuuauagugguuguaaggaggggaugguuggguuggggauugggaugggagggggguagcugaagaaauaagaaagugcugcagaaaggagcacauuccacacccagcuucuuccugauuguguuucccuccaagcagcgaacaagaggcugauucaaguggcucaguggccucccugccuggaguuggguuccuaugccuuccagugacuaaggaggaaauuccauuucaguuaaucuguggccgcgcaucacccauggcauucucuaucuuaauuuuauggcugccucaucuuuuuggaauucgccuucuuuuuguguguugggugauaagucaaggagacauauggcacagcuccacaaaauacaaccacauuuuaguauuccguacacaguccuuucugggcaucccaggcuuuguauuuucacguuggucggccgugaggaggguggaucuucauuaucugugcaugcaugugcaucccuucaucccuuccucuucaguuucuuuucuuuuuuuuucuuuuuucuuucuuucuuuuuuuuuuugagauggaaucuugcucugucacccaggcuggaguacaguggcgugauauugacucgcugcaaccuccgccuccuggguucaagcgauucuccugccucagccuccugaguagcugggauuacaggguugugccaccacgcccggcuaauuuuuguauuuuuaguaaagacgggguuucaccauauugaccaggcuggucucaaacuccugaccuugugauccgcccaccucagccucccaaaguguugggauuacaggcgugagccaccacauccagccuccuguucaguuucuuaacccuugaugggacucccggcuaaacacccccauugucugggaccuugagauuagaugcaguagcacugcugguuucaugguggacuuugagucggauggaggaacuccuuggagugcgggaggaagggcugcggaaggugucugaacuaucguagcaguagggucccugccacagggaggugaggcagccaucaucaccaguccuaagagguacggucacccuccgccucugucucccucuccaguccccauccaauuucagcuuugaacccagcugccgggucuucaaagccuguucugacuuacccagcagaguugguugcucuguccucuuagcuuauagacgcugcccguuuuuuccccacguggccccugccauuuagguccaugucucucgugauccuguguguauuuccaguggaaggacaagguuuggcccacuguauauuugaaggcccucaauauggcguuaguucguauuuacugauggaugaagaacucugaggagaucugguugaaagagacuuuuaaaaauuaaagggaaaugggucacgcaggccgcguuuuuguccuugccuauuggcuacuuuugcuauucagaucaucugugaauguaagugacugucugcuguguucgcagugugguuacugggaaaacagagcucucucuccccaaaucaggugaaacuacaggaaaacaguaggcaagagucuucaaagugaugcaucucgagagagagagggccugggucugaaucauggcuuugugccuuaccagccugugauucuagucacuuuaccuucugagccuuguuuuucccagcugcaaaaugagugugauaauagcgcuugcuucaggggauuguuucaaggaucaguugaaauagugcacaccgaauguuuggcauaugugcggagcucuuugggggugacucaugggcaacuguuuuucauuuaagaacugaguggauuggaccuuuaagaacugcuuuggucccacugucaugggagguuagugcugucuggagcaggcauggggauguggugguacaggguaggguguagggguccccagaauugggggccuccguguuggaaagggacagugggcagaguccaugcaggcgcucuggggcugacagggaccugggacuucuuucugagaggcagugaccagccaacuggaguggaggguuguggggaaaauguuuggccaaaggauuuaggaaccagagagaagcaggcacaugaugcuccuuuucuuggugggguguucaucaggccuguagcugccacagucaucacuguggcugagauucauaccuguagcaccagagugggaggcaauuuuuccaacauggggcagaggcuggguguguggggauugguugcaaggugcugggaguggggugcagggaagggccucugcacaccacguccguccucauccugcuaugaggucagcucuguacaugugcuggaagagcaauuagcggggugccuaagcaguguccaucauggacgugggucucugcuggccacgcaaggggaagaugggacuggugggaagauuggggagauggaagcgggggcaguugugugcgaaagguacagggucguggaaacaugcacaagaaagugacauuuuagaaggugguuuuuguuccauaauaaauuuauuagcuuuggaaucugacucuauugccuuggcuucuccaaacuuugguguccucaucugcaaacuggggaucacaaucucaguuuugcagggaaugugaaauccugaccugaaaugaucacauguguaggaagcugacaaagaaugcuaauuuucuuccuucuuuucuuuauggccuuuccuugguaaaucucugugugauugauaacucaugaagaaccuaccagucaaaucaguuaaauuaaaugacuuccuaaugauaauaauuagauuaguaacuaauaaucauagcugacauuuaucuagugcuuauuaacuucugggcagugcgaauuuggucucaucuguuaaauaauuuaauuccuguaauaauccuaggaggauggugcuauaauuagccccauuuuacaaacaagaaaacuggaggaucagagaggcuaaguauaaugucuaaugucacacugcugaaaguggcuugcugguguuccagccccaacagucuggcuccagaguuugugcuauuaaccauuauaucagucugcuguguguguguguguuugugugugugugugugugugagagagagagagagagagauugugcauuguacggugaagagcaauagaaaucauuauaaggcauuccugugcuacagucuuggugggucaggcuuacuuauagaagcugugagaaggauggggcuaugggcuuuaacucaguucugacaaucugucacucccagaaccugaggcaggcuggaccuauagacuuccaccuccucuuccuccugcccugaaccguccagggacucagaggaggucagacaggugggacucccagaauagugaccuccucugccacuugcagccuaugucgggcuccucuuauagagccacccccuugcuuaugcuguaguguuccuuuguucuggccauaguuuuccugggccugugucaguugagugcguccagaugcagcuggguugagacucaaagcccugaagauaccgcaaggggagugcuccugugugcaguugcucugaccugcacagcaggucggaguggccgccgguccccggcugccagcuguuuaccuggccggccuugcaaaggcucuucagggccaggccccagccggugaaucacugaaacugauccccguggccacugugaaguacgggacuggaggucuccggaggagauggcagcucuaauaaaaacaggcugccaaaccgcagaaacuguauaagccucuguuucucauccucgcuaccaccccugcguagucccuguuuuacaguugaggaaaccguggcccagggaaggucgggaacuuguccaaaggcacagucauagaacuagggcuuacaccagcugugucuaauagcaugcgugcccccucugcugugcuuuuauuugcuucuuggagugcuguuuagagaaauugaugguucuuuuguugugacuagggguccgcacuaugggugaccucccugcucccuuuggccucaggcccuuaucuuaggcgauggccaaaagaacagcuuuacauucaguaaacuguuuuaacugaaccucaccacagguuuacggguggugcucguuucauaauggauaaagaauggguguggcucaguguggggaaguugguggauggggagagggcagcagaguaaccagcuuuuaguggagaccuggauuugagugcccugaguuaggugagccuuuguaccuguuucuucacuucuuggagcagaacauuaguuucuccagaucccacaugugauaaaguucugugauccugcaguuugaacauccuggcauucagcucagcccacugugcagaaaucuauacuaaacauguagacaguuuaggaagagggauuguuuauuguguugaauguuauagaauaauagcuacuuaaauuuuggagcacuugccauucaucuuccaagugauuucuacguguugacucauguaacacaggcaaccacccuauaauaaguacuauguuuacacacccacucuacagaugaggaaacugaggcucagaggaauuaaguaaucugccaaagaucccuuggcaaguaaguggcuaaggggggauuggaacccagggagagagcauaauccuaggaggagauucugccaagguacagcccuccacgauggaagggcagcagccuccugugagcugacucacuugaguuauuccacaccaucccaguggagaaguuggauuaucccuauugugauagaggaagaaaggugaaggaauuugccagaaauuauaaauggugacauucgcauugaacacauguccacugaccccaaauacugggucauuuuauaucuuucccucccuucuuuuuuuuuuuuuuagacuagucucacucugucacccaggcuggagugccauggcacgaucuuggcucacugcaaccuccaccucccggguucaagcaauucuucugccucagccuuccaaguagcugggauuacagacaccugccaccaggccagacgaauuuuuuggauuuuuaguagaaaugggguuucaccauguuggccaggcuggucuugaacuccugaccucagguaauccaccugccuucaccucccaaaguguugggauuacaggcgugagccacgcccacccacccccuucacaccccaccuuguuuuuuucuuuuuaguagagaugggguuuuaccguguuggccaggcuggucuugaacuccugaucucaagugauccgcuugccucggccucccaaagugcugggauuacuggugugagccaccacgcuuggccucuucccucccuucuugcuaacuuugaagcucagcuccuuguccaagagccuuucuguccagguguuuucauggugccugugccuucugcugguuuggagugagcgguuuccacagcauccucccaucagccaugcauuccucagggucaggcgcaacaugcucuucauaucugcucccuggcacuuggccuucaaaccaggaauucacugcaccuagccugauccauugaccugggcccaguauaggcccucccauguugggaggccaugggguguuaagguuaaugcugggccacacaugacugugaugagucccuuucucucugcugaagaacguguuuccaugggggacaggggcaguuaagccuggguucuguugggcgcugcugcuuggguggguccagucugccccauguggggucugcauucuaugccaaguguuggcagguucugccagguagagcucuucaguauggaagcacuucccugugcucagccucuccccgacugugcacauuuccuucucuucugcuggggaaauggaaaacagcugaccacugauuccuugaaaucaccuacucagacacuccagggucugugugggauuaagucguccgcagucuuucccucccuuaaucucuucuaaccuuccucgaaagugccguuucccaccccauuuuaaucaugcccuuugcucucgccuggacaucuccaggggcuccagugccucucuaagugaaggguuuggggccacacacauggcugucuguucucuccaggcccacaugcagaauccagcagcccccuggccucacaccugcuuuucaguaguggcugggacugccagaugaauaggcuugaggcagcauacgaguuugcuauacacuugcucaaaacauuaguggacucaaaaccaaaaagacaacccaguuucagaaugggcagaagacuugaacacacauuucuccagagaaguuauauaaauggccaauaaacacaugaaaagaugcucaguagccaugguuguuagggagaugcaaauuaaaaccaugagauaccccuucauaccuacuaggauggcuguaauuaaacaccaccaccaccaacagcaaaaaaaaaaaaaaaaaaaaaaaaaaaaaaaaaaaaaaaaggcagaaaauagcaaguguuggugaggauguagagaaauuggaacccuuguacauugcugguaggaauguaagaugauacagucucuguggaagacaguuuggugguuccucaaaaagucaaguauagaauuacauaugacccagcaauuccacuccuagguguauauccaagagaguugaaggcguauguccacaaaaagcuuuuacaggcaugugcacuacucacaacagccagaaggugggaacaacccagauguccaaugucuguccgcggaagaauagcaaacaguauucaacuguaaaauggaaugagacauugauacauguuacaacauggaugaaccucaaaaaugcuguucuaggugacagaagcuaggcacaaaaagucacauauugucugauuccauuuuuaugaauuuucaagaauaagcaaaauuauauagacagaaagcagauuaaugguugcugggggccauggggaguagcugcuuaauggguacaaaguuguuguugguuuuuuuuuuuuuuuuuuugagaccgaguuucccucuuguuucccaggcuggagugcuggagugcaguggugcaaucucagcucacugcaaccuccaccuccuguguucaagugauucuccugccucagccuccugagcgguuaggguuacagucaugugccaucacacccggcuaauuuuguauuuuugguagagaugggguuucaccauguuggccaggcuggucucaaacuccugacuucaggugauccacccaccucggccucccaaaguguugggauuacaggugugagccaccacaccuggccaaugaguacaaaguuuuauuugagggugaugaaaauguuuuggaaccagauagacauggugauuauaccacauugugaauguacuagacaaacgucacugauuuuguacacuuuaaaaugguuaauauuacuuuaugcagauuuuaccuccauuaaaacaguuaugacaucacagaucccaucagguuaaaagaggacaugugggccaggcucaguggcucacaccuguaaucccagcacuuugggaggccgaggcgggcggcagaucaccugaagucgggaguuugagaccagccugaccaacauggagaaauccuuucccuacuaaaaauacgaaauuagccaggcgugguggcacgugccuguaaucccagcuacuugggaggcugaggcaggagaauugcuugaaucugggaggcagagguuguggugagccgagauugcaucauugcauuucagccugggcaacaagagcgaaacuccaucucaaaaaaaaaaaaaaaaaaaaaaagaggauauguggacacuaugucuggcacuuaaacugguggauucuauagagaugggauggguucauuagccccauucuacagaugagaaaguagaggcuccauuagagcacacaguguagaaguggaaccaggauuggucugacucuagaaugcugcuuuugaucacuuuucuauguuccucuuccucuacaguggacagguuuuguuuuguuucgcuuugcuucagauucuuggcucaugccaagugcugugugccauggguacaucaccugacccugaagagcccagaucuaugucuuuucaugcaaccuugcccugugcuuuccacauauucacauccuucacagucaaucccacccuggccacuaggccaauagggacuccccacaucccacuuacaggggggcaaauauuuauagccaaaagaaaacagaagauguggguuugagucacaguuccacuauguggucauggaugagugccuucaacccucaguaccucaguuucccuaaaugugcagugggagagcaugagaacacuuaucugaugucuucccugggguuuugugaggauuaaacacaccauguaggggcaagugcuuugagaauggaaaagcacugugcagacaugagugaugugcaugaugguuauuguuagauguucucuccuggaaucaaguucaagcuucuugcauacucagcagagaacagacccaaacucccgaaucuagugcuguggcaugugguuggugcucaauaaugauuuguugugugaacaagugcaugaaugaguaguaggucaaugaccucaaugugggccuggucaggauuuagauuucuugucuuugugugugcucagcccaggacugaaugcacagcaggcugucaggaaguagucauggauugauguguccguauucgccauaaccaagcaggagauagaugauuucguucuggucucuggauuuuggcugcauuuucucucauaguaggaauuauucccggaagauccaaaugcucagcuuuguccuccucucauccuggugaggcgugugauccaggugagaagcagggagaacuggccuuccuggugggaaguugugggccaucaccuuaagcuuggcuuguaguggugggagaccuguguuccuuccuuccugagccccacuuccucuugauuuuauuguauuuuuagcagcacugagcugaagcuuucuggguugcauguuagaggcagcacuucuugcacaagcuaggggagcgugaguaucguuucgguucugauagcaggauggauuguuauguauccuuucugauggaggcuaccaaaagcuuuagauguuaggauggauuaucucaccuugcacaagacagugagugcuagaguuuaaguuuucuccucugcaaaauaaggaguggcagugagacuuagagcaucucucaagcccacuuuggcccaaaaguuccaugacuguggcagucuagaguaaauguguuugauagccccuaguuacaacucucuucugucucuuccccuuucugccugcgcuaccaucuaauccauccacgcaaccacccauccacccacccacauuuccuagccagcucucuggaccaggccuuguguuaaguccugaagacacagaaaaggcuaaaacagccccuggucuuaaggacucacagaucaugaggaggcgauagauacuggaauagaaggcaaaagucaaaugucaugagugcugggauucagaaaggugcaggcugcucugguagcaauaaaggaaaccagcucucccuugagaucccuuucaugaggguuauagccuggauccugugaugacccaggacagacuggucuugauccaggggaaccauaucagugaccucaagaggccccuuuuagccacaguaaucuaugauguggaguucucaauugcuggcuuugcuggagaaagagagaaggaagaaauagaggggccggucagcccuccuguacauuuaguuugcggucucaaaccucuguuuccuggagcugcaggcuguaugugugggaggugcacagcaguggcuuggccgccccaacgcgccuacagcccgcucuggggacagccgucuuuuggcagagucugccucugcagugguggcagcuggcccaggcagaccuccucucuguccgguuagucagcgucugguggccaagggcagaguggagccuguguuuccgacaggccagcugccccucagagugaggcagcgccgugauucugagggugaugcuggcguucgccccucaacccugucccccacaaggagauuacggacaaggcagcauuucuaauaagcagccucugcuugccccguagcagaugaaagacugcguguaagaguggguaauuuuggguuuuccugaugaaaguaguugacauuugugcugagaccucaugcgcucugcagcgcugccuuucaucucugcucucaaagcccugcucaucucugccaugacucgggggcggccugcgccaccggaauucaguugggccaguggugaaauauagaggaaaugguggaaugaccccugaaggcaguggaugggggaguggagacaaguccugacuuuccugguggaggggauguuccuggggguguggaacuguguaucggcccaugcagcacagccagggaaagaguguggaucuuggagcuugguauggcuggcuagauuggaaaggcagcuccuccacggacuugcucggugaauggagggcauccuuucucuucccugaucuguguccucauuugucagugggaauaauagaauaacauuacuaccaacgacgauggcuuucacaacuggaaccacuaggcccucaggaauguuuacuggcuucuagucucauugauaaacugaagccauugugccauagcucuagagaacuggcacuaggggcuugcaugauucaucugaguuccccagacaaugcuggcacauaguaggcccuccauaaaguaagaagggacacuuugcuccugacauccauacagcuccucuagcuuugcagagaaagcccuagagagaaagaaugugaaggaacaaagggucagguuagguugugcaaccuuucugauaugcauuuguaaugcagugagcaaaugcacaagccuugagucgcugcauucuuuucuaaccacccaagagauaaguugaacccccacucguagcaaccuggccacuugucuguuuagucagcccuggaauaccuccacugacggggcacucacuaccacugaaagauggugugcagaauucuaauguucuuccucucgcggggucgugggggcuuucuuccaguucucuggguucugaucguuggggcuguccugacacccuucuucagaugaccgcugucagguuggugaaggcagugcgcguugggccuucccucccuagagaugugauugcacgucggguaccaggagccuggccagcccucagcuucugcuaaccagggagcagugaagcccgguuuacuuuuguuggcuuguuuauuuucuaaugucaccugccucugcacuuuaaguaguauuugggcuguuauggagugugcacauucuaacacagcaccuugucagcuggcugagaagcugaaaauucucggcauuccuccuugaugucaauuacuucaaggagcaggaaggugacuucuuuuaacaaguggaaaggauucagguaacaaagccauuuccucuucuuaacccucuacuguggaaaguuauugacuuagcgacacagucuguuuaucugggcuucaggagcagggcuuuggagacugaaggcuucuccccacuuuugugcaauguuauauauuuuuucucacucuucauccagucugaguggggucugcccccuccccugagcagucaccauccugcuacccacuccggcucuauuggcgacuguggcauagggugguggaaaggacgcuggacugagagcccagagaucagaugucugaccuucccucugccuggaagagcugccuggccucugaucagggucccuaccuucguuuucuggccucacucacuguggcccaccauccagcagugcagguguccuggggacucggggaaggucagaaguggaaggaaagccuccaagcccucgcaugcaggcccaccauuccacugucagguuuucuucccuuuccuucugcucuacauuuugugccagcaguuugggggucuccugaaucuuaucccuucgcagcgguaggcaggugcaauuucuggccagucacugaacaugaagaagcaucuauaggcggaguuaaauccaaaacacuuggccugacacaccuggccuugaagucucccccagccucuccucuuguccccaacagugguucauguucuagccacacagaaauugaggggguccuguguuaucuguguuccugcagacagagcuugccuaggacagcaaaagucauccuaacauaaaaauaugcaugaauaaacucacugccaacauucagcccacccacauccaaugauaaucagucauuuacugauggccagacguuguaaacaucugucaguccacugcaagaacagcagaaacucguagcugaccuccauuuggccuacucacugaauuaagugauguuacucauucgcuuuguaaaagcaaacugagugaggccccaggcucauugaagacucuguggguuacccagaagcccaacuuuccagauucaauauuuuuucuauuucuuagcuguguuaccuugggcaaguuaauuaaccucucugugccugcauguugcaucuguaaaugagacuaauacuaguacccaccuucuaaagugauuaugagcauuaaaugaauuaguacguuuaaaggcuuagaacaguguuuuaugauacgauaaacacucaauaaauguuagcuauugauauuggugugcccagaaggcuuguuacuacuaguugauuuaugugcuugccaaaaguuguuguguugguaauuaaguacgacauaaacuaaugaaaauugaguuuauaaagaguuguuuuaugaaaaguuuaguacuuuggauagaauggauaauauugauuugcuaaaaaaaaauugucaccaaauaacuuaaaggcaaaacagcuguaaaaaauuguaaaaccauaguuuguauuccauaugcuuuacaggugauuaacuuuggcacugcuuuaaagaaacugaaaccaggaauuguagauguugacuugugaguguguauuuugcauggaagaugauuugcaucucuagucagcgugccaaaaaaagauccuacccuuugauugguuaauaaauaugcaacuauaauaaaauauuuaaguguugguccuuaaugauugccuacauuuucaaugaaaugacaguggcagaacugaggaacagggguuuuucucuccaaggcagaucagcugccagaaauugcacguuuuguaccagcugcaggguuuccuggaaucagcaaaggccugugagaggcugcaugaaccacacacgcuuacugacaccuccugugugccgagcgcugaguagugcugaggauauagcaauuggggagcacuagcagaaucaggguuguuaaccguggagaagagaaaggaaagaugaugucucucuaugcaaaucaagggaaagugauuuaaaaauguuaaaaaaaaaaaguuaagagaggucuucgaaagguguuuugcaaaaugauuccuuggauuaaugaugaaggaguggagugaaggaaguuuauauuuugugagaaaacgugugcuaaggaaggccucgacauuagauucauucuguacacaacucagcaaauuagaucauaguuuaaaaugauaauuucaggggccgggcacaguggcuccugccuguaaucccaacacuuugggaggccgaggagggaggaucauuugaggccaggaguuugagaccagucuggccaacauaucgaaaccccaucucuauuaaaaaauacagaaaauuagcugggcuuuguggugcaugccuaucuuccugucuacuugggaggcugugcaugagaaucacuugaacucaggaggcagagguugcagugagccaacaucacgucacugcacuccagccugggugagacugcgagacucugucuggaaaauaaauaaauuuaaaaaaauuauaauuuuugguucauguuuuuuuuuuuuuuuuuuuuuuuugaggcagagucuugcucuaucaucuaggcuggagugcaguggcgugaucuuagcucacugcaaccucugccuccuggguucaagcaauuuaccugccucugccucccgaguagcuaggacuacaagcaugugccaccacgcccgguuaauuuuuguauuuuuaguagagacgguguuucaccauauuggucagacuggucuugaacucuugaccucgugaucugcccgccuuggccucccaaaaugcagggauuacaggugugagccacugcaccuggccaguucagguuucaaaguauaagaucaaucuuauuuuauguauaguuuauguguaauuauaaauuguauacuaauaaagucauuuuuauaauucuuuauuucuuuuuccaagauacccacccccccccccaccaaggagggcuaggacaagugacaaaagucaccccagaucacagccaaauggguagagcuaggaauccgaaguaggugaugaagcuugauuuuucaagaugcugcaaccccucucccccauaugcuacauuaaauaucuggaccuauuuuaaguggguucuuuucugggguaaugagguucucuucugccucaguuuuccauggcugcagagcuccugcuguuccuucugccuaguucacucuucuuugccuugacugcaccucucugagcuaccuuccuaccuccauccuugcauucauuagggguuucuuuauguguccagcucacugugggacccaggacuccuugaagagggagaucuugcucauccaucugugucccccacucuacugccaacacagugguaggaagggaaggcggcaggcuuaggcgagguccugcaggcuggacaggaucugucaccauuacuuagcccaggcccaucucuuuacuuccagaccaacuggugucaccauaaugccuucuggcaauuugaagauucuggcaaccucuuaccggaugcagcuggcaggauaaucccugugcauuagccacuuucagagguaucugggcccccaaaagagucacgggagucccagacaugaaggagcauuaguggccaucuccccaccuugcuguaucagcaaaacugcuaagcccugacccauauuuugggcagugcucacccuaucucauuuuaucuuacuguauaucucguuuguaucauuuuauuagguaucuuauuuuaucucauuauaugguaaucucauuugcuggguagaccagugaggagggcugggacaagugacuggaauugcccaaggucacagacaagugagguuuagaguuaggacuccgaagcagguggcggagucaccguugaguucaucauagcgaugcuggcugccucaaaguacuguuuuaguuaaugcucacaagcaacucugcgaagcagacgggccauucauuugugcuucacagugugggaaacugagucagagcagguucaugucacacagcugauaaaugacaaagccagaugugaagccugugaguuggauuccaacauucaucuuugaugaagcguucagguuggggccuggugugggacaugcucagaggaggacgaggaggaugauuugggggaggccucagaaggcguuccuggucugagugugcugcugucacugccuugguuuggguccccgcuucugagcaggaucuucuauuggcagaggguucaaugcagugggugccaugaaggaagaugucuccccaacagcaucacagucucagggacuguucacaucacauuaaaagcgcugagacucuggcuuuuggugaaaacggcuauuuugucuuguuccacgggagcugggaagaggagacuaaacacaggagccucccccuaacccaggggcacauggagaaggaggaaggcagcccaugcuggggagcaaaagggagagaaggcgagggccagagcccugggaagugucagauccuggugugccgcgcuucucccagguuguauaaucagcugucacuucagcauuucccugcaucagccuucccaaguacagauugaacauuaaacaaacagugacggcuuuauaaauauuuaacucccacuguuuaggaauugcucggggcaggagacaaaauaagaguuccuggcugucugcuccaugcccccucuggcaugguguuggaggccgggggucagagauuuggggaguggugggcagcagcuauucucuucuuccuuuccagggggauguguuuggggacacaugucuguguguucauggagcuguuagggccucuucuagaagccaccaguuugcguuuucauacaguggcugggauccaucauugcugguguuauuccuucacaucagagcaaacuucuuccuuucuuuuuuauauauagcagcuuuauugagauauaauucacauauaauucaccugaaacucacccauuuaagguauacaacacaauuuuuuuuguuuguuuguuucuuugagacagagucuugcucugugacccaggcuggagugcaguggugccaucuuggcucacugcaaccuccgccucccggguucaggcuauucugcuucagccucccgaguagcugagacuacaggcacacaccaccaugucuggcuaacuuuuguauuuuuuuuuuuuuuuuuuuuugagacagagucucacucuguugcccaggcuggagugcaguggcucgaugucggcucacuguaagcuccgccucccguguucaugccauucuccugccucagccuccugaguagcugggacuacaggcgcccaccaccacgcccgacuaauuuuuuguauuuuuaguggagaugggguuucgccguguuagccaggauggucuugaucuccugaccucgugauccgcccaccucggccucccaaagugcugggauuacaggugugaaccaccgcaccagaccccaacuuuuguauuuuuaguagagaugggguuuugccacguugcccagacuggucuugaacuccuggccuuaagcgauccacccaccucggccucccuuagugcugggauuauaggcaggagccacggugcucggccaacacaauuguucuuaauauauucauggaguugugcaaccaucaccacaaucaauuugagagcauuuugaucaccccaaaaagaaaucguuuuuauuagcagucaccucuuuauucccacaauucucugcgugcuaagaaauuguugagcuacuuguacuacaaauauaccuauccuggaauggucuuuugugccuggcuucuuucacuugguguaauguuuucaagguuuaucuguguuguagcauagaucagcaugucauuucuccuuagggcugaauacuguucccuagcacaaguauauugcauuuuuaaaaaucuacucaucuguugaugaacauuuggggacagcaaagcucuaguugaaaaaucaagaugaaaaaucaaaaaaauauaguugaaaaaaucaaaaaaaucuaguugaaaaauccagcaucaugugauuaaggccaaacucaacuucacaaaagagagccucuacuauuuugggaaagaucuagaagguuaucuguaagcauaugguggauguuacaauguguucaguggacacgccauucagcuuuuauucagcacuuaccauauggugggcacuaugguaggauucauuaauuaauuuauugaaaauaauuauugagauuauauagucuugugaaaagauuuaucagaggcuguucugugaauuuuagagguuuuuuguuuuuguuuuuuuuuugaaauggaguuuuacuuuuguugcccaggcuggagugcaguggugccaucucggcucaccgcaaccucugccuccuggguucaagcgauucuccugccucagccucccaaguagcugggacuauaggcauacaccaccaugccuggcuaauuuuguauuuuuaguagagaugggguuucaccauguuggccgggcugcucucgaacuccugaccucaggugagccacccaccucgggcucccaaagugcugggauuacaggcaugagccaccgugcccaggugaguuuuagacuuuuuugggguguaagaaugggagcaugaguuuguguucucagcucguuucauuugauuucagaugucagcucucuuuaggagagaggcguggagaaaaggugggacucucugcaguccuguucuuguucugcccacuucccuccagucauggucucuggccggcucucuucuccccagagugguucuuuuccugccccuggugucccucuaagacccagauguuuccagcacccauuugagaggcugauucagcccaggcagugucuggccuagggaaggugacugcaggaaauguuaaaaaaugggggcuguuaucaugccugagcaucgcacagucccuccguugugacuaauuguagugguuguuguugaagggcugccccaggucccccucccuggaccgguacacucaccccagcugccgagacggcggcugcuaauguccacugcugcuaauguccacagcaccacuucucuggagauuagccuuccuccaacuggagcugcuucauccgggaaguugcucacccugcaccagcccuggcugacucaggggugcaaagggcugcuccuccuuguuuccaugugggguaaacuccauggugcgguucauguuccagggcauccuguggauggccugaguugguccccagccgagaccaccuccuucccuugccuggcucugccaccuucccuuccuuucuccugagguugcucccuguuaaaucacacagacagacauucccuccucaggaucuguccccgggugcccacccucagacacuauccggcaacacguucccuuuccugaguccccucugaugauguaucugacuuggagauccuuggccugcuggcucucuuuucaguucuguucuggagaauagaagcuuccugggcuggccuguugaguguuuuguuugguugguuuugauuuccaagucuuuucaggcuaaucggacacgaggaaaggucugcauugaaucacagccuuggcacuguuccccccuuccuucccuccuccguucauucccccgaacauccuuuucugugccgacaaugaccucagcagaaaggggaaaaggacgugggaaggcugcaugggaaacucauggaacuugguagcaaacagcucuggguucaaguccgggcccuguugcucaggagccaggcacucaguugugguggcuucucuaaccgggaacuucuucuaugaaaaugggacuauucgucucuacuccuugcauuauuguggggaucggaaauaaucugggucaaugauguggugcagugacuagcaucgaggggacacccucuccacacaggcuggaaagacauccagaaggaguccugggcucccucaccacgcaggggcucagccucgccagauaguugucaucacccauccaggcccguuucuggucucauugcuuuuguucauguacuuuccuccuggguugcucuuccuuuucucucugaccugucaaaaagccccauuguaagcaacauuuaaaugcuaccucuuccaugaagcccuuuuggaugccucuuagggggaugaguucuuuccauccuagcacugcuugcugcaugguccaggaucuguggggccugucuucuuuaccacuuugcucacuucaugaauguggggguguaugaagaguaugaugaaauuagaggcuauguucuggagucagacugaucaguacugggauucuggccauacccccuccuuagcugggugacuuuaggcaacugacuguaccauccugaaagucaucuguaagccgugcugaccccccaaccacaggacacuugugcccgcugcaggugcucugucagcagugacuucucacuaccuggcauccucugaauucacgagcaguuugaagaaugagcaaauacugagcaaagcucauaggauuaaauacacacagaccuguguaaguuaacaccaagcuaaggguuaaauacuuuacaaaaauucucagugcgguuggugggugagaagggcugucguccccucuggcugccuugccaagcugguagaggggccaucucccacuaccuacugacaaagauucuuugcuugacccaauuacccaauuuaaucagacacuuaagucuuuuccuaggcccaucuguguacuuccuguaaaaucuaguuuuagcaaaaaacucugcugagucaguuugguaaggaccaccggccgucaauaucuuccauaucugauagauaggguuccucaucuucuaccacccuccagaugaugucuggucacccuggccugccuuuagcaagaaucuugauagguugauuuaaccagaaucccccuuacuccugauguugccuguuaguaauuuucuauccucugacccccacccugcuucuuggcugugaauuuccacuugcucaggcuguauugaguugagcccuaucuuucuccuacacugcaaauucccauugccguggucccuauaccuaucaggaugguccugaauugucuucuuuaucaucugcucugcucugccagagcuuaagcccaggcagcugaguuaaaagugugaccaaauggaccaucuugucccugaaaauugggaccuaagcucgauuccgagauuuaaucauggcagaggaguuuacucugcuaaccaccaucaccccacccuaucccccagaggggugcggugaguaaggggguggcaacugguuguuuccaaucucccaucucucucuggcccuccucugucucuggccucccuucucccuuugaaagggacacagugcugcucacagccuguccugcugcgguggcugcagagaggggcugagaauaagccuguguccgaggcagcccuccaaauacagcagggcuggguugaccuuuaaauagaugggcucugggccacucaguuccuggaaguuugaagaaagucagccuuucaagugaugcgacuuccaaccucaggaaagaucgcuguguuuguaaaggguauaauuuacuguugcuuuugcacuucaugauaugcggcugcacagccagugggagccagcaugccagaauuaggaggggaaaauccucaaguauuuuaauauaccccuacuuagaagcaagauaaacauauguauuguacuuugggacagaagcaagggggguuuagcgggugggaaagggagaguccuggcauugcaugaaaggucuuuuuaagcugaacucugaggguuuucaguuuuucauuuuucuguuuuuuuuuuuuuuuuuuauuuguaagcaaagcuggcaugagcaaaugaugccaggaucuacuuggcuguguaaaagcuguagucccuccucagacaggcagacugcuagaacccucccuaagccauaaacuaguacaccguuuugccucgcccaauuaaaaaugauuggguguggguugucaucacaguugacuuagaugauuuacuuucuuccaggaaaucuuccucccaacucuugcuuugcaauuaggcaaaagaaaaauaaauguuaauauguucugugcucccagggaaaauuuuuuuaaaaagaaaauaaaacacuuugggaggccgaggcaggcggaucacgaggucaggagaucgagaccauccuggcuaacacggugaaaccccgucucuacuaaaaauacaaaaaaaauuagccgggcaugguggcgggcgccuguagucccagcuacucgggaggcugaggcaggagaauggcgugaacccgggaggcggagcuugcagugagccgagaucgcaccacuggacuccagccugggugacagagcgagacuccgucucaaaaaaaaaaaagaagugucaaggucaugagugucagggaaagacugagaaaugguuccagacugaaagagacuaaagagaugugagaauuaaaugcaaagcuugauucuggacaauugucaaaccuuggauggcugggagcguuagauguuaguuacguaucugugucagcuuccugaucuuccuauagaacaugguccuaagggagaaugucuuugcuuuagaaaaauacacauggaaguacucuguagugauagggcuucagguccacuacucccucucacaugcuguaggggaaaaggauuugcuguguguucccagcacguuugugauuauuucacaaauaacaauaauuaaaaaaaaccaaccucugguggggcggugcggaauuauuauuauuuuuuuuugggacagagucucacucuguugcucagguuggagggcaguggcaugaucuuagcucacuacaacccucaacuccugaguucaagcgauucuugugccucagccucccaauuagcugggauuacaggcaugcgccaccaggucuggcuaauuuuuuugcauuuuuaguagagacgaaguuuugccauguuggccaggcuggucucaaacuccugaccucaggugauccaaccaccucggccucccaaagugcugagauuagaggcgugagucaucaugccuggcaguaaucuuuucaguggagaauaaaauaaacccggguuugaauucugacccuuuaaauuuacucaggguuugacuucagccagggaacauaaccuuucugugccucaguuuccucauuuuucaaaacaaagauggugugugugugcaucuccaucuaugaguuguugugaauaggaauguaggggccccagcaggguguguaaagguaccaguuccuggggcgucaaagguuuuucuuucccuucguacccccucacugacaugcccaggucugucuguguagagcaguggguggauuuacagacuccgcugagaacccccuuauagcauauuuucagguucgugaugauaucaugggcugugacccugggaguuuaauuggaaugaauuucaagguuuuguuaaacuuggcuagaaucuuccuauaucuccagcaagauauugaugggguuuuuguuguugcuguuguuuuugagacagggucuugcucugucacccaggcuggaguucaguggugccgucacugcagccucaaccucccaggcucaagggauccuccccuucagcgucccuaguagcugggacuacaggugcgcuccaccacacccagcuaguuuuugaauuuuuuuguagugaugggguuucacuauguugcccacgcuggucucaaacuccugggcucaagccaucugccuaccuuagccucauaaagugcuggaauugcaggugugagccacugcaccuggccaagaacuugguguuucuuauuuccaagcuuaucuccucuguuauuugcucccagggagaccccuuuuccauuuauguuuccagggugcuggggggaagugauugcccucaucucuuuugcccagccaccaaacccagugcagacucugcugaaugcaggccccaucucuguauuuuacuuauuccauuuccugucuugaaggugggggcacuauguuuaucucuaggacccugacuggcucaucauugaaagcuuauuuugugcaaagcauuguucugagcacuguguguguaugauucuacuucauccucuguaacccuagcaguccggucaaauaguaucauuuuauagacaaggcaacugaggcacagagcagcucagcagcuugcccagaucacacagcuggaaagugguagagcuggaaucuggaugggugcuggcagccuggccucagagucggugcuaaccacugagcggcacugccacccaacggaugggagccugcaggaugaggccaugggaauugauuucacucagcgcgagccaagcagaacucccguccagaccucuguccaccacccuaauaaagccaguguuuacacaggcuggaggugcucaucagauguuuuugccaauccccaaauacggccagggccagaaagugagaggggugccuauuauguaaggcccugcggcugguccccagacaaugccacuuccucgcuuggcgcugugugacugcauaacaacggguuacucauuuccucuggaaaacuucacagggccucuuugccccauuuccuccucccaccccauccucaggcuuccucuguugaauuuucuccagauuccugggaacaccaccauggagggccuggccuuuggcgguggacagucuguggcugggugggaacgucaggaguggggccugccucuuugcugggaaugccgugcacucccagcccacuugccccaugccagcacucgaggcaggugaggcccagccauggguauaaggugcucccagggcgggauuagccucaaggaggcaggggguccauguuucugcuccucucccauuacuaacgggugucugcuuuagguuugaucucccucccuucugccccucuccugguaaagggaugaauaaugaaggccuuccuugggaagucugagauggauuaccccaaggaggcucgaacaugggaggacaugcgagaacuauugucacaugaguuuucuuucuauccugucugcaggacuucgcaggugagcaguaacggaaaucagccccguuuauuccucccagcaccugccuuauccaacuccccacgcuguggcugagucccagccugcuauggaagcaucacuggacucccauugaacucugugcagauucgcuguucguagacaugguaccugauggacaccaagcuacguacagcuucaaggccccuucuuucuuugcuaauaaaaaauaaaaaauaaaaacauaauacacguuauauuucuaucuuauaauacacauuucuuauuuuuaucucaauaagcugauauauaguagauauacacaucucugacuguacauacauacacaaacacacacacacguacaugcauguauaugcguaucuaucuccaaugcauguggaguguugugccaggucauccucacauuuaauuuuucuguucuauuuaucauucuuaaggauugucaggcauuagggauuuaucuauagcaauuuggaucuuagcaguucuuuucauggguuaucuuauuuuuuccuuccaacaaccuuggaggcuauaaaagggcauauuauugcccuuuuauagaugggaauuaauuuauuagcaaacucaguuucaugauuuuuuuuuucuuuugagauggaguuucgcucuuguugcccaagcuggagugcaauggcacgaucucggcucacugcaaccucugccucccggguucaagcgauucuccugccucagccacuggaguagcugggauuacaggcaugcgccaccauaucuggcuaauuuuauauguuuaguagagaugggguuucuccauguuggucaggcuggucucgaacucccaaccucaggugauccaccugccuuggccucccaaagugcugggguuacaggcgcgagccauugugccuggccaguaucauggauauuuuuaaagugcuuguuguguguugggcacuacuauguccugcauuuagaaauagaacucauuccuauucucugcuuucccauggagagaggcacaaaccugcggguauagguggguauaguuucuuaaugugcacaccaucguaaaguggagacccugugcgugagaugugugcuguguacagggugggcaggagagagacuggugaggggaugaugcccuuaugcuggaaggggcaagaugaagccucucuggguuuggugggaccuuggagacaucugccuaguguguggucacccagaggccaaggaugugcuguuucuacuugcuugcugcuuucucugggaguggccauuucuuccaaggcaguguaagagccugggcauaggagccaggcagaacuguguggggauguugccuccauagcuuucuagaugagcaaccuuaggaaaguuugaacaguuucucuacauccuggguucuucauccaugaaaugggaauuauuguuugagccucuaaagugagacagucaaaugagaugggcauuugaagccuucagcaggguuccagccucacagcuaacucucaacuagcugugaugguuacagagcuguagguugcucauaagucaacauuguaguugcuggagccaucaacucagcuauaggauacaacacugagcccuuuucacuauccuuugaugggucuccuuuucccuaguaugggccaucggcuaaggugauugaaaaagggccuuucauguuuucaaaggggcaaagaaacuucaguaguugguugggcauuuuauugaguagaggugacuccaugcaguucuuuuugggggaaggaugcugcacauuccaggguuuaacaaaaauuuauugaaugcuuacuuugccccagguaccugucuugguaaaggugauaaauaagacagccucauccucaucuucaucaagccaccagucuggugguggugacugggguggggacugcugaggcauugggccccuugaagccuucccucugggugucuuccuccccaggauggucugggcucucucgggaugggaggaaguuggucugaaagugccucagugaucgcugaaauagguuugccaaagauagaggggaaagaguuggccagccuuuguuuagggacucccagaauggucuuaggucaggaaagagugaauggguacauuucucccaauuucugggcuggagauuccaaacugacuccuucauggcaggcuuccuuaucucugcaacauuuguuuacauguucccuucauagauuucuaacaggaugaagacuuuguuccuugggguaagggucuaccuccagguguguggggaaaaguugagaagcugcuaaauucuuggcuuugacuuaucaaugguuuuucggagggccuggagcugggcugggacugaucaaauuugguaauugcuuaggcagccuccacuuuuguugcuccuggggccagauggcguugggcuagaaacaauaucggggaguucuguuugguuuuaacugcuguaccugggugcucuguuauccaaccaggcccucuccuaaguucucuucuuuuuuuuugagacagaguuucacucuuguugcccaggcuggaguguaauggcgcuaucucacagcaaccucugccucccagguucaagccauucuccugccucagccgccguaguagcugggauuacaggcaugcaccaccacacccagcuaauuuuguauuuuuaguagagacgggguuucuccauguuggucaggcuggucucgagcuccggaccucaggugaucugcccgccucggccucccaaagugcugggauuacaggcgugagcccuguaaucccggugcccagccaguucucuucuuuuuuuaagccucuuccuuuagaaggaagaaaacauaaucuauaugcuggcuggcucuacacagcagcaggcaucacaagggguuuuugucugcuuuugcuucugaaggugaacccacuaucuauuuagagaggccaggucagggugugugugugugugugugucuuuuucccuaggguggguauuuucauucaggaagguguuguuaugauccccuguuguagaagaagcagugaaguuuuagggagaugaagugcuuugucugaugucacacaacugauagaugacagaaucacauauguauucaggggucugguccaaagccuagaagaaggugagccaugcguggcccgauggcacagagcaugagcucugguugcacaaucgugggagguuacuuaaucuugagaaaccucaguuuucuuaucuguaaaaugggacaguauguaucccaaagggccauuuugaccauuuaucaaagucaguuucuccuccguauggagcggagaacaguguccagcaugcaguacgugcucugaugaucuuggcuguaaugaccauccugguuaggguggauuuggccaaaagcuggaguaacugguagcuuccugaucugagaggugucagugggugguguggcccaaagauugagaaucuugucagggguggccacgugaggguggaagugguuugaaugaggaauggucuugagguaagaguuggacaaacagugucuucucucucucucucuuuuuuuuuuuuuuuuuuuuuuuuacuuuuuuuugagauggaguuuugcucuuuuugcccaggccagagugcaauggcgcgaucuuggcucaccacaaccuccgcgucccagguucaagugauucucuugccucagccucccgaguagcugggauuacagacaugcaccacccacgcccggcuaauuuuguauuuuuaggagagaugggguuucuccauguuggucgggcuggucuccaacucccgaccucagguguucugccugccuuggccucccaaagugcugggauuauaggcgugagccaccccaccuggucgacagugucuucucuaagcagaacuguagcccugaagcgcccaggcuagaacucucuauugaaugaggaucacuccauugugccagcugcucucauauugcuuugauggccuuucucagaaaggagaaagguggugcuggguguggcuuuggcuuccuauggccgccccaaugcuggucugacacuuucugaaucugguuugugguuggaucugugcauccuaccgcuccacuccauguccuggccuuggagaaaucauuucccucccgccgugauuguucaccuucaaaggucaacaaaggcaguaggcacugcugagcucuugcagccuucagggcugagcugcuuccucuccugcuuccagugagggguugcuugagggugccuuuaggaaggaaccucaccccuaauguaacuugagcaggucuuugcucuaaacucuucgcugggaacauacccucccgugggacuuggcauggcacccaccucugcagagccaccugugccacagaauaaccucuucucccuagacacacuguguguccuugguuggauucucuagaugggagggaccggcugaagcauaacuguguauguucacauaugugccuuggaagaguuuuauacaggaaaggauuuguaaaucagaaaaaugaaugcugguaucuaauuuccuguccccguuuuaaguccagaccaagucaccuaaccccucgggcuugcagcccgcaucauccacugggugauuaccuugaguuaucugguucagucccuuugcugugggcacccucuuuaccucuacaaguaaacugcaauuaaucugacagcaggggcaagggaacugacgagucuugggugcaaaucuugagaugcuuuggcacauuaucuaauucauuguuuuucuuuucuuuuuucuuuucuuuucuuuuuuuuuuagacaggcuggagugcaguggcacgaucuuggcucacugcaaccucugccuccuggguucaagugauuuuugugccucuagccuccugaguagcugggauuccaggugugugccaucacgcccagcuaauuuuuguauuuuuaguagagacaggguuuugccauguaggucaggcuagucuagaagucuggccuuaagugauccacccuccuugggcagggugccaccugccugaaagaaaaugcccacccuagggaaaaagacacacacacacacacacacacacacacacacagagagagagagagagagagagagagagaccaacguggccucucuaaauagguaguggguuaaccuucagaagcaaaggcagacaaaaaccacuugugauaccugcugcugcguagagccagccagcauauagauuaugcuuucuuccuucugaaggaagacucuaggauuacaggagugagccuggccccaauucaauucaaucuuuaugggcaucgaacaagggcauuauuuauuacccaugguuuacagaagucaaacccaagucucagagagggaagacauuuuuuagucucacugcgaaaguaacagagcuagaauuuagucucugucacgcuaaaucgugcuacaugcuccgucuaguucagagccuguguggaggucgacacuggagucccucaguuuuccucaucaggcuccuggucugauucuuccaagaucagucucuuucccucagcggaagccagcugggaaucacuggccuuguaaccucuucaggcgaccuccuugggauguucacaaggagcauagccaucuggagaaugauacuguuuuuuccuagggcugggaugggggugguaucccucacaucauuccagaaacagcgccagcccugcuuuuaucagcgggggccacaaagaggcgacaagcccugaucaaaugugagcgagauugacaaucucagcacuuuccagggaaaggaugccgucccacauggcuucaggccuccgaggaagccccauccugagacagagagaccccaaaucacaguguguuuccuuuuggccagagaugaggcuuacucaucucagacagcuguguccacggcauguuccucaaggacagcugcuccagaugaaaagaagagaugcucccagagccuugaggggcugcugauaggaacccaaggccucacccuggggcuguauccuguggcuucaaaaauauauguauuugaaagcuucuagcaaaacagauuacacaagaacgcaaauguaagaucccuuugggauucuaacuuuuuuucuuaagguguuuaaagaaaaaugacacccuuaaaaagaaaugccauuuguuuucaaagcugcagcaccagaggacauggaagagaaaggcugaagugucccugaaaaugagugaagauuccagucuguuuuuacuaauguccaaaaucuuagguuuauugccuuugcguuccucugccccagggucucuguguggcaggcgagugggucucguucgauggugcagucaucguguggcggaaugcaugcucacacagggaaguugguugagcgucuccuuugagcaguccuuccucuggugaggugcacaggcgggcaucaugcccauuucauagaugaggaaacugaggcugagagggaugcugcaauuuaggacuucugggugauaucacagaagccucauucucuuuuguggcauguaccuucucuauuugggaaguuaaauuggacuauggggauuggaccaaggggucuucuugcuuccgcuuucucuaggccaaggcuuugcaguuauggaggaagaaagagcuggggucugucuuggcaacccugugacucuucuccccuauccucaccugccuucucacuugaccaacauauuuuaagggcuccauguacaaagguggggcuguggcccuuucccaaccagcaccuuggcccuguacccugauaugggaugguuaaggcacacaggcuucauggaugggggccuacgaccgcagauggagcagagguggacaggguaugguccggcagguggaggugcuggagaaaagccgcguuaggcagcacgggagccaggugcggggucucucaaagccucgagucccuggcagugcugugcucugugaggacugcuuuugacugcagggcacugacacucauaccuuuugcuucugcagcugaccauacucccuggagccuucucccgaggugcgcgggugaccuuggcacauacagccaucaugaugguacuuuaaguggaggcugaaucaucuccccuuugagcugcuuggcacguggcucccuugguguuccccuuuuacugccaggacacugagauuuggagagguaaguggcuuaccugaggccaugugcuaacagagaagaugaagagaugauugaaacaggccuaagaccagaccuaagggucuguacauuuuccacauacuuuccauaucuuuagaggccugaccaaagcagaucuuuuccuuucuucuagguaaguccaaaggcaccugccugcugggcccacuguuuucuaacuuuccuaacuuucugaucccuuggaggugauaaucaaauauucuagucugaggcauugggauacauggugcuagguucugagacucugcgucaggccugaacccugcauuuuguggaggugggugggagaauguuccccuggggaacaugccuagacacgggggacaacaguugcccucauggggagguaccuguuuacucgcuguuaugggaccgcuuucacaaaaccacugcaggugagugaguuccugcugaauaucaggccuggugucucuagacucauuauuucccccacccaaccccuauguuaguucaucucgagccacauuuuuauugccauaauccaggccuggacaggccaagaucuuuuaacaauuuuaauuacugaaaauaauaacugcauuuuuuuuaaagcccaacuuuugguagagucagcccaaaauacagucuuuguguugccaucugggaacuggauuuggaauuguucuuccaugagacugcagagcagaacggcagggccagaggucccacgagcuggucagacccgguucugcuccuugcuggcugagugaccuugggcauugugauucauauucucaucugccuucaagugugguuacgaaugcuuuuuauccugcuuaucaauuucuaugauugccauaaaauauuaacacaaauuuagcauuuauauaacauaauauauuaaugcauaguuuuuuugugggggggggcgguggaggggcaguguugagacagagucuugcucugucacccaggcuggagugcauggugugauccuggcccacugaaccuugaccuccagggcucaagggguccucccaccucagccuccagaguagcugggacuucaggcaugagcuaccacaccuggcuaauuuuuuguauuuuuuguagagacgaggucucacuaucuugcccaggcaggccuggaacuccuggacucaagcgauccucccaccucggccuucuaaagugcugugauuacaggugugagccacuauguccggcucacguccaguuaucuagggcagaggucagacauggaucucuccaggcuaacaucaaggaaccuguaggcugccuuccauucuggagacugcaggggagagucuguuccuugcucauucuggauguuggcagaauuuguuuccuugagguuguagggcugagaucccguuuucuugcuggcuguccagaugcauugagcuucuggaagccuccucgcuaggcuuguggccuccucucuccauuuucaaguccagcaaugguggguccaguuccuuuuaggauuuaaaucuuuucucccucuuucuuuucaccucugugaucucagcuagaaaagauuaucuaauuuuaaggauucaugugauuggacuggggccacccugauaauccagaauaaucccuacuucaagguccuuagguuuaaucacaucuaggaaguucuauugccaugggaggcaacauauucacagguuccaggaaauuccgacaugggcaucucuuugauuggaaugagggguggcagguauucugacacaguaccucagaaggguugcugugaugaugaagugaauggagacacguaaagcgcuuaaaauauuauguagagccaugugaauuuggcagcauugaauuguugaccuauaaaaggucaacuuaauaguaucuggucuauaguaaaucuucaguaaauguuugcugucauuacucuagugguagaaaugucaugcuuuauuuagccaguuugcuauuguugggcauuacuuuuuaaagaguuauuauuuuguuauuauaguauauaugugaacaccgugaucaucaugccuuugcaaauuuuauucugauuuagggcaaugcaugucuuuccaggccacacucagucuccugcucuggugccagugucucuguggccugaggggccccucuuucuugcagagccccucauccagcaccagcucagcucugggccauguguguggggugggacuuuucucuuuugggaagugggccaugccucuccuuccugagaccauccccuuuggcuuccucggggcccuuggcucuuugaaccagccugcagggcaccacaccugugggcccauuuuugucaggaaacgacucccuucccaagggcacccugagucccagguccccaggcccacagauguugggcccucagagugugaucccauguccccagcucuguaacucccugcauguggcucuuaagacucacaagcccauguuugccuuggccagacacuuucgccugucaguucugccaguugggaagugucauccccacugugugaauguggaagggauaaugaagaauuuccacggcuugccuagggucguugagcaauguggaagggaucauggagaauuuccauggcuugccuaaggucaucaagcuggcaucucaacccagguucaucugccugugaugacaggaaagaaaucaggugugauucuguucuuguugacccauagccaccucucucauuaaggcuucuccugcaggcaacuacacagccaguggugggaaagcaccuaauuuacaucuucaugcauugaaacugaugucacucaccucucccccuugaccuggaagagccccugaaggcugccauaggggaaaugauaacccauucuacagcugcugaaacugaggcccagggaguguccagagcuuucugagguccaccauguacuguugaccaggaugagugauagccaccuggugacaauguugaagguucucauucaguagagcuggguucaauucugacuugccugaccagcuggugccucauuuugcucuaaguauuggagccuccagcuuuauuuucuuucagugggaaagacugugagauucagucccuccuugaagcugcgcaucgacucuccuguccuggguacucuuuagguaguggcuguucugaaguggcuuuggaaacccuggaaugaaacugucauguccaaugcugagauuuguauaaacugucauuuuaacugugauuauuauuccuuaggauuugagaaauaaaaucugaggagggagcaggaccugccucagggccuccucuccaaguugagugacccaucuucccaggucuccuuuuguucugucuugagccucucuccugagguccugaaagaagagaaugugcuguuguagggggccuggaaaugucccauggaccaucucgugacucaguaagaugauguguguccucuggggacagaaggagguccugcacagaguguuccugcccguugaugcccuccccagauccuaacgcgaagucugacacauaguagccucccgguaaucuuaauaagcaaaaggacacauuucucaagugaucuuagcaccauuucaugcaaucaauuccagcccagcccuuuauucuggccagcccugguggguccauuagcugcaaaaauuagucgugcucaguuuuaaugcaaaugacuaaguauuacuuuauugaauugauuaauaaagaagcucucuuuguaugauaucaagaccaugaagaaauugcaaagacauagguagggucuacagcagaguuucucagccuuggcgcuguucauauuuugggucagaugauuuguugugggggcuguccuauguauuguaggauguugcucggcaucucuggccucuacccacuggaugccaguagcucugucagucgcaaccccagcuuccaguugggacaaccuaaaguguuuccagacauugccacauguucuuuuguggugguguuggugguggugcguacauauguguguguaaaaaucucccuuuguugagaaccacuaaucuagagaccaccuaauuagggcugacgugggcucuuccacagagccuucuccuuaaagacagauagguugauggacaguuggauuuagggaaaagaaaacugaguugaggguuuaaagugaauuucauccccaauguggaagaugagcguuccguuccuggcuguaggauguggagcauguuacuccacaugugggagaaaaaaaucaucccaucuacuucaggacuuuugugugauuaaagaggcaagauagucuagugcuuuucauuccaugcgcacucaauaaaaaauagggguuauauuuaugaauaguaacaaaaagccucuuaaggaaaauuauuuugggcccuuguucaagguucaguugaccauuuauuuuuaaagagauggggguggcccaggcuggaguagaguggugccauccuaguucacugcauccucaaacuccugggcucaaucgauccuccugcuucaacaucccaaagugcuaguauuauaggcaugagccauuacaccuggcccauuugacuauuuuuucugcuugauuguagagaagggaauguaagucaugaagaucuaaacuauaaaaccugcguggcuuagaggcugagcauggauugugauuuaaggaagccccagguucaauuucugguucugccacuugcuagccauggugagaccuugcccagcuuucauacuuucagguucuuugucuguaaaaugggaacaauaagaguacugaccucaccgggcuguugugcuacuggcugugcugccugaaugggcccuccuuuauuugaaucccucugccacaguugucccauuuuuuuuuuuuuuaaauggugacccaaguuccauuauggacgaucaggcauucaggggaaggagggauccaaagcagagacaaaagcagccagccagcucauccccucugcagcugauaccgaggaggaggaugccagugggaagaagcguggccauauggcuggcaggaugccucacugguaacagucagcccggccccuuugaagugguuuuaagaccaauuugguaacuugauuuggaaagugguaucgaugacuccgagggcgcaggcugcucauuagcugcugucugggcccggcaaauugguuuaaguggaaugaaauugguuccuucccuccccgugcucauggcugagguccaggcccgauuguaaugggaaccucuccugggcaaaggacauagaaaagcuuuccggggagucugacccucuuuuuucauaugugaauucuacuuuccccugggggucaaggcaauaggcugauaaaacauaaaaaugaaccugaaguggguggggugagugugugugugggaaguuggaucagaggagaaugaacaaugaacaguggccgaguguuuuucaagggccaguuaaccauuccccuguugagacacugugcuugaugcauuuuuuuucuuuucuuucuuucuuuuuuauucucccauauuacaaacacugcugggaggaacauccgcacaugcuuucuuggucacuuaugugagagcucauccaggauuuauacccugaggcgacuucacugccguggaggcuaaggaacauuuucuguuucauaagacgcgaucacauugcccuccagaacaaucaugccaguuuacacucccacugacuguacacaagagcccuguuuucccccaucuggucacccacauuugauaggucagaauuuugcuuuuugccagucucaugggggugaugccauuucugguaguuccccugauugccagggggaugagcagccugcccucaacugccccaugcugaaggcccuccaaaggcagcaugaauccucacaguucccagccugugcccugacaaccuaggaggacacgcuggucugguccauugcuuaucugaaacgauucccuuucccuguuccuuuuguugccuugagugucaguuuuggaccucccacugagcaguuuuuucugucacguagccauagacaggacugaguucuuuggaaaauaaucacaucccacuguuguucccauucguucauuuuuuccuucaacuaaccaacauuauucagcacuuuacucagcacaggauguggaaccgaaggccuggcuuuugggacacucaccguccccagucagcucuguguccuagggagagacccaugagcucucugggccuccuuuuguuucucuguaauaaaggacuaaagcuaccagccucgcugcggguuggaaaaaagaaagaguuaguguaacacaugugaauguguacgaagggguuuagagacagacaaaacauugcaccaaggcagggcucgcuggagugcagacccaggaaaaacacugcaggccaaauugcuucuggucugucaggguaccagccacacauccaaggcagggaacuuagggcgauuggccuuucugcucaugcuuacucucccaagcuuguuggguuauuaucaugcacaagccauucaaucgauuguauugggugccuaauauaucagacacucuuaggugcuagggauguaagagcaagcaaaacagacaugguucugcccuugugggcuguauagucuaguggaggaagggggaagagguuaaguauuuguaggaaggugaaccccauguuaagaaagcaucuuccaucuuucaaauguuuccaaguagcugguuauucaugauagcgaggaaaugguggucaucuccauugcucugguaacuaguuugugucugagaaagugcugauuuccaagaaaaggaaagagaccacggaugaaugauagcaagacuauuaaacaggaauacaaagaagagcucacauuuauugagcaccuacuauaugugcuggacccucuuguaagagcuucauacaaauuaggcagacaggcaauauuauuauccccauuugaucuacaaggaaacugaguacaaagugauagcuuuucugcagagcuugugcacaggggccaaaguuugggaacaaugccuuucuuuaauuugaaaguaucuguuguuggugucacuuguuggaauuccuagaaucccagaaaaguaaguuuaaguuuucuucugccagcaucggucagccuaccuuugacccaaggucacgacucccucccuccucccuucccuucccugcucugacauucuuaccuuguuuuugaguuccuuauucccuagcuuccuccaagcagcaggcucugggaacagucccguucauuuauauaacaaauauuuauugaaaugcagacuuguuguuuucauaauaccuguguacaaguuaaacccguggucacuuguucaugugccucuuguuuaugacaagagguggucccuuguugaaagccugucacauggcagguacucagucuuuucuuuccuucuaauaaguaggugaguauuuuccuugguuugcacacgaggaaauggaggcucagagagcuuagguagcuuacucaaagccacacagcuggguuaaauggguucagcaccaugaaaaucugaccuuuaaugucugcacucuuauucucuggcuuauugggaaagaauuggacagggaugguaaauggaguugauggaggcaaagagauaauuacuguugcucaaagguggaucgagagaguuugggcaaaaacggaaccacgaacaagccguugaaaguccccucauccuggaccuguggucuguccuuuguaacugcucuuuuuuuggcauucccucugucuccucugcccaucccaaugccaggcacacugagccuguagggauuuacaaggugggccucagguuucuccccucccaggugggcauaggaaucacugcuuagcuuagauuuggcagaaugaaagagucaggcagagucucacccggcccuguuucuuagcugcuuugacaccuggggcagguuuuuggaccucucuggacauggccagcuguguugugacugcccaccagaggcugggucugugaauggaagacugaagaaaaggcgaugaucacaguccagggacaagguuucugaaucuugugaaauaguuacaaauacuaugaaacaggaauacaaagaaaagcucacauuuauuaagcacuuacuuugugcuauacccucuuguaagagccuuguacaaauuaggcagacagacaauauuauuauccccauuuuaccuauaaggaaacugagugcaaagugacagcuuuucugcagagccugugcacaggggucaaaguuugggaacacauugccuuucuuuaaucugaaacuaucugcuguuggucucauuuguugaaauuccuagaaucccagagaaguaaguuuuagcuuucuucugccagccccggucagccugccuuugacccaaggccauaguaaguuccagagugacuucccgucuguuuuauuaucccugacaaagggauacaguauugugcgguggcuguggauggcguguaguaguguuuuccuucucuugaaaagcagcugcugagugguggagcacagagguauucccugagccccagcuugugcccaugguagguccagggcguuugggggaaggagaccgacucuagguggucccgucugguuucucaggggagaaaauucauagauccaucuccuagcugucauccaauucuguguagaaggggaaagccaagguugcccucagauuuugaucuugguucacucugauuucucuaugccagacuaguagagcuucagggaagcuuggugacuaugacuggaugaauucugucccccuuaaaaccauagguugaaguccuacucacccauaccucagaacgugacuguguucggaaauagggucucuagagagguacaguuaacugagcucacguggcggggcuccaauauggucagacugguggguguccuuaucagaagaagagauuaagaugacaaaggaggagugaagaccacguguagacacagggaggagguggccaucuacaagcccaggagagaggccucagaagaaacaacucugaccacaccuugauccuggacuucuggcuuucagaauugugaggaaauaaaccucuguugucugagcaacccagccugugaaaauuuguuguagcagcccuggcggaucaauacagugaccaugagcaagucacucacccucucugaacccccuuggucucagcucuaaaaagaagccugagaauuucugccucacaggcugugguaagaggcaucagaaauagccgacuuucaucggaggcucacugcgagccagggccuguuuaagccuuuuccaugucugaacacacuucaucuucauguguagccuuuggcuggggaggggagauacuauuguucccauuuuacaggugaggagaguggagcacagagcuguuaauuaaccugucccauguuagucagcaaggaaggggcugguccauauguggaacuucguaguuguacucuggugcccacacaccagaucacuaugccgucccagcuguuguuacaauaagacuauguaggugaagggcccacccaguagugccuggccuaugggacacauugaagaccagcccccugugaccagaaccucccauuugcugcauugaguuuggaauguuugaacuccaggagcuguguguguguguguguguguguguguguguguguguguguguguaucugucugucucccucucucuccucucuccccuaccuuccuuuucuucccuccuguuuuugggagggagcucagccucccuucacugccacugcccaucagcauccucucccuauucagccacccccaccccccaucccugguauuaauugacuuuggcuccuguccuggagcucagccuggcacccagaccugccgugcuauacuaacaccucucacaugguuaaaccaauggggguggcauuuagcagaugacgcugaaacccgugaaucugcccuuucucacugggcccucacugcucuagaguccccgccucuuuuacgaagcggcugucaugguugaugggugagugucaggccccacccagggacagggaggcccagugccggcuguggaguuacccagaccuuacgguaaaaacgcaucacccugaaugggggccaggccaggcaucggcccaagccggcccugcccagcggcuggauucugacucgcugugccuuagucacaggccagagacucuucugcuuccagcugaggcuguccccugccuucccuggcggcccggguuccuggaaaagcugugugccagaggacgggaguuucccuccaacuuaagccauuagaaagcucauuuauugagcacuuacuaagugucagagacugugcuaggcacuuuacaugaaucuucucauuuaauccuuuuaauaaacuuccggggcacaugcucuucuaaucucccuuuuacugaugaugcaggcuugacagugggaaugcuaaccgcagaaagcagcucaccucacuugggugcuacugugugccaaguccugggguuagcacccaauagccccguggcggcaugcuguuauuacucucccugcauaggagugggaggcugagaccuggguguuucugggugucccagcuccuguaugccaucugccuguccagcccuuagccacaaagcuguugugccauguggggagaugcggccaguuucccaggugaggcugguccugcuucaagcgugggagcuccaaccacugcuccacgcugccuccacuccugaaccugaagguggaggaguuucccacugucucaaauaagcaccggggcccaggggucaccaggcucagauggaauuugcuuaaaggacucuugggagaaaagcugauugggggaugggaagagacagcuggcagucacuuaggagacagaugugucaccagaacuaaagacugaccugggaggacugacuuucacccaaaagggccugggcugggaauucuccuuuaugucuccuucccucacacucaagauucaggugcucacaaggagcaccuucgagugaggagguguaggagggaggauggcuaacagcucagucugcucagcacuuuuacaguuuauaagccauuucacagacauuaucucacuccauugggcaaucauaugggaaugcaagccacugucuuuucuuuucuuuuuuccaaauggaguccugcuguguggcccaggcuggagugcagugguaugaucuuggcucacugcaaccuccgccucccggauucaagcaauuauccugccucagccucccaaguagcugagauuacaggcaugugccaccaugccuggguaauuuuuguauucuuaguagagaugggguuucaccauguuggccagacuggucucgaacucuugaccucaugauccaccugccucagccucccaaagugcugggauuacaggcgugagccaccauacccugugccccugucuuacugaagagggaaccgaggcuuccuuagagagggagaggacccuccugggaaacuuucaucccaccugcuccuucuaccccagugcacugcuggagcucaauauuccugaggcaaagcucccugcacagcaguguccacagccguguuguugucauacccgugcacuagcagagagcucagggguagggcccuggguaggaaacccagggcaaggccaguggguagaguugaugcaggccucaggcugaucaaaaggaagacagcgucacagcauggaucugacaucugagggacgucagaucacagaaaggucuugagauuagagcugaaugaauaccccuaggagaaacuaaaaggcguguaacaaaggaguacaauaucaacagcaagccucccccggucauuacaugccuagacugugccugaaccucacauuugucauugcacugguccuuggcacuguccuucaagggaagaacuguuugcccuauuuugcagacuaagaaacacauccaggaagcagcugagcugggaauuaagcccaggguugaucccaaagccucccuucuuuccaugcugcucugcuccuuacaaaaacaaaaacagaauuccuuuuuuuuuuuuuuuaagauggagucucacucuguugcccaggcuggagugcaguggcaugaucucggcuuacugcaaccuccaacuccuggguucaagcgauucuccugccucagccucccgaguagcugggauuacagguauaugccaccacgcucgacuaauguuuguguuuuuaguagagacgagguuuuaccacauuggccaggcugcucucgaacuccugaccucgugaucugccugccuuggccucccaaagugcugagauuacagacgugagccaccgcgccuggccaaaaaacagaauucuuucaauguugcucuaggaaauuuauuuuuaaaaaaugaauuuccuucugcaaugccuggcucacgaccgauuguagaucaagaaacagaucuugggccuuugccacccaagcagguucagaaagacugcccuggccuccaugugcccagggaggccagaggagcccacaguuucacugucucagcagagcuggaggaaccuguuaaacugucuaagaagcuaauaaaaaaaucccagugagaucaugucuguuaaagcccuuugagcucccugagcucugaggcugucuuaacacucacugucucauugcuuacucagcacaaauuuccccagggcugcaaagccccuucccuguuuccagaccccugguuuccucacucauuucauuugaugcuuccuuuacaucuugaagaucugccauuuuuuucuuuaaacacccuauucuagaaagaacuggcauguuuuggguaccuauuuugugcuaagucuuuuuucuccauuggcuuuauagucauacuuugaaacaaaauguaauaugugcccucauuuuccgaugaggcaacagaggcacagucuggggagcucagcaaggucucauguuuuagaaucacaagcugugucugcaccuagguugugccugcauuuuuuuuuuuugagacggagucucgcucuguggcccaggcuggagugcaaaggcgcgaucucagcucacugcaaccuccaccucccagguucacgccauucuccugccucagccucccaaguagcugggacuacaggcgcccgccaccacgccuggcuaauuuuuuauguuuuuaguagagacgggguuucaccauguuggccaggauggucucgaucuccugcccucgugauccgcccgccuuggccuccgaaagugcugggauuacaggcgugagccaccgcguccggcccgugccugcauuuuucaggucauucucuccaguaggcagaagcuucucuguccuuccucaaugggagaacaaggaccugucuggaauuuggcucugaacugaugguuauggcacauuacuuauucuugcuuugaaggucaggcugggcaaucucuguccuuuugaauuguccuggaguaucuuggccccgaucugcugggagaucacccuacugcaaccucccugugcaggaaugcuuuuacuggacucugcauaaaaugaaugaacagauagaucuugauguuggagauaucagccuguagauugccugagaaccugacucaaaccccacucuugucuccaucugcaaaaaucaggcucuuuggaauaccuuuaucaggggauggccauaaagauuguuagaaaaauaaauuauaauagcuaacauuuauuuaguauuuaguauuauaguaacguuuauuuaguauuuaguaucagaaaccauucuaaaguuugcucugguagcaacagcacuauccacaccccucccaaauuaaccaugagauaaauugaacggguaauuugcuuccauuuuacagauaaaaaagcugagacugaaacucuaacuugcagaauugggcugaaacccagaucuccugagauuagggaagacauucccuucucccuacuccaagaaaucuguugugagcucauuucuauguggacuuccuagaugacuggaacauuuuuuuucuucuuuucuuuccuuuccucuucuuuucuuuuguuuccuuuucuuuucuuuugcuacagcucacguaggugccucguucauaauuucuccuucccaguagaaucccaacuacagaagauacauacauaaaugcaaagcauggucuaggcagguuggcuccaggacuuuggagaaaacgugcacaaaacuugaaauacugaucaucuugaauaucucuuaauuacuagcaguaaggcacaaccauaugcaaaaagaaaccaaaaccauggacuuuugccacugcuugacauugcuccaagaaaaaacuugccuuugagggugaaguugaccuccguuacucuuaaguuuccuuaugugccucagaauguuauuugagaaucauucugagggaugacagaggccugcaauaccuaugucuuaacuagaacagaugcuuugugaugaaauugucuuguugugguugugugacugcugugacugagacucaacaaguacccacuuuuuuuuuuuuuuuuuuuugagacagucucacucugucaccaggcuagagugcaguggcgccaucucgguucacugcaaccucugcuucccagguucaagcgauuuuccggccucagccuccccaguagcugggacuacaggcacgcaccaccacccccagcuaauuuuuguauuuuuaguagagaugggguuucacuauguuggccaggauggucucgaucucuugaccuugugauccacccgccucggccucccaacgugcugggauuacaggcaugagccacugcgccaggccaacaaguacucacuucuaccugugggugugguucagcgcccccagugccucucccaggugggaguugccugccuugagcaggugaacaaacugaggcccagggaguggcuuccccaaagucauacaguguagaagaaggauucgggccucugaguucguggauuccuccaugaagcaaugacugagcugcugcucugcaacuggugcucggcuugguccugggggucugugagcucuguaccaugggccagcgcuuucugugugcugccacauuuauccuuugcaccacccuacaagccuguccuccagguccuccauccuuuauucaaaacauuuaggaugaauuauguuugggaguuuauccuguuuugagauuuuagaaacgcaauacaguacgcauaucauacuauguguuaugggcugaauugugucucugcaaauucacauguugaaguccuagugccaaggaccucagaauaugacuggauuugaagguagggccuuuaaagagguaauuaaguuagaauuaggcuauuagggugggcccuaagccaacugggcuagagucccuguaagaagaggaaauuuggacagagacaccaggaugcgcacacacagagggaaggccauguguggacacagugaaaagacagccaucugcaagccaaagagaggccucaggagacacccaacugccaacaccuucaacuugaucuucuggccuccagaauuaugagaaaauaaauuucuguuguuaaagccacccagucuauacuccuuuuuuauggcagcccuagcagaccaauauaccgugugucuggggcagugccucuaaccaagcccaaaauuucuacagggaaauauauuaauuuucauaguaagugggauaaauaaaauccauaaauagcuucaugguaguucaggucaagauacuaaguuuccaacacacaguauaagaguuaugcccaagagucuguaauccccuccccuccccugcccuccccuccccuucccgagacagucucugucgcccaggcuggagugcaguggugcaaucucggcccacuacaaccgccaccucccaaguucgagugauucucaugucucagccucccgaguagcugggauuacaggcacguuccaccauacccugcuaauuuuuuuuuauuuucaguaggaaugggauuuuuucauguugcccaggcuggucucaaacuccuagccucaagugaucugcccgccucggccucccaaagugcuggguuacaggcgugaaccaccacacccggcuguaauaucauuucuauucugcaaauaaaaagccaagcuccaagaggcuuaguaauuugcccaagaugcccaauuaguuucugcaagggcuaaauuuguagcuggguaguuggccucuaggccuuugaauuugccugucauacuguaccaccucuuugacagagauagccuggguuagugcccucucagagcuuggggagguagacagguacaucuacaacuauaguaugucacaauggagugugagaagggcaucugggacccaagcucaaggggaagagccuuggcuuuggccccagcacucagcuguuccagguugagccuuagugcuuguuccacaggaaggauggugcagagccaggcuggcagggcuggggcuggagcugaggcugagaggggccugccccucauccauccagcaccaucaaaggccuuuccuuggcuggcaagaagggagcucugaacagucugcucugucuuuccauacuguguagggacagauagggagcuguugcaggagaaagaacugccaccucuuuuccagguuccguggugaagggaagacacagcucugcaguuuaauuuuuuguuguuguuguguuuuuucuguuuuuguuuuuugagacgaagucucgcucuguugccaggcuggagugcaguggcgugaucucggcucacuguaaccucugccuccugaguucaagcgauucuccugccucagccucccgaguagcugaaacuacaggcacgcgccaccacgcccagcuaacuuuuguauuuuuaguagagauggaauuucaccauguugggcaggauggucuggaucucuugaccucgugauccgccuaccuuggccucccaaaguguugggauuacaggcgugagccacugcgcccugccaguuuaauuuuuuuguaagucucauguuucucugcaaaacuugaaaacagggucugcuucacacuugagcuagagcccuccuuuuagcagaagcuuguucuuauuuuuucauuuuuauuuuaucuuaagaauggccugucauaggccucauuauuaugguaggcacuauuauuacuauuauuaucaucaucacuaucauuaucacuuuuuauucucucuagugauuaaccagucaucacuggccuagcuugcauggugguuuaaugcuuuucaaacaacuuuucaaccaccauuuaccucuacuuuagcuacuaguaccaucccuauuuugcacauguggaaguguagguucagagaugccaagucacuugccccagguugcacagcuuggggauggcaggauccacacucugcucccgagcacuaggaaaagcaccaugauagccugugacaugaagcccucuacagacucaaguuucaggggugguuuuaaacaugucuucuggcuggacacgguggcucaugccuguaauuccagcacuaugcgagaccgaggugggcagaucacgaggucaagagaucaagaccauccuggccaacauggugaaaccccaucucuauuaaaaacacaaaaauuagcugagugugguggugcaagccuguaccgugcagcuacucaggaggcugaggcaggagaaucacuugaacccaggagguggagguugcagugagccgagauugcgccacugcacuccagccuggugacagagcgagacuccgucucaaaaaaaaaaaaaaaaaaaagaaaagaaaagaaaaaaaagucuucugcaggccaugggggacauggucuucauuuuauaggugaacagacugagauacaggaggagucacuugccuagggccaaacagcucguuccucuucaggccuucccgguccugggagcgaguguuucucuuugccuugggaggcuuugcagcuugugcugcgcagcugauagcacugcaaccccugaacaugcacacacacacaaggugcacacaggcaugcgcauggcggggaggugugggugcacuuuccagcuucccugccgugccucguucugcagggcaaggccgagaaacagcgggcagccugugugauauggggacagacauguucucagaucuuggccaugguuucuaauucccuggcaccagaagcccugcugggugaucaaagcugagugccccuaacagaaagcagagaggcacaugggaaugacagguggugaggugaagggaacacgggcguggcaucaaacaggauggacagagugguugguuggcugaucuaaguguggaggagguuguaaacuauucauuuaaaugaauauauuuauucagcaccuacuauaccaaccuuagaaaacuucauacuuucuguuuuuuucucuucuuuuuuuguuuuucuuuucuuuucuuucuuuuuuuuugagacagagucuggcugugucgcccaggcaggagugcaguggcgcgauauccacucacugcaaccuccgccuccuggguucaagugauuguccugccucagccccccgaguaggugagacuacaggugcacaccgccaugcccaguuaauuuuuuguauuuuauuggagcugggguuucaccguguugcccaggcuggucucgaacuccugagcucaggcauccgccugcuuuggccucccaaagugcugggauuacaggcaugagccaccaugcccggcccaugcuuucuguuuuauuugauccccuuuuuggggaagacagggcagguugaaaggucugcuuuccaggggaggaaacugaggcucagagaggagaaagucaggcgccagagguagaugagagccaggauuugacccagugauuuaggauuccaaguccaaggcucaaagugugacuugacagcugcaaucugggaucuggaugugugccuucuguggcucggugacuccagaauuuuuccaacaucugguuguacggaauaacaauaguagcacgaaugaucccauagcugacagccacgggagccaugugccaggccugguucuaagcacaugucauauuugaacucacagaguccuccuagcucacugugaaguggauacuaucgaaggggagucuuaaggguuucagucaguugucacggucacagcaccaagaugggaacccagcagguggccuggguccucaugguuugcugcuguucugugcugccccuuagcggggugggguggggugggguaggugggcucaggccugcagagcuucuguguggcucuaagggagaaagagcagaagggagauuugggaugucuucugagugcuagccacgugagugcauuuuaccaagcgaacugaugacuaucaguccccugauugcuuccugucuuauguuuuuaucuuauccacgcauuuagugggcauuuauaaaggaauucugguauucuaaauauucuacacucuggggauauaaaaguuaaaagacccaggcugggcgcgguggcucacgccuguaaucccaacacuuugggaggccaaggcgggcggauuacgaggucaagagaucgagaucagccuggccaacauggugaaaacccaucucuacuaaaaauacaaaaauuagcugcacgugguggcacgugccuauagucccagcuacucgguaggcuaaggcaagagaaucgcuugaacccgggaggcagagguugcaguuagccgagauggcgccacucuacuccagccuggcaacagcgcgagacucugucucaggaaaaaaaaaaaaaaaaaaaaaaaagacccagugccuacccuuaaaggagcucuucuuauugaaacucuuuaaggaaaggaggcaggaaacagacaucuuuaaugggccagaggcugauuuaggcuguucagacauuguuaagcugcucagcaucugaaguucaaagaggcugagaacaaaccgguuaggaaauggcagaaggggguugggaccuaggugagcagcccgucaggagccccuggguggcuugcacuccuagccccaagugcaauauacaggugaggcgccugcagaauuuucauuaggcugaguucauuucuggaagcagggaauuggcauccacuuaaccaucccuaaugccugccuuuucauguaugucugcacuuacuucuggccuuccccggaugcaguaugugauuccuggaaggggucuccuguacgucguaguuuugucaucuucaggcaacccaggaugacaugauuucuggaaauuucccugauuucuuucugcuucacucucccucuuuugcuagaagggaucggcuuaggcagccauugugguguucauucaacauguccaguacagccuguuacugcaguuuccaaguuggaggguccgugagucuacucccuuuuuugaacagagggguacauggggaagcugagccucugaugaauggguugauuugucccaggucacacagcuugaggguggcagaagccagaucucaggucacagaguggcucuccuccauuugccucccuggucuugccuccuggaggccuguagauaggagacacccuuccuggaaagacaacagcuuggggacauuacagauaaggcugggcgggugugccuagcuagcccagaauaaaaggaucaccgagagaaguuaggaaucgaccuuccuugagguggguucugcagauaaagaugcuuuugaaguucaguuggugggagauaggaucuuuguggccuucuggauggaugcaccacgauagggaaaucagcaagcugaagauagggaaagugaacacuuaucacugaaggccucugcaggguuugcuuugagguacuuccuuccugucaacccuguucuggagucugucuccauuuuucagacacaaaaacugaggcauagauaacuguuuucuguuuuuuguggggagagaguauuauuguuucaauuuccuggacacuucaaaacauaggguauuucucauuaugcaauaguuuaauugagcacauacugcaggccaggcauggugcugcaugcauucuggaaguacaggaaugaguuggaagugcucuuuuuccuuagagauuuuuuguucucuuguguguguguuuggggguggggggggcgggcgggcacgaauaggggaggaauuuagaugagaaaucagauaaucacagccaaggugccugccuggggacacagggugccauaggcacacagaagggcccaggguguggacuuaggguggucaggggaaggaaggaguuugcccagagaagaggcaggagggagacaggaaagguaagcagaggccagauccuagaaagaccauuuugacuuugugcugagggcgauggucucaugaugcagauuuuaagcagaggugagagagggagagauuagcauuucagaaagcauggccucugccauaggaagacaagaucagagggagguccaagcugguggccaguggugacggggccugagcuggaggagacagggaugcacuggagacccaagagagaagucccugaacgcggugcacgaagagccucugggguuacaggaaggaagggguaaaauguucuuuucuguguccagcuuaggccacugaauagauucggugcuguguguuguacuaggaaaugcggaggugauggggauuguuugggcuggagucuggaggggcugugccccaccccaagcugggugagcaucuaagguaagugagggcugugcccaagacugcaugagcaaauccagguucuccuaccagcaagcugccuugaagacucugaggcuggaaauguauaaccuuguccguaccacugagcaccuguuacccauacacauuacuguucuccaaaccacggaacaacuugaaggauuguuuugccagacuaaaaagugaagaaagcacugguuuccuuccaugguguuccucuuuaaaccacaccuucucaaccuuguuuagggaguggggauggccuucaggagcuccagaggcccccccugcccgagucugacuccugguuucuggcuucaacaaugacuaaccuguaacuucacauuuuggucuauaaaguggguagaaauguagcaccucugcauucuccagguuuguugugaggacgaaggagauaaugaauguagaauuuuuuuuuuugagacggagucucgcucugucgccuaggcuggagugcaguggcgcgaucucgccucacugcaaccuccgccucugggguucaagcgauucuccugccucagccucccaaguagcugggccugcaggggcacucccagcuaauuuuuauauuuucaguacagacgggguuucaccauguuggccaggauggucucaaucucuugaucucgugauccaccugccuuggccucccaaagugcugggauuacaggcgugagccaccgcucccggccaugaauguagaauucugagcccagggcuggcucacugggagugggccacacauuuaggggguuguuguuguacacaugaucaucgguggcacugcuuugcagccuaaugguuuuugacacauguguuccuucuuaauccuuaagccagcaccuugaguugggugugaucaacucauugaauuuuuuaacuucagcugugacauuauagaucaucuagcucugcugugaccuuauuuuguagaugacagggcuagggguuaccaucccucuuaaggccuagggccuggguguucucacacccagguugcgguuuuuguccuugucuucuggagguucgucugcauuuuauuuuuuuuuguugacgauuuguugacgaggcuggagugcgggggugcuaucucggcucacugcagccucugccuccuggguucaagugauucugcugucucagccucccgaguagcugggauuacaggggcacaccacugcaccuggcuaauuuuuguauuuuuaguagagacgggguuucaccguguuggccaggcuggucucaaacaccugaccucaggugaucgcccaccucggccucccaaagugcugggauuacaggcaugagccuccaugccuggccucaucugcauuuuagggucccuguuuuacaaaggagcagucccuauuuuacuugcagaugggcaguagugucagauccucacugggguggucagggaagaggagguguuuggaagagggccccaauggaccucuggccugcgggauugagaucgggcuggccagcucuccucucuuuccucaacagagucugggucucacccugcccagcagcuuucucuucuuccuagaagugcccaagacaggaucuuuucaguucugagaucuuccaccccucgcacggcagccuuccugccccugcccaggcugacuucacaccaugcucuguuaucccagguccuaggcucgcaucggccacuugccaccauguuggugacugccugcccucuaccuuggauggugcgguccacggggcaggacugggguuugccauuugugugucccuggugcuucucucagugucugacaccuggugagauuugccaccuguuuggugcaugggugagugugguuguuuacacuagcguuguuauuggaaaucacucaauucuuguucucacccacuccugccuccucugagaaaaaguguggcagaaaaguucccugaacuacuaacacagggggauuuagcacucuuagauauuuuuaacuuuuccauagaaaggcagcaccccccaccccccuccacccuuuuuuugaagcagcagcauuuacaaauauugaaaccaacuuuguacaucuccacucugacuucugggccuauuuaauaaauauucacucaaacauguacuaugugucaggcaugauuuuuggcacuugggaaacaucagggaaugauguuuggggaggaagcugaucuagcuggggcccaggugggguuggaauggaggaauggaguccugcccuaaauccagcauggccuuuguccugcgugccuugggaccugguccuggugguucccuccacuucucugauucuugguuugaauauauauugacugaagaguuggaauagaaauaucuucguauucuguuuucaguucuaggaucguuuauucguccaguaacguuugucagggguugaaugucgaguggagaauggcugaauuugcacugugagggaacucacagcuggagggagauccccacagggacugcgaaggcuuauugcagaugaaggagugccaugacgacgaugacccccaggagcguccuuccaggacaagcagauggguucagggaaggcugggcaaagaggggcaagucagccaugccuggagaggagcagcaucugcugggaguccuguuuugacaguugucauucccagauguucggugguguguucccugcagcaggccugcaugcaccuggaugucagagugggaggccauuagcucacugguucagaaauaguuccugguuaugccugucuugugguggcccauucucagcuuggcggauacagcagcgaccaaccgaagccaccagugggagcagaacuggaggauggagguccucggaaggguucuagccacacugggcuucagacccuccagagucaaagccuggcuuccuucuccugcuggaggcaaaggcccuuauuguuuuuuuguggcugcaguaacaaauuucgacagauuugguagcuuaaaacaacagaaauuuauugucuuacaguucuggaggccagaagucugaaaucaaggugucagcgagguugacacccucugaggugcuaagggacacccuuuccuugccucuuccagcugcuuguggcacuggauguugcucggcuuguggcagaaucauuccaaucucugcucuugucuccacguaccuucucuauguccgucucuccucauguuuuagggccuccaaugaucucaucucaagauuauuauuuuuaaacaacuuuauuuaauuuuauuauuauuuuauugauuuauuuuaagaaugggguuuuaccauguuccccuugcagcucuccuacucuugagcucaagccauuguacugccucagccucccacagcaugggauuacaggcgugagcccccacuccuauccaagauucuuaacuucauuacaucagcaaaagcccuuuucccaaauaaggucauaggcaccagauucuaagggcaauaucuuuuuucggugggugaagacagcauucaacccacacuaguaggccccagcacuucuggggaaagccaagguuuagaccucauauccagaugcucuuuucugugguuuugucacuuuuucuuaucuuauaugagaaauauauacauauuuuaaaaagguaauuaaaauuuuguugauauaauuucacuuucacauugaguaaaagcugcaagaagaguacaaagaacucccucauauacuuuacccaaguucaccaaugaaaaaauguugcccccuaaguggguauaauguacacauuuucucacagccaguuggcagauucaucagagccucaggcucccccuaccccucacagcgucagacagagaguuuaccauggggcuggacaguuaugauugguuucucaggcagcugcucacucuaaggcuugcuguaggcucuggcguuacaucugucacugggaauguggcaucguccuggcacagucacagagaggccaaagacacagcucuguucaccccccauuuaaagccaaauggccauccuggguccugggggacccuuccuuguucucuccacucugcccuuggaugugucaguugcaggcacuucagaugcaguagaguuauuuagagaaggcggcucccugcaccgccugcugccuuuugguccauuuugagcuggguguccgagccucugcccuacaucuaggaacuaacagagucagguguugggugcagaacagagauuggcaggagaugagcaggcuguucagaguccgccaggagcucugugcuugaagcucugaagagcuuccauccuaccuuccugaugaugcagacuuuaggugagggggagaggcaaggagguuacaggauuuaccuuuuggaaagacuacuuugauaugaaugcagaaucagggauggaaaaccagugaaagagaaugucacaauaaauaguauaauugaaaguccaguuuuagagguuuugccagaggcacauggaggggguagcuugcuugguuugcauuaaauuaaauugcauuacuuagagucccuauaaaugcugguggaucaauguagcugaugguuucauaacaaaacaagaaugauaauaacagcgucuaagagaaugcaaacguuaauaguacaguguuguuuuugauccugccacuguaugguauugaauuuaccuggguuauggagucucauaauuguaccaaaagcuguggaaagagucagggagaguauuuuugcccccauuguggggaugaggaagcuagaggugaccugaauugcugagguucaugcaccuaguaaguaacagagcugcacuuggacccugagucuuagaaaaaaccccacacuaguucuuuugcugauuucugagcuaugcccauuucucucacuauggaauuguuuuccacuauaccucuaggaagcuaaacugggacauaacuggggcacaagaugggggauggagcuugccccucuucucagcagccagauaaggccuugggagcagugaagagcuuucuguaaccugaacugccugacauccuugcccuuagccacguggggcuguugaacacuugaccuggggcuguagcagcugagggacugcaauuuuugugugaauuaauuucaacagacuuaaauuuaaauagcccucccuauguagccaguggccaccccauuggacagcauaugucagcgcuguaaaagucaagugugagccacaaugggacauaggaaggacuuuucaggaaaccauuugacuguugggauucuccuuucaucuuuuagggguaugguggggaguaccugcugacggggauauuagaaugccuuucuuuuuuucuucccuugaugugccgagacuccaugcccccugucacggguaucccagagcuauggcuaguggguuugcuggcugagauggguccugagcccuaggccccuuugccccagaaaggaaaaucccgaggaggcagcugaugcuagcccuggaagacuuuaauucgaggguggcacaccugacaacgccuuggguaaugaguguuuguuucuggaggcucaugggacacccaccccagggcugauugcagguuggaugcuguuuggugagaauggaugcauacccacccgcugaugacaaagggacaggucagaaggacagggccuuucuuugaauggaaaaccugacccgggaucucuccuggaagaugaagaaugaacugggcagugaaguggggagaaggagagguuaacuucuggggggcuuagagaagaggggggaaggaggagaggagccugggauuagucccacgaaggcugcgcucuuguuugcccaagucuccuccugugugggacacaaagugggcuuguaauacaauacuggcucaaaggaagaaaaacggcagaggcuagcacuggggccacccugagcaagugguguguucaucugugcauguucuggacaguaccacgaggucaguaaaugcuucugccuggcaucuaccacaaagcucauuccagagggugcucuguggcccugccaagaauaaggccucgucaggaaaggcucacccuguauuuucccagccuacuuugagccaucuccugaauaaaggacagcuugccugggcaguaccgcuccugccacaaagacggaaaggaaaaguauggcaagugcuuuaagacuccuuuuaaugucagcuuucuacauccagauaaggagaagagcucacgaugguccuguaacuugccagacaucucacaggagauucauugcugagucucugagcacacacaggcucccuuuacagacuggaaaagucuuucuggucaguuugccuccacugacauuuauugagcgccuguaguaugugcuuggaugcugccuugagagggcgcuuuggguuugaaggcuccggaaacguaugacuuuggagcacucauuccuauucggugcugaccuuuguucacauuugugcucagccaacaauccuguguaggagaguggagccugacaaauguuuauggaaggucugccuggcugacuccauacacagauugcauaggguuuuccaaauggcagcuggggagaaguucuggaucugucagaacugauugggagaaccugcaaaacaggcagggguguauacgucccuuuuccaaagugacccuccugccuggcuuuugggaacaggaucuguccucgauggucccucacuaacugccuggcuuccuaacuguugcaggucuggggaugucuguuguuaagacaccaugcaucuggaugccuguugaguguagagugcuggcucagcuguaggguggggugggauggggggugguuugaaaccucuuucaaaaauaccauuagggagacaccaagacagcacugacguggaugcagaacguaagugcucuuggagaugaggucagcacaugaagcuucucugauuuuacaguugccaccagggacgcaggauuauguuccuguuaacugaagacacaaugagaggccuggcuuaggcaaaagcuggccaguaggguguaucagggaggcccuaaaaggguuaguacagugggugaauuguauccccuaaauagauauguucagguccuaaccccugugcccuugaacgugaccuuaguuggaaggaucuuugagggcguaauaaaguuauggugaggucaucuugggguauggugagcucuuaauccaaugaaggauguuuuucuaagagaaaggacacguggauacagacacacucugggaggaaggccaugugaugauggagguggagauuagagggauacagcaccaagucaagggaggccauggauuccuggcagccaccagaagccaggagaggcaaggaaggguuuccccucagaggcuucacagacagcacggcccugcuguccccuugauuuuggacuugcagccuccagaacagugagagaaaacauuucuguuguuucaagccaccuauuuugcgaccauuuguacccugagaaucuaauacagaagggaaucucauccuaucuugaggugauggcuuuccuagacuccauuuagagcaaggaauugcauguuuauaagcgaacuuugacacuugccucugcugauauggcugggaauccucucuuucauucuucauuauuaauggguauuuauuaugucauaggacuugucauuaaaucugcugaaaucugguaauccaagccuccaacccauaguuugcaucaaccagguggcgacccccaggcucugcugguuuccauuccuuuaucuugauuccauuccuuuaucuugauucucccuggccgagagcuuuucugacccaccuaaaaucuguucauuucagaccccggccuuuccaggaugccuuuuggagccccugcuggccaccacauaucauguucugaaguucuacagcccucugaguuggacacugaccaucugggggcucgagucauccucagauugguaugcagccauucaaacauuccuguuuguuuccugugagucagcauugugcugggcuuccaaggaaucugcaguccucuucacugccucuuccugaguacucacuguguuccaggcuucucucagcccuuccuggguacagugcuaggaaguaaagagucauauccacuccaguaaaugauugcugaguggaugaauauagcuauuuucaccaccaagauaaagaugggaaagugagacucagaaauaagaaacuugccuaaggucuacacaguuuaccagugcaagugcugggauugaacccuggccugucugacauagaggccacuauuggcccaggacaaaagcuugucugcagaggacagagcaggagcagcgcuguccauccagucugggcgauauucuuugcagugggcccaggggugauaggaacuuguugcauggaugaaguggaacuuuucuucccagaaaagaagacaagaagacagggcucugacacccauggucuccagcagcccuuuuugccuggagcaaguaugcccaaccccccuuuggcucuugaauaagaaggaaaggccuuaccauaugagcaggaauugugcauccaggcauguggcuuacucaccuuuccugcuaugccuaaccuucucuucuccuuucucugucuccucagacccucagggggcacacauuucagcauaagcuacagaguuuuguccgcauucacauuccucuccaucugccaugauuuguuuuuuuuuuuuuuuuuuuuuuuuuugagauagagucuuacucugucacccaggcuggagugcaguggcgcaaucucagcucacugcaagcucugccucccaggcucacgccauucaccugccucagccucccgaguagcugggacuacaggcgcccgccaccaugccuggcuaauuuuuuuuguauuuuuaauagagauaggguuucaccguguuagccaggauggucuugaucuucuggccucgugauccgcccgccucggccucccaaaaugcugggauuacaggcaugagcaaccacgcccagccgacuuguuuuuuuacuagccgucaaucuccaacccucugucacagccuaacaggugccagggggaagacuuaggacuggggucucaucguugguuaugggcacuuuaggguuaaauaaagcuauguaagacaccuccccaaaaaauaaaaacaaaaacuaaagaccaccaaagaaaguaggaaaccucaaaaaacugagaaucacuauuaccuuaaagcccaagugcucuaggaggaggcaaaagaaaaugaaaacagagcagguuaugacucagcuaacugaugucauggcuguuacaugucccaucucaugucaucuaaaucaggggccagcaaacugacaggcuaucaguuuuuguaaauaaaauuguauuggcacauagccaugucaauucuucuaugugcuaucagugcugcuuagguaccauuauaacagcagagucugguccugacagagacccuguggccugcaaaaagccuaaaauaguuucugucuaacccuuaaagaaaaagauugccagccccgguucuaaacugcacuucugauuucuaacuagucggagcuauuuuuuuauggagggcagacaguuucucauuugcucugcauagcaggccuuggcagccgagggccagggaggagcuugcccagaucaugcagccagucccuacacagcuggcauucaccuccaggucugccugacccugaagccugcacccugauccccugcuccucugccuccauccccugcugggccucugcaggagacgguccaggcccacacugcuuagagagguuuccaagaguacaugaucuguuagggauuguuugugacaguuagcuuucaggugagagcucuugagaagaccgccuauaucucuucccaugcaauagcuccagcccccugcccugcacuggcauagagcaggggcccaauaauauuuuuugauuaaaggaaggaaucaaugaagagggcagcccucaagccagggcacugcaguguagcauagagcagcccagccucuggaacccaugccaggccacgaguuccagucugcuaugaccuuggacaagguagacuaccucucugggccucgcuuuucucauccguaaaauggggauaaggacagcaucaaccccaaaugcccacugugagguuacaggagcuacugcagguugugugcauggaacauucuuagcauaucugucaccaccgggacagaaacgggcuguuauuaucgaggcuucaggcuguuuacugaggauucuuuagaaauggagaaaggaagaguagaaugcuggucuucggacaguccggccaagugagacugucaggcagaugacuguggugaagauggcccagcaagccccuccucuacucagaucgcccuuggaaaagccagucugagaauugcuguccuggucucuucacuggggcugggaaaggcaaggcaucuggccucagccucccuggacaccugcuccugaggagccugcagauuccucaggaacuacugcugcacuccaguguugggauggcagcagcaagaccuucaagcugcaugcuggggcgaaguucugccccaggggcuuguguucaccccaagacugucagugcgccacccauauuggucaggugcuucccaguggccuccguggggcaggccacuccagccggccagcuuucuugcuuugcagaaagucacugggcugagcagcaggcagggaguuggggagccccuugccauuuauuugcuggucacucacaggguguucgaugguuucaauuggagcuguugaacuguggccuaagucaauuaucacuggguugcuccugcuugaguuagaugugccccaacccaguggcacaguggaaucagcuuuaaaaauagcugugcguugggagaccgagguggucggaucacaaggucaggaguucaagaccagccugaccaacauggugcaacccugucucuacuaaaaauacaaaauauuagcugggugugguggcaggcaccuguaaucccagcuacucaagaggcuaaggcaggaggaucacuugaacccaggaggcagagguugcaguaagccgagaucccgcuauugcacucuacccugggcaacagugcaagacucugucucaaaaaaaauaauaauaaauaaauagaaauagcuuugccaggguuccgcucccagagaagcugaugacauaauugcucugggaaggacuggggcaucugugcuucuugaagcucccaggugauccuaaugucagccaaguuugagcuguauauuaaaaaaaauuuuugauuaaaacaaauuuuuagagagagagucucauucugucacacagguuggagugcagugauguaaucauagcucacuauaaccucgaacuacuggcuucaagcaauccucccgaguagcuaggacuacagguucaugccacaauguccaguuaaguuuuuauauauguauauauuuuuuguagagauggaguuuugcuauguugcccaggcuggucuugaacuccaagcaauccuccugccuugaccucccaaagugccaggauuacaggugugggccaccaugccuggcuguucagcugcauuuagucauuuaccugugugcccucccuugccaugugugcacaccugguaccugaagaccugggagacgaaucaaugacagggguacauaggaaauaagaauaauggagagagccaccaguuagugagccgcgacuacugccaggagcuacacuaaguacucaccaugcugcuaggaggaaaguucugaaauguccccauuuuauggaugugaauacugaggucauggggguaaaauaacaugcccaaaggcacagagcugguacuguuggagucagaacuagacuuagguccccugugauuccaaagugcuaccuuugccuuggccaccccugcuuggacuuucagugaggacaacuguguguugggauugugguccacacuggaaaucccaacuaggucccaccugauggaaaacuaaaguuccucauuacuucuagugccaguguagaagcugacccaaguugccuuuuugaaaaaaaaaaaaagaaggccaaacacgguggcucacaccuguaaucccagcacuuugggagucugagguggguggaucaacgaggucaggagaucgagaccauccuggcuaacauggugaaaccccaucucuacuaaaaauacaaaaaaauuagccgggcguggugguggaugccuguagucccagcuacucgggaggcugaggcaggagaauggcgugaacccgggaggaggagcuugcagugagccgagaucgcaccacugcacuccagccuggggacagagcgagacuccgucucagaaaaaaaaaaaaagaagacauaguuuaggaaauucaguauuuauuucuuggccucucagcagggcuuuauauuuucgaagggugggcacuuaaauuacacagauuggguuuuucuguuccucuuugaacacugggcugugugaggaggaggaggaagaagacugaaucuuacagagcugagaugaucagauacugccggaugugccauggggccuggagagcugacguugcuaauauaucaccccauuggugccuacaguuuccauucucugauuagagaucauauuucuuugacuugaugcucaaaugccucugaguuugauccuuucucauauccugaauucuauuuccaguuccccagaguuuuauccuaauuuuauccauuauugaaguuuucccaaaaaaagucagcaucaucaucaucaucaucaucauuauuauuaauuuuucuuuugagauggagucucacucucacccaggcuggagggcaguggcacaaucuugauucacugcaaccucuuucucucggguucaagcaauucaccugcuucagccaccugaguagcugggacuacaggugcgcacugcuacacggcucuaacuuuuguauuuuuuaguagagaugggguuuuaccguguuggccaggcuagucucaaauucaugaccucaaaugauccaccugccucggccucccaaagugcugggauuacaggugcgagccacugcacccagcccaucaucauuauugaugucauuuauuacacagcauuguauuuccaaagaauagauacgggugagaaaacaaaaucaguaacucuuccuugacuaaucagauuguuuucagauaucugauauguuuugucuuuacauuaauuaaugauuuuauauagucauagguguagggaauaguuuguagucacuuuuuuuuaauccuaaagcggaaacauuuuuauuauaauauauccuaaacauuugauguacccuaaauauuuuuucauuuuauuaaagcagcuuacaaaugaucauuuuuagagaguauauaaugcuucaucaaguggacaagucauauucuaaaucaguucucuguuguuaaaaauuaaagugccuaguaguuugccguuacacuucuaagggugccaugagcaucuucgugcauauaaccuuuuucuucuuggaaaaucuuuuggacagauucucagcaggauuauugagucaaagggcacaguuuuaugacucuugucccacauugccaaauuacuuucaaauaagguuguuuaugcugcuuccaucaacauguggacaugccaguuucaccacaaccucaucaacacuggguauuauuagcuuaaaaaaauuaucauucaauggaugcagaaugaucucuuguuagauuuauauauuuuuuuauccuuagugaggccaauuuucuuuuuugccucuguguguuuaccaacucucuuugggaaugcugacauuggcugcuccuccagccaaguucguuacuuuccauguggaugccuucaaguugagccaguugcaacgcagccuugacuuaaaaugagcgagcuucaacauugagccuuuguaugaaauucagcuuagcacacuggccccugaguuugaaggcugagauugcaacacccugcucuucacgucgugggguucugcaugaaaucacugaacuggccuuauggucuuuaugacuucaaacuuaacaguugucccccuagauuugucuuaugagcuaggcaggguuuuucuucagaaagcuuugagauacagcuccuucaacuauuuuucgguuuccuagcuugaaaaacgaagagaagaaaagucccuguguguucauguugucucuuuauuuguggggcuguuguguuucuagaugguuuuuucugguuuucucuugcugcuucacucaccacauccuguggagcuggaggcuucucuagcccuguuugucucugccugucugacauugagugccuggagcccucccuagcucuccagcuggaaccuuccucuguaggaaggcugaggcuagcagggagaagccaggauggauuuuaaagagccuuguugucucuaaggaagaguggagcuuacaucuuuggguuugcagaaaugcccacauucaacucagggggaauaaaaggaugggaguuagaauuucaacuugcaguugcagaaucucagaguuaaaagaaaccucagaggucaucucuuccaacccuucuccagagcagcuuuaauugccugugugggagauucagggccagcagcugcagcuucccuuucccugccucugacuugccaggugaguuuagaugaguuccuugcuuucuugaguguuuauuauuauuacuaauaaacaagaggaugaauauuugaaguucuucugcugucuuaaagcccucaaacuccacuggcuacugaaaucuuauaugcaagcuuuauaccuguaacuuguuaaaggagagcugcuuugauaaaaauaggguuauaguccuccugcugaaccucccaucuccaccuggcccccagaagucacucaggaggcucucuugacccccuagggauuuguggaguacaguuggaaaggguggcacugugaccuaugguuauaauaacaccggcaccuacuuauugaacauuaaccaggcaucaggggcuuggcacaggucauguucaguucugacagacacuuugggggcucuguauccuuauccccauaucauauaucaggucugagccucagggaggugcucguugcucugccacacagaggucacacaggaaggaagugguggagacucaguuccagcccagguagcucagcagcaaggccugucugcuucagcucugagcuuuacugccucuuugugacuugugaccuucaaccugacacacagcaucccagccuucccuggaguuugguuuuuugaguugucaucccaccugccaucucugacagccccaguauuuaguguuuuaggugcucccagauccacgauguguaguaauaggcuaaaggcaucaguguucucuagaauacuucguaccacuuagcaaauagccucugugacgccacugguuuugugauuuucccaagcaaacuuuacuaucccuuucuuauuguccucaucacuuacucuuguuugcacaaagcccaggcucuaauuuauuccccuuguccuuaauccucucaucucuuucuccagguaucacccucagaaauaaggaugugcaguaggucuggugggcaucugaaugaggauggcccccaggguguguacauuuccuggggggaaacugaagcuggagucugggcuucucaaguguggguucugccccugaagcuguuuucucacaauggaggcuccagguacuuccuaagcccccaucugcugcaggagauaccugaagaaacuguggacaguucaaagguuggauuauuuaagaaaucuuggcugggcauggugguucacaccuguaaucccagcacuuuugggaggcugaggugggcggaucacuugagaucaggaguucgagaccagccuggccaacauggugaaaccccaucucuacuaaaaauacaaaaaaguuagccuggcaugguggcacaugccuguaaccccagcuacucgggaggcugaggcuggagaauuucuuggacccaggagguggagguuucagugagccgagaucaugccuccacacuccagccucggcaacgaagccagacucugugucaaaaaaaagauaccuuguaucaguucugacacuugcauuacuagcugucacccaacaccuuaguuccauaagcuugaaggcuucuuaucacuauaggauuaagucuguaaaccgcaguuguaaguucggugccuucugucaacuguucaucuccccugguugcaggcauguucucacccacguccguggugauggguguuaggugacagcaugcuuccccaugcauugcugggcuauccuagugacaguguuauauuuaccccagcaucugaugagcagagcagagucagggcuuaugugcuaaugucuuguugcucuucucuucucuugcaugcuuacuuccacacugucacuucuuucaagcugcugaucacaaguuacgucuuacaggaaguucuccaugaguagcuuacuucucuuucucuuuuuuuuuaagagauagggucuugcucugucacccaggcuggagugcaguggugcaaucauaguuuacugcagccucaaauuccugggcucaagcaauccuucugccucagccucccugaguagcugggauuauagguguguaccaccauaccuggcuaauuuaaaaaaaaauuuuuuuuuguagagacaguaucucacuauguugcccaggcugaucucaaauuccuggcuucaagugguccuccugcuuuggccucccaaugcacauuccugagccaccacauccagccuuaguugucauguuuuuguuuauuauuauuauuuauuauuauuauuauuaaacggagucucgcucuguugcccaggcuggagugcagaggcggcacaauuucggcucacuacaacuucugccuccuggguuccagugauucuccugccucagccucuugaguagcugggauuacaggcacgugccaccacaccuggcuaauuuuuuugugguuuuaguagagaugagguuucaccauauuguccaggcuggucuagaacucgugaaaacaggugauuugcccuccuuagccucccaaagugcugggauuacaggugugaaucaccgcacccggaccauuauuauuauaauuuuuuuuggagacaagguuuugcuuuguugccuaggcuggaaugcaguggcagaaacauaacucaguguauucuugaacuccuagacuuaagcugccuugcuaauguauuuacgugugugucuguguuuguaggucucacuauguugcccaggcugaucucaaacuccuggccucaagugacccuuccgccuuggcgguugccauuuuuagcauuauuguuauuuggacauugugauuaauacuuuacacaaaugacacaauuuaaccuguaccaaauaaucaucuuucauuuauugucuaacaauaaacucaaccaaauguguaaguucaucuaucuauuuguccaucuggucaucaucuaaucacccaacagaaguuuuaccaaacuccuuuuuuauauuaggugcuaggugaacaaaguugaagaaaaugggucucuaacucaaugagcugggauucauccacgcauucaaacgaucacaaguguuugcacacugcucacuacccuugcuuguugaugccagccuugaguccaggcuuuccauccuugucagcaagguguucccacaaaguagcucccauuugcuaugauauguuugcccuucugguccuggaaccuucaucuuggugacacaaggccugagcaucugucauauaaaccuuugcgaugcaggcuguguucucuaggaaacagacgcuaagauguagauuagcaaguaggauguuuauuaugggauuccuuugggaucaacagcugugaaacugaaggagaagaaaccauaguugggcagagggagaaguggagcuguaacaaugucccaacaaaggccaaugccagaggagccugggagcuagacugauccuucagaauuguccugaauugaggugaggguugaucagucauuucaugugcccccgaccccaccacccaaaggaugccuaaucuugaacaaggugauuguauucggccaaggcaguucccagagagggcugauagcugauggucaucugccagcacuuuaguaacugcuuuagaagaagccuggauggagaaacaucugcuuuguuuuuuuguugugguggugguuuguuuucagugaaagggucuugcucugucacccagguuggaguguauuggcaugaucauagcccacuacagccuugaucuccugggcucaggcgauccuuccaccucagccucccaaguaguuagaccuacagguccauaccacagcauccggcuaauuuuuaaaauauuuuuguagagauggggucucacugugcuccccaggcuggucuugagcuccuggcauuaagcgaucuuccugccucgaccuccugaagcgcugggauuauaggugugaaccacugugccuggccaaauaucugcuuugcuuaccauuuuauccccaguaucuaguacauaaaagcacacaguauuggggggaauggaauuaccuaagcuuuacggaagcacugugaguaauucauuuagcaaauauguauaucuauuauguuccuaugacaugucagucacgauuacuacccuuacggagguuauagucuaggggguuugggcugagcgguggcucaacacugacuuccuggaagaggcaaccugcauacugggggcgugacuuccuggacgaugggcucugggccagcguugggcucaguguuuccuggguucccuagaagguggcuuauugagcuggagacuugaauggauaugggauguuuucucagggagggggcucucuguugcagcccaccucugggcgcaccuguccaccauaggaaauucccugcuucacuuaccuucauugacguuugaacucccaggagccuggaacuuccccaggugccccauuggcuuggugacuuuacaucauuacaucaguugaguaauugaagaauggaggaaccauucuuuugagcuaaguggaaaaauauauuuucuccucugugagucaccaaaaacuacagcuucuuuuuuuuuuuuuuuuuuuuguuugagacagagucucgcucuguugcccaggauauagugcaguggugcaaucuugguucacugcaauuuucacccccuggguucaagugauuccuugccucagccucuugaguaggugggauuacgggcauccaccacaacacccagcuaauuuuuguauuuuuaguagagaugggguuucaccauguuggccaggcuggucuugaacuucagaccucaagagauccacugccuuguccucucaaagugcugggauuauagacgugagcuaccgcgcccaggcuuagagcccagcuuauacccaguuacuuagcuucuguguguguguguguuuguaaaugaacuauuauauuucaggaaguuccuagcagggaggaugagauggaaucagugaauuuuagaucucaaggagaacuagagauugcuugguccaaccucuuuccucugcaagagggcccuuguggggaagggacuggccaaggcuacccaaagagcuuggagagaggugcagggcaugugaccaugugcaaagcauuugccaguagaguucggcauuuuuuccuggcgcguucaccuccugacagggcaccaggaaggugcugcacagccuggcauguggugggugguguuuaucugcacaagucacccaagugaucagaacgcuuuuacggaaaacaauggcuuugauguucugggugacaagaccaaagcaugcuggcgggaagggagguuuuugggguuagagaaaugaaaacuauuuacauuuagggcugacuuaauaacuuaacaccucugaagugggaggauguuuuugagggaaaguugaauguaaguguaguacaaaaaggaaaguuugagguagaagacuaggaguggaaauacuucuaauggcucagggaaaacguccugguaagguugaacuuccagaugccuccuuucuucccacacccccacugcauccucuguuucuacggugagauuugcauggcacuuuacaguuuccaaagcauuuccucacauauuaucuucuucaguccucccaggagguggugccaccaaaggcugucugaccacaccugcggcuuuuggagggagcuuggcuuggaacccaggguucucugagucaaaauccuuuuuuccugggacaguggugguccucacauucccuucaagacuauagacuuuagaagcccagucucuggcgcuagacuuccuuccuucaccuaccaggcuucucccucugcagaggucuugggcgccuuuugugaccauucugugacgugguuucuugaaauguaagauggggauaaugugagcaccuacccaccuucuuggguuguuguagggaugaaaacaucuucacaguuccuggcaccuauuggaguuggauaacgauguuaggauuacuugaggcuggcuuuccuaccuuguuuuaacagcagcucuagaguuucagaaacauaaggacuggacuuuuggugaucaaaucuaaacacucuccaguaaaaucagugaugcugcugacucugagucuuuaaucauucuagucucuucacccucugaaaacaagaggauguguagcauagugagcaacagcugugugccggggacucagcauuaaguagcaugggauuacucaugacuucgcacucauggcagccucacagguaacuuugucaauuucuuuuuuuccuuuuauauuaaaaaaacaaaauggcuggguucaguggcucaugccugugaucucagcacuuugggaggcaggggagggaggauggcuugagcucaagaguuccagaccagccugggcaacacagugagacucugccucuacaaaaauaauuaauuaauuaauuaauuaauuaauaaaauaaaugaaucaauuaaaagaauuaagaaaaacaaaacaaaacuuuuugaaucaguaaagcauuuacaagacacaaaauccaaaagguauacaaaguuuuccaaugaagacugccaacccucauguccccagaccccuguuucuccucccugggacacaguuguugcagguuucuugcuccuucuuccugaaagagucugugcauuauugaaaagaagauguguguccaugaguacaucuacagacgaguguugagcaccuguugugcacaguggugggggcagugugaugggaguacacagggcagggagacacgggucugggcuccccugaaguuugcagccguauuaagggcucggccuuacagugcguggggccucggcuucagaggaagggcugaucuuggggcuggcugcugcuugacuuggaguaccugccucccucuggccuccuguugaggcagccuggggucaaaucccagcucaccuaugugccaggcugcuggauggcucggauguggccuaauuauuuccugauggcccugccagccuggccaugggcuguaggaacaguaguagccauccauuuuucuuucuucuucuuggacggagguggugguucaaaugaaauuucagccuuacccuuuguaguuuucuacguaauaaauccuaacaucugugauuaaggugacauagguuuuuuugagaaaggcuuugauuucuugcuugcauggaugguuaauacuccaggcucuucagggugauucucgcccucuuguucuguagcuugugguccuuauuuauuuuaauauaauuuaaaacuugcagaaaaaaauuaugaacauaugaagaacuacugcacacccagaucaucaguuguuaacucacacuccaccccaccaccaaauacgcuauuuuuuccugauccauuugaguaaguuguagacaugcccuuucaucccuaaauauucagugugugcuccccaaggauaacgacauucuuuuacauaacgacuguauaauuaucaaacucaggaaauuuagcauugcugcaauuguauuauccaauccucaggccacacacaauuugaucaguagucccaauaaugucccuuuugacuauuuuuucccaauuauggaucauuauugcauuuaguggcugugucucauguuccccagucauacuugacuuugauuuuuuuuuuuuuuuuuuuugauauagagucucacucugugguccaggcugaaguacaguggcaugaucccaggucacugcaacccccaccucccggguucaagugauccuccugccucagccucccgaguagcugguauuacaggcgugugccacaaagccuggcuaaguuuuguauuuuuaguagagacgggguuucaccauguuggccagguuggucucgaacuccugaccucaagugauccacucacuuuggccuuucaacgugcugggauuacaggcgagagucaccgcacccggacgacucugacauuuuugaagaguccagguaaguuguuuuauagaaacacuccucaguuuggguugagacuguuauuuuugaaagcucauacugcaccacuugcuuuaauucuguaauccucaaugguccccuauggcugcugaucacguccgcgucucuguagauaagaaaacggagccaucgggaaguagagugguuugucaauagucacauucccagcaaguggcagagcuaggauucaaauccagacuaucuguccugaaaccuaauuugccuaccaggcaacaggaauaaggacaacaauuagacccugagaauaacaaaguguuuaucaagcacccacucugagccagagguuguguugagcacucugcagacacugcaguacaauacucccauccaucccaccccaguccaggagcagcuguuuuauguuguuguuguuuugagacagaguuuugcucugucgcccaggcuggagugcugugguacaaucucagcucacugcaaccucugccucccagguucaaacaauucuccugccucagccacccaagcaguugggauuacaggcauacgccaccaugcccagcuaauuuuuguauuuuuaguggagacaggggucucgccauguuggccaggcugguuucuuucuuuucuuuucuuucuuucuuucuuucuuucuuucuuucuuucuuucuuucuuucuuucuuucuuucuuucuuucuuucuuucuuucuuucucuuucucuuucuuucuuucuuuccccuuccuuccuuccuuccucccuccuuccuuccuuucuuucuuucucuuuccuuccuuccuuccuuccuuccuuccuuccuuccuuccuuuccuucuuuuuuuuuuugacagauucucacucugucgccgaggcuggaguguaguggcgugaucucggcucacuguaaccucugcugccuagcuucaagugauucuccugccucaacuccccgaguagcugggauuacaggugccugccacugccccuggcuaauuuuuguaguuuuagcagagacaggguuucaccaucuuggccaggcugguuuugaacuccugaccucaugauccuccccucucggccucccaaaguguugggauuacaggcgugagccaccgcgcccagccuuccaggcugguuucaaucuucuggccucaaacgaucuuccugccuaagccucccaaagagcugggauuacaggugugagccacugugcccggcugaguagcugcuuuuuuuuuuuuuuuaauccucgauuuacagaugaagaccagagaagcuaggcugacuucccauguugacacagcaacuaacugguggggaucagcucagagcugggcagacuaugcacuucccacccugcccugcaccccaugcucggcuugcuggauuugauagaaucuagcaagcgugggggccaggcucugcugacucccugugagaagcagugucuguuucuguguccuuuucuggggccuucuccagagggaaggaacauaucccaaagcuggagcuugcacucaggagcuucccaggggaaacugcuccacucucugccaucuacagcucuugcagguaccauagucuaccuccaugaucuauuugcagugggcgaugguguuuugaugauuuccacaucaugaacccaagugcuguugcugauuucgaagcuuguucacugucuccugccaaguggccaagggcuccuacccuagcccuugguggcugcuccuggcugccaucugcccacccaguuggccccacugccugggccacguucugguggcauccaagaacugguagcagagauggugauuagucaauguguguuauacccugggucucuccaucuuuccaacagagaccugccuuacauguaggacugccuccccuuguucagguuaccuagcccuugugcaauucaccuucugauuggagaaggaagacaauacggcccugccucucggccuguagagaggaauggaugaugugaaacuguggcaugcuugauauucugcuggcagagaggagaacagauguuaacacagagcacaccucugccccgaaccuccugggagccuuggagguccugagucagccuguccuuggcacucaggcucuucagacgucaaagcacagcguugggcccagcaugaccuucugcggucccaggagacaucagggaaguguugucaguguccuuagaaagcccauggcuugcucggccacaucaggugcagggaccucagucaaccacacagcagguagauauccuugagaacugugucaggugggaggauagccagagggucugggggcagccaccugacccuucagucccaggaucuagcaccucccaucagaccuuccucuucacucccuguuucucccaccaauuauuggcauuggcauauuucugagcaaguucucuccuuguggccugucacucugugggugggaagugacccccugcugagcagguucaguguuuugagguggggcuaugaccuucugcuuugcaccgggcucuaaacacccuggccugcccaggauucuuugcagcuccugggagaagcuuagaaauuuuaauuuccuuaauuuccauggaacauugcuuuguguguguggcuaaaaacauuaauuaaaaacauuaaucaguuuggcugccuuggaaagagguucuuuuuucugcaggagccaacgugcuggguuauugcaaccccaucuccccagccccuuacaaggaggaggggacaggacaucagcuugcaaaccaacacuucagcccuguauuuguggauuugucucuuggugucaggcagacuccuuagcuccucugaacuuuaguuuccacaucuguaaaaugggaagaaagguuaugugucuccugauuucuuggggacucuguguguguucagugaggugccaggaggacaguccuuagugaaauguccucuacagaauuugcuaguaaaggcgcuguuguuauaauuagcuggauuucccugguaguuuacagacugccucuucugcgcacugucucauuuaauccugucagcgcaccuggcagacggguaguguuugaauccacucuuuuucacagaugaguacacuggaaagggaggguuacagccaggccuggagcugagaaccuuugauggaagccccaggcuuuggcccaaucucauugccuucauuugcucccuuggccccaugugcugagucccuacacuaaguuacaguggugagauagaaagaggggaggccuuuucauuuccuccugggaggagaggaagaaguuaagucucuagcauuugccuaaguagugcuaauaaaagcugacauuucuaugggcuuauaauauccagagacaagugcuaaacucugcaaagauucucacuuaacaccaggaacaagccucuaagaugagaaacugaggcucagagagcucaaguuugaguacuuguucaggguccuaaaaagccucuuuaaguaguagaacugggacaccaacccaggaagccugagaagagcccaccgucaaccaagaggcugugccucugcccuuuuuggguaacgaagcaaauucauuuugacaauaaggcuaaaagugcuuuccuggucacaaugccugaggcgugugggaggcugcucacuggggagcccagaggcgcugaggacagcaucuuucugcgugccuagcuagucaaggggacuuuucagaguaagggggaauucacucugugcugcugggaacuggacucugagugcaggaugcguuaagccugcacugaaugggaggaggcgaggacucugaggcuugcagaaccacugcagaucuguccgugauaccaacacaucuaaggaaggaauaugacaaccagagugccucagagaagacaauuauggccaaguuguuccuuggggagagaugaggaaaucaaaguggggaauacaagccaccugcccgccguucuugccuguggggcaaggauguuucaccagcuauuccagaguugagagcaaauuccccuucagaacuuuucagcguucuuuauucugaguuugugcugacuaagcuucaugucauucaugauuuggcugccagugaggauggugggggggccugaaaagggaaaagggcaccguacuguaaauguaugaaugggguuuucugugggggccacaccggagcaucacaguucuuugaaggacaggagagaaggucagugccuggauccccaggcuaaguaccaggcgcugcuuuaggauagccuagaaggguggccccugggccucauucuccacacugucccaccccuuuugaccaccucaucuagccaucuugaugaucaguuaagauaagaaucucuagugaggcuacauuuuuuuguuuccugaauaaugcaugauguccacugaacacauguuacuagaugacaguguugggcucagauaaaacuuacaacaaaauuaaucugaugcagccuccauggcucacaugauccccaccauguaugaaaugggcugggcacccagggacaggcuauucucagaaugggguuauuggguguguuucuuauuccucucuaccuaguauucuuggaagaaggugaaugaaaaugcucuaguaggggagggaaacaugauuaaugggugggggcuuaugagucagaaagacccaaccaucacuucugcccugacugccugugugacuucagaaaugggggauaucaaagccuaucucauaggauuaaacaguuuaauguguauaaaaugccuaacacagugcuugccacauaagcauugcucauuaaaugucuucucuucuugugcuccucauucaguguauaguaaaugugcaguccuuaucuuuuaaaugaaugaaacaucucauuaccaaaucuauucaagguaaacauugauauuaauauguauccuuuuuguguguuucuagaauccuguuacaccugggauuuaggcacuuucaaucugaaaaaauacauauccuuucagcacucuggacggacuugagaacuguccuuacgugaccuaaagcuggaguauuuugagauuggagaauuaagguaagcgacuuuaucuuccugauccuugugaaaccaaaaauagcuuuuggaguugacgaccuccugcagcacagcuuggguugugguucuugaccucucggugugucuuccugugccgcuccaauguguucgggaagcuggcuccccauaaccucuccccgaccugguucucagagucuaguccacuuauucauugugccuaggaagcucucccucugucccuaguggagggaggagcccaccaucuccuagugaaugcgccacuuguagcagaaggugcaggaugcuccagcugucuugugaaaacauguggagacagccuuggggaaaagaggaaaaggugaggugaggguuauauaaucagauugaaacaccuuugggacauccagaacaugagcucuuccuccuuucccagccaauccgugcuuccuccuuucaccuccuugaauucuaugcuccuuccacacuaaggcugagggugcaggagguaaaggguuagagguuaagacugagugcuucagguagacuuggguuuucuugguuuugcuacuugccucauuuuggacaagucacucagccucucaaagccuuggucuccucauuaguaaaauagggaugguauuagugccugccucaugaagauguuguuuguguugagugagauauuggagcaaaacagcuuagcaggcugccuugcacugaggaagaaaugcuccaaaagggaagagaguuuuugcaaauuauuccucaauuaugccauuuagaauuccuuccauguaucaggcuauuuugaagucuuucauuugcuguccccccagccuuucaccuaucaccaagucagccugggaaacagcugagaaucaccuucccaguugugcccagccccuuacccaaagcagaguugauuccccccuccccuggacggcagcgggcuagugaaggcaugucuccacuauaccauggcuacugcacuggguugaaaugucccuugccccuuccccugcccauucccccuauugcuggugaaauugcuuagagcaaggacugucuuacacaucacaggaucuggcauagugccugaccgagggugaaacaacaaaugaaugaguaauugaaaggagagagaaaaagagauagagaaguaaccaaaagaagaaaguuuuuaaagguucagaggaaagaaugaggucaguugcaauuuuuuuuaaguaagauguuggaaagaauaaaugacaugaugaaaaggaaacugacaugauuccuaucaugaauuugaaagcuaugcaaggguggaaaggugggugagaagcuguggacuggugagaagacagagaagucagaacugagagcauagcagagaacuguacuucuguugugcuacauaugucaucuucaucuuuuguauugugccuuaaauuuucaaaagcgcauuugcguuucaaaucugcugugauagucagcauuccuguggcaugcagaggugaagagcaugaggccuugcccuucagucaagguggggauacuggcacacauaggauacuacauacucccuaggugucugugaggaugguggaggggauuuucuccaugccgggaggcuuccuggagcaggugcugccucucgugacucuugaaagaugcuugugaauaaagcauacugggagcugagcugcuguuuaguaauuaaaaauccuuuccauuguuuagagcucagcaccuuugugcauucauauuacgcauucauuuucguaucauuguugaauuucucacuucugcuacugcaauguaugucuacagcugacaagucuuccuugggagcccuacguagcucuuuuuuuucuuuucuuucuuuuuuuuuuuuuuuuuuuugagacggaaucuugcucugucacccaggcuggagugcaguggcgcaaucucggcucacuguaagcuccaccucccggguucacgccauucuccugccucagccucuugaguagcugggacuacaggugcccaccaccacgccuggcuacuuuuuuuuguauuuuuauuagagacgggguuucacuguguuagccaggauagucuugaucuccugaccuugugaucugcccgccuuggccucguagcucuuuuugacccucagggacagucacugaauuaugucuugggagcccaugcuucugaggcaggcuuagggagcaggagagcauacagguguagcagccuuuccagcugauccccaugcccugcugcaccuggagggcuggaacaagcuauucucauauuggggaaaagggcugaugggaccucagucauguggcagagaaucugaaagccagaagcuuggcaggucugucucgggguggggugacggagagacauuucccuagaauucagcugcugggagcagaaagacagagcaggggcaagugcuggguuucugaggcccgcaguccugagcauggccucaggcagucuguucuaugacagaaccugaagaaaggcccaggcauuugcaucuaugugugcaguucuacuuguccuaaaggcacuucucacacugggagccugccugucuguaccugucuagaaaucagccuggcugggacgcacaccaauaggagggcauccucaccuuucccacccaugagucgggacuguugccugcugugcagcaaaggcaccaggaacacggagucagacacuuagggucuaccccaggcuccacuucccacugccuauuugacucugggcaagucuuuuacagcuuuucaaacuucucucuuucuuaaaacaaaaaaaaaaaaaaaggaaaaaaauuucuugccaggcacaguggcucacgccuguaauuccagcauuuugggaggcugaggugggcuaaucacuugaggccaggaguucgagaccagccuggccaacauggugaaacccugucucuauuaaaaauacaaagauuagccaggcaugguggcacacgccuguaauccuagcuacuugggaggcuuaggcacaagagucacuugaaacugggaggcagaguuguaguuagccaagauugugccacugcacuccagccugggcaacagagcaagacucugucucaaaacacacguacaaauuuuuuucuuuuauuuuuuuaaagacagggucuuagcuauguggcccaggcuggccuccaaucccugggcuuaagcaauccucccaccucagucuccugaguagcuaguacuauaggcacacaccacacacccagccagacuucaauuuucccagccacaucauggaccagaagccacuuggucugguugugaggaugacggaaccuugcccgaggaaaugggcaaugaacaggagccuguuuguuucuccuuccagcuccugaccugucuagcuccugacccucucagugucauucuugcucaccccuggcccugcucccuggauaugcagacaggaugggcuucuucccuuuagaccuucacuuugcucuuuuggacuccucuucuggccuugccuuccccuggugucaucugcuggcucccugccugauacugccacacuggucaugcuggccuccuggccuuuggugacaccgcaucagcaggcuccugcuucccugucaagggauacaagccagcaccggucuuucgccacaagguauguguguaaagauugcuuccuguacuugguguccacaggauuuuaaagaacuccuggcccacucggaacucuacgcuugaaacagaaacaucuucucaaaacaccucugguauuggcccauuucucuauuacuguuucuugugguuucauacugagguuuuuggugcauugcaauugcccuggaguuuauuuuuaguaauaaagacagaguucaauuaaugucaaaacaugaggguaauugcagaggaaggauuaguaagucuaggggaaaaugugcccaacuuuuuuucuucugauaacaucuuucacugaucauacaccgucacacccacagacacggagcuuccuccgugaugucugcaaugcacuaggcccagucggggagcaguggcugcgccaccaccugaaaacgaaagcauuucugagucucuuucaguccagcucaucuagcagccagccacacaggugaccacccaccguagcugucacuaugggugaugauuaucauuaugguuuugaggaaaggcugggcuuuagaauagucaauucuuauccucucuccggggggauuuauucugucuccagaagcagcauuucacuuuccugaacaucagcucuucuccccuggauugcagggucuaggucuuguucucugucugcuuccagcuuuuggcauuuugacagcacauaggacaugcuuggagaacguuuucuugaguuaacugaauucaggacacugacuuggggcuggaaaggcaaagugaggaagaaaguauuccccuuucagaagcuccccagucugccuuaagaaacaaaggcagcccugucaucugcccaggacuuuacaguuuauaaagugauuucucauccuuucuccuuucuuguauugcacaaauaucgaacgagaaccugcagugugccacugugcagggugccuagaauaaaggagaaaagccacugugcuuucucugaaggaaucacagggagugaagcuagcuucauggaugccagaauuucacagaugaagggacuggaggcuuggagcaauugcauugcuugagauccccccugcucauggaugguggcucccaaaucaggacaugagucuucugaaucccuuaaaccugcccugugccugccuguucucccagcacauucucuguacucucuugugcugcuccucacccccucuccaacugucucuccuucuccaccauuguccucugcccacuccuagucccuucuuucagcucuguuucuucugaaaaugaggaucuuucucucuacagugccucuugugggacggguucugcugaugggggcuguguuugggaucucgccuggaaacacgaucucuccaacuuucccugggagcagagccuugggucucacugaacccaccuccccagcaccuuguguggugacuggcaggagguagccauucccuccuguccucucugcccuuguccacuuuccuguuaugagucaguugcugagauaggcuaugaggaguuaacagaguggauaaaaaagagcuuuguccuucuuuaaagccuucaaaauauacagauguauuagucagggcuuuccagagaaacaggaccaauagaacaugaagauagaugcguauccaugucuauaucaauaucuaccuugauauuuauaucuauaucuaggagauuuauuuauuauaagguauuggcucaugcaauuauggacccagagggguccugugauuugccaccugcaggcuggagaccuaggaaacagcugucgugucacaaagggcagagggcuggagaaccuguaguguagauuccaguccagauucgaaggccugaggaccaggaaugccaagggcaggagaagaucgaugucccagaacaagcaaucaggcagagaugaaauucaaccuuccugugccuuucuguucuauucaggccuucaguggguugaaugaggcccaacccacauugaagaggaccaucugcuuuacucagucuccugguugaagugauaaucucaucuggacauacucagaaaugcuguuuaaccagcucucuggaaauccuguggcccagucaaguugacacacaaaauuaaccaucacacugcagagacacagucuaucccaauaccuguauuuacuggguaacgugcaucucagcucaccaggcugguuugauugacuuggcccaaagcugcccuuugaguguugagccccagcugaccccuuugauccuucacagccccaucauuaaaacaaggacccugaaucaagugacuguaagagccacucuuguccuguucugucuguauccuggcuuugaguguuuaucuaagcuaagcccaauugacuguugucauucuuugucucuuccuugcucagacaucaguuagguauuuauugaacacuccuguguucacagcauccggcuccugggauuagagacagcucuugacuccugguuuugcucuuugaaaccuauuggacugcuuuucuuuuaagauacaccccccacauuauaggaaucuauccauuucuuuguucauuucuuuaauugugcauuauaucaguccgucagucaguuuuccuccugaaauaugcuaaguauugagaauuauaauagauucuauuaagcaccgcuaauaaaguacuauccuuauaguaguaguaguguuugcggugauggucguguuaguacuaguaguaaucaagauggccaugaagagacugcuuuuaaucuaccaguaaucaugguaaaaauaguaauagcucaaauguauuauucaugguguuucaagcacuuuacauuauaugaugucauuuacucuucacaaccugccaggaaauggaaaugauuacguaauauacuccaguuugcaaaugaaggaaucuuccugcggaacguaugugaagcgcauauuggugcucugggcuuuugcauaauuucaaauguccuuuuuuuuuuuaaacuuaaggcuaauguuuagaagcuuuugcuaaugagaggaccauuugcuaaaucgguauaagugcuacacauuuggguaucuccaucccaacauaccucuuauugccauuccccaaagcagacaccuucuccucccucccucaaggaccucugagcuugcacuccaauuccucucccacacucaccuuucuccuuucuguuccucuugggauccagguuuauuugaggagauaggaaaagcuccugauccagcagguuuuauucuuaaauuuguaacaaaguaaaucacagaaccuccacccagcauccaggccucugguucucucccuccuucccagguauaggccggcuuucagaaacccugcaccacauagacccugggccugaauugcugugaguaauaaugacucugcugguaauuuguguccuucugcuuggaacuguuuccuuuuuaguuuggucacccucccagagcugguuucaaugggggcauacccauuaugggaugcagggcauccugcauccugaggaauuuuuuuuccuccaaaaaugaaaccuugaaaugaggacauuguccuguccacggacugcacaacaacacugagccucaaggacucauacuggcauuuuucuucuuuugcagagugugggcacccuggcuucaagcucacgagaaaccaggucgggauuuaaacaauguuggguuaaagcaaaguuucauaaagacagaaucaagaaaaaaagaaagagaaaccaaucuaagugccauccucccugaguugcaucuuaccugagucuucagccgccgcccccugcugcugugggaggaaacgggaaagugacuggccauggggacaggggucgggggugugaggguuagugguagcagggagguagcacuucugugaagccggaaaggagaccugaaccuggcucucugcuuugcugcuugccagcccucuggcugggaagaaggcucuuggcucuugugagccucgguuuccucugcagaguggccuguucugaggacaggcugacauugcuguccaucagucuuccaggacccugaggauuucagcucuacccaugggcacugaacuggaacauucacuggucauuugcuuucguuuuuuuuuuuuguuuguuuguuuuuugauacagaguuucacucuuguugccuaggguggaguacaauggcgugaucucagcucaccacaagcucugccucccggggucaagcgauucuccccaguagcugagauuacaggcaugcgccaccacguccggcuaauuuuguauuuuuaguagugaugggguuucuccguguuggucaggcuggucucgaacuccugaccucaggugauccgucugccucagccucccaaagugcugggauuacaggagugagccaccgagccuggccgcuuccggucuuuggauuugauuuuccucaaguguaauugaaagcaggggccuggauggccgccauagucccucccagcuucgacauuacacauuccugccaauccauuuuucaggcugauaacauuguucagaguuuaaugggagcaggguaagauagucaccguguggagcaaaaauugaaggaaauauuccagaugucaugauuuuuuaccuguagccccucugcugccacacccuugugcacauccuccagacacuuuuaaagaauaaacucuauuuucagaagaguuuuagauuuacaggagaauugugaaaacaguucaaaaaguucucauauacccugcucccaguuuucccuguuacuaacgcuuugcauuaguguggcacauuugccacaauuaauggaccaauauugauacauuauuauuuacugaaguugaaacauuacuuuaguuuuuaccugguccaggaucccaucugggaucccacaucacauuuagugaucaugucuucuuagauugcccugggcugugccgcuuucucagacucuccugguuugugaugacauugacagucuugaguuuugaugaccaguuuugacuggucagguauuucauagaacguaccucugugaggguugucugauucuucuucuuauuagauugggauuauggaggaaggccacagagguaaaguuccgcuuuuaugaaaucaaggguaggcaccaucagcaugaccuaucacugauguugacuuugauuaccuggcugcuguagugguugucagguuuguccacuuuaaagauacuuuuguguuuuuguucuuucuuaacucccuuuuuauauuaaacucuucagaaggaagucacugugcauagccauccccuaagaagagggcauuccugcucuuccuucuccauggcuagaggaucuacaugaacuauuuagauuuuuucuaccugggagauuuaacuccucucuccuauuuauuuauuuauauaucagcauggacuugcagguauuuauuugauaauuuuuaauuuauuugaguuauaauccaauaauaugguuuuauuuuguugcucaugguuuuucuuccuuggcuauugggaacucuucaguuacuuccugugcccauuugacauacuuucuuauuaugggucuuucuuucuuccuuuucuuuccuucuuucuuucucucucucucucucucucucuuccuuccuucccuuccucccucccucuuuucuuuucuuuuuucuuuucuuuccuuccuuccucccucccucacucccuccuuccuuccuuuuucuuccuuuuuuccuuccuuccuucccucccuuccucuuuucuuucuucuuucuuucuuucuuuccuuccuuucuccuuccuuccuuccuuuucuuccuuucuuuuccuaccuuccuuuuccuuccuuccuuucuuccuuccuuuccuccuuccucuucuccuccuccccuuccuuccuuccuuccuuccuuccuucccucccucccucucucucucucucucucuuuuuuuggugcauccauacuuucuggcacuauaagaugcuuagggcuuaucuuguauauuuccagccccaguuauagaaucagccauuucuucaaggauccccugucauuuuacuggagaaaggacuuagaauccaagaucugggugcuagaugugcuugagguguuguuuccuccagaucuucucaacugacagagcagugaaauauauguguguagggaggauggggagaacaauuuuuuuaacacauaugaauacuuaccuggcaggggagauaccaugaucacaaaggugguuuccccagggugaggcuuauccauugcacucccgaugugcugaccccugugauucccccaaaugugggagacuugacugcauaauuugugguaaugggggacugcauuuacacuuuucccuguaaaaauuuuuaaaaauaaauaaauacauaaauaaauaaauguguguauaugaauccaugugcaugcacguauguguaaauauuucuccagguauccaucuuaucuauguuaagcuaacuaugaguuuauacugcugucuccaacucuaauucauuaccacauuucacccauuuuuuuuuuuuuugaaauggauucucacacuuucgcccaagcuggagugcaguggugugaucucgucucacugcaaccucgcucucccagguucaagcgauccuccugcgucagccucccgaguagcugggauuacaggugcacaccaccacaccuggcuaauuuuuguauuuuuaguagaaacgggguuucaccauguuggccaggcuggucucgaccuccugaccucaggugauccacccacuucagccucccgaagugcugggguuacaggcgugagucaccacgcccggcccccauccacuuuuaacaaacuuguuuucuuuuugcccacauugacugacaaaagaagguaaugaacagagauguuggaaaguucacguggggcaagaggagugggcugagaacauuggacuuuucccuauggucaauguggccucauucaacaaaaaucaagaugagucagaugcauguagaaagagacuccgaaauguguccugccuagauguuugcaaaccgggacucuguguuaugcucacaggccuuugaaugugucucucccugggcuucaugugcccuugcugguuucuggacuguccuguucugcuccuguccuccuacugacagccuuuccugcuuuccuuucccucccaugccacucccacuccauacaaccucuuccccugcacacugcuccuagaaccccuugguuagccccaucagggaugucccugcuuuccugggacccgaggcacacagaaugaggaugaaacaguugacguaucauguaguaucccccaccuggcuuccuucucagccaggcgucccaaacucaauugucugcagaggccaggcaggcaacaaaaauaagugaugugggccuccugggcagucaggagggcuuggugcagaacuggaagcaccagagguagcaaggaaccaggagaucaggccagcaccugcucugaauggucaggcaccuccaugguugcauagcaaaucaguuguugagaaauguuuugacuaugguccuuguguaggcccaguauaaagggggaaauggccagucuguggcugcugauuauggcccugaaagucugcaggcccagaauggccagaccugguuguucaaaggaaaacuggcaggugggaagggcggagggccuugccccuucccauuugccuccugugccugacagugucaccguagcaauacuuuccuggcagcaggacuuugucccauaacaauaguugauuuuaguguguagggcuuuuguuguuguuguuuauuccauacuuggaaccagcugcguugugcuacuaucagagaugacagcccagccuggagcucugcaagguccuccaggcuucucaguucugaucauuccaccagcagaucccaucaccaaagggguguacuugcuucaugcagcugcugcuucucccagaccucauugucccccuugugccuuuuccauguucaauacaggauuuguuuuuuaucugaaauucuacccguuaaaacauuugguauguuuccucuucucuugugagguguauuucuguauuuccuaccuuugcauccuuugcucaguucaacuugaagcagguuuccaagcucaucacuuggaggcccagggcauugccacugccccccaccccaccgccuaccgcccaccugcaggucugugccaggaagcccugcgugcugucugcaccccguuuggcugcuugcccacaaccaugacugcuccugaggggcucgccagcagcacuguuucccagccugcugugcauaaaggugacgcuucggguuuuccacagugaacaaugguucccagagugggcaggacucccuagugucugcaagggugugugaccaugcaggguggaaacaaccuugucaaaauaaaccagggcagugcugaggggggaagugaggcuagcuggggggaaaugugggcugagugcuucuugggggguuuccucuguaccggugcccagcugcccaagggucccagaaggcagaggcugacacacuuccugugacccuuucagacucgccauuggcccccaccagaucaggaaucuguuuucccuuguugaccuugagccacucacagagugggaaagguuugccuauggaacgaaaacaguccuccuuccaugauuuccccuuugcucccauguucauccaugugggcugcuguaacaaaaucccauaaacugggugguuuacaaacaacaaaaauuuauuucucauaguucucaaagcuaaaaguccaagaucaaugcgcugggagauuuggugucuggugagaaccugcuucuugguucagugucuucuuaccgcguccucacauggaggaaggggcgagaaagcuuucuggagccucuuuugucaaggcacuaaucccauucaugaggacucaacacucgugacuggaucgccucccaaagccccuaccuccaaaucccaucaccuugaggguuaggauuucaacuaugaacuuuggggagacaccgacauucagacuguagcagcuccccagcacaauccugcucgaccgaauucaccuuccugaccaggcacgucaacaaucuuucugucccucugaugccagaacguuauguuucugagggugaaacuugagugauuaauugacaguauuccucaggaauccuugcugauugcugaaugcauaaaugagugaaagaccuggauaauccccaacaggcgccugagucucacauccgcccugggugauuccccauggccaggggcccaccucgguucccagggauccaugggcaugaucauugugaugagccacuacucuccaaucuggccucugcaccugugugacauuuuccucccauugcuuuacauguuacucuuucuuauucaguaggaugugcagauuggucaggguguguauuaguuuccuagagcugcuauaacaaaguaccacaaacuagguugcccaaaacaacagaaauguauucucucauaguuguggaagccagaagucugaaaucaaagaguugugagggcuguguucucccugcagaugcccagaaaaauccucccuuucucucucccggccucugcuggaggcuggccauccuuggcgcucuuuggcuugucauugcaucauccaagucucugccuccauccuccuguguccucuccuguguguuuguguccaaauuucccuuuucuuagaauugcaucuucucuaaaccagcaugaccucaucauaacuugauuacaucugcaaagacccaauuuccaaauaaggcacauucacagguucugggaguuaggacuucaacauaacacuucuggggacacaguuaaacccacaacagaguauaaggagaaaauguuacaacuuccuuucucuucuuuuuuuuccuuuucuuuucuuuuuuucucuucuuucuuuuuccuuccucccucccugucucccucccucucugccucccucccucccucccucuuccuuccuuccuuccuuccuuccucccuucuuuuuucuuucuuuuuuugacggaguccugcucuuugcccaggcuggagugcaguggugcaaucucggcuugcugcaaccuccaucucccaggcagguucaaguaauucuccugccuaagccucccgaguagcugggacuacaggcaccuaccaccacaccuuuuuuuuuuuuaguagagacaggauuucacuguguuagacaauccugccucccucccucccucccuuucuuccuuccuuccuucuuuccuuccuuccuucuuucccuccuuccuuccucucuucuccucuccucucuuacccuccccuccccuucugucuccucugcuccccugcccucccuucuccuccuucuccuucuccuuuuucuucuucucuuuguuguccaggcuggaguacaguggaaggaucauggcccacuguagccuagacaucccaggcugaaaugauccucucuccucagccucccaaguaccugggacuacagguauguguucccaugccugacuaguuuuuguauuuuuuguagagacaggauuucaucauguugcccaggcuggucuugaagauaucugcuugccucugccucccaaaguacugggauuacgggugugcgccauugcgccuggccuguugauuucuuuuuuauaaaaugucuuuguuuucaucccuguuauuauaauaauaauauaggcauucauaugcauauguguaaauuauaagugaguucuuauauagauuugggggacuauucuccaacaugacugaugagggcauagucaaaagacaaauuaaucaggccaccagucugauuuaugaagcgucucugucuuugucuauuugggcugcuauaacaaaauaucauagaauaaagggcuuaguuuauuuucuuacugugcuagaggcugggaaguccaaggucaaggugugaacugauucaguuucuggugggggcucuccucuuggcuugcagaugguugccuucuucuguguccuuacaugguuguaggagcagagaggguucucugguguuucuucuuauaaggacacauauccuuucagauuaggacuucacccuuaggaccucguuuaaccuuaccaaccuccauaagguuucuaucuccaauaaagucaccuuagggguugggacuucaacauaugaaugcagaauggaugcuggcaccuuucaguccacagcaggccgcaacuacuguauuucauuguacaauaagauccccuugacucuugugaauuauaaugaacauuagucuguaaagcagguccuuguaauccagccaguuuguauacaguagguaaucaagaacuauggauuuacuggguuuauugggugggggagaagggagggcuuuauucaggugccagcacuucuucaccuuucucuacauuugcucauccuggaggugggguugagcugggucugccuuguccccucacuucccucucugccgagagaguccugagcccacccauuacugguagcaaagcccggggcacaaucuccguuuuccuauuuguaaaauggagcuaacaguaguacccaucucaucagauggcuguagagaugaaaugagauaauguauuuguggcguuaggacaacagugguccugcuacagggagaagccugggccaggagauagacuagucuccagauaccacugaaguagccuuucgaauaccaauuaccugccucacuuugcagcugugcagcccugaacaaguuacuuucccucucugauuuuccagucuuuguuaccuguaaauguaacaaugccuuucucuauguuguugcgaaguccacauaaagugacaugaaauugauuauaaaauacaacacaggcugggcacaguggcucacgccuguaaucccagcacuuugggagguggaggagggcagaucacuugagguugggaguucaagaccaaccugacuaacauggagaaaccccgucucuacuaaaaauacaaaauuagccaggcaugguggcacaugacuguaaucccagcuacucgggaggcugaggcaggagaaucgcuugaaccugggagguggagguugcagugagcggagaucacaccauugcacuccagccugggcaacaagaacaaaacuccaucucaaaaaaaaaaaaaguuacaacacaaagguuggcaacuaucacuaauaaguuugacugggaaaccucacuacuacauuuguauugucuuagaccaagcuugugagauuuuuuuguuauuuguuuuugaagcucaucagcuaucguuaguguuaguguauuuuauguguggcccaagacaauucuucuucuuccaauguggcccagggaagccaaaagauuggacaccccugucuuagacuuuuaaggagcugugacugaaggauggagacugggccagguggggcuuggugcaaguuuaagcucuuaggucauuucuaaauagcaaaccucucaaauagcauccaacagauaugcccuagucuugucgucuuuccccugcuaucuuuuguacauguaccuucugcugacugcaguguguccuggagcccugacuuaguuaaaccucagaacaucccucugcauccggaugcauccaguacucucgguuugucuggcuccugcuguacucccugcaucugcccagcugcugacacagccacauauggcuuccuuugccccagcuuucagcauucugguggcuuguagugcugagugcuagcaaagaaaguggguacucucacacacugcugcugaaagguggagggugaugaacaggaccaacagcucuaaaagacguuucaaggccaggugugguggcucacacccgcaaugccagcacuuugggaggccaaggcaggcagauuacuugaggucaggaguucgaggccaagcagccaacaaggugaaaccccaucucuaccaaaaauacaaaaauuagccagaugugguagugcgcgccuguagucccagcuacucagggggcugaauaaggagaaucacuugaaccugggaggcagagguugcagugagcugagauugcgccacugcacuccagccucagugacagagugagaccuugucucaaauaauaauaauaauaauaauaauaauaauaauaauaauaauaauaaaaagauaagggaaauuugggcaggacuucuccaaguuuagaguauaugcacccuuuggcccagcaaucccacuucucggagucuguacccuagaaauagugagggaaguuucaaaagauauuuauucaacagcauuaguaauguaucagaaccuugaagacagccuagcuggucaacaguacaaugcucaguugccacuauaaagaaugagaugcuguguccuucucagugccucagaucaggaggcaccugguguuggcuugucacauuacuaaugauguuuacuuccaucacuugauuaaggugaugucugccagauuucucuacuguaaaguuucuauuuuuuuuucuguguaaugaauaaguaucuugucaggagaugcuuuggaccuauguaaguaucuuguuucucaucacacuuucaccaaacuaauuuuagcauucguggauaauucuugucugaaacaguuauuacuacagugugugccaaacagugauuuucuacuuccaucauuacuccuacauuugucaauuaaaauguuacuauaaggaagauauuuucuuuuauauugaaaaaaugcaauuuuuuaaaaaucagucuggacucuuggauucucauuauauugguuauaacccaugacuauaauacauuuugugcucagauuuuucuagauuuuacauugggaugcccuucaaguuggguucuauguauuuuugccauuuuacuguuguuuuuugagcacugccuuaccuuuugaccccacaagauauucuaggcucaguguacacuuugccugguccagcccuggaaucagccauugcugcugugcuauccuugacagaacuauaaccugaauuuaacaaggaggaaauaucaggcaaacacaaauggagugacauucuaguuaacaacugaucagcacucuuuaaaaaugaaagacaaagaaugacugaggaaugaguucagauuaaaagagacgaagggacacgcuccaacuguaacugcaacgcaugacugcgggcugcguucugcauuggaaaaaaguguuacugaugaaauuugaauaucgucucuagauugagcaacuaagcaauaauauuguauuaaauugcuagauugggcaauaguauuguacuaaaguuaauuuccugacacaguuaaauaauuguacuguguauauaagaugucaaaauugagaaguugcaaggcuaaauggaauuucucaguuuuuuaaacucuuacuuuguacaucugaaauuauuuuaaaauaaaaacuaaaaaaaaaaaaccuaaauacaaaccaugagauagauuuauauguacuaauaugggaugguguccacaaucaauuggaaaagauaaguuguaguaccauuuguauagaauuggcccauuuuuguaggagcaagacagaacaauauagugcacauacauauuuaucuacacaugggagaaauucugugaaggguauguacuuccuguuaacagacauuucugggaaauguguuuggaagguaugagacaccuuuuacuuuuugaugucuccugauaaugggaaaacaguaagaauguggguuguaugcaugagugugauucuacacguguagguuuagguuugauguacucccauccagcuuauucucuuuugcauuuuccagcacaggcagugcugugcaaugucuugcccaguggacacccaccuaauuuucacuccacaaaccacuguccuacaucugauccuuaacaaaguauguuaguuguagacacaaagguggccuacauuucauacuuguugacaguaaugcuaguugacucaucuuaccuuugucugaggaggcuggaaauuguuuguccucagaaacuuuagggagaaauuuauuacuaagauuguaucauuuuggucuccccagagaaaugaaaaauuagaaauuggccaugugacaaucguugcauuuaccucuuuaaggagcagugauucuuuaaguggugcuugauuuaucuaaacccgauuaauuagugaacggucaucuguuucucccaggaauuuuuaaugaucauuaggcuuuuguaguuacugugaaauuuuguuuacguggauuuauuuuugugcaggauuguauacagggcagaugcuccuuaauuuaagaagggagaugugagaacaaaagugucuucucuugagugagggccuguuaugugcccugacuuguuacaaauaucgacuaauguaaccuucucuaccauguaccuuucuuccaauuuaucaaugaggaaacugaugcaaaaauguauguucccacaggcucugguguguucacugaguuagcuccagaaagaacuguccccuucucaugccuguucccuacuucuuuugcagcuaauucuccgaaaugguuucugucuucagcuuucugggcugccccaucaccuguguugcuucuaaauguuaguuucauugcugccuucuggguuccucugcuucucucugacaugaugucucuacggaugcaucucucaguaaugauuauaaugguggugaugauaauaaaaagagaauacacaaguguuuuuaucaaucccugaccaugcugggcacaaugcuaagcaugugcaggcaugaugucuuuauucugcccacucagcugaugagauugaaggggcucccugcagguuggggccugaaaaacacagccagguccaucuaggaacuagaagcuauggucaggcuuacaugcuuuuuucauaucaguguucauguagauguuuaagcucuugcaguagguuuuugcaagcuagugaacgcugccaaauuaugcucgccacacaauugcagccaccuauucccaggcaguauaaauauauggcugaacuaacauuaauaccuaucacuguuuuaucaagugacauaaucaagauaauuaugaaguauccaaauauuaauuuucauagauuaaaagcagauaaaguauuagaaaucugcuuauaucauuagcagaaacauuuuugggggccacaggguaaggaaaagaggggaaaauauuguccuucaacaaaaguaaucauauucuaguaaguauaauaaaagaaaugacaagcuuuucagaauuuccacgacuaaaaauuguuuuagcugcagcuaaaaaagcaucacauaacaaaauaucucuuguuuaaaauauuugcuacaaaaaaguccuauucuauauguccugcauaagaacaaguaucuuuauauaagaaauguguuuaauagcccucuuucauucuuuuucugaagcccucccuguuaaauugcacccaaaggggaaacauuaauugaacuguaaagcuuuuuuuuuuucugucuaaagacauuaaagacauauaggugguauuaaaugaaccuuuaacuagagcucugugaguuuucaaaauagauuuuauuuuucuuuaccauaggccaacagagauuuugagaaacacauugaaggaucuguuaacacuugauauacccaauaaaagcagugguugugccagugcugaucugucuugaugugaaugugaacaaugggaaccugagcugagcagguaaauaaucauguaguacagucaccgucuucaguguuugagaugacuagcaggguaaaccacgcugugucuaagaugcaguguuaauucuguuugaaguaaaaauaugcaagugugguacuggauauuuuggcacgcaaucuugcgaaauuucucauugaugagauucugacauaggaacuacauuugaguaagaaucauagcucaauacagcaugauuucaggaaagucgacuaagauaaaaguguuucugaggcugaacagcaagaaucuuuugcuaagaguuagaauagauugacaagaaccuaaaaucagaaguugcaauucugcugagauacugcuuuucaguucuccgguggaagcuucauuggacauauuguacaucaagccucuaugugacugauuccugccucuuuaugucuuguuuuagauucuccauggcaguagcuuuaggcaacccaguuuuacugaaugcagcaaugguuucagugaccauuagaguccaauuuuaggaugauacuucuccaaauuguuaaaacucccuggugcuuuucucuuauaaacugcaaaaugucuucauauuucaucccgcuuuucaguuaaugcuagggugacagaaacuggaccucucccaagacaugugacagaguaauacagcagccaacuucuucgccaaauuaaaguuuuacaagauuuaaccugucaucaagaccugggauuuugguggugagucaucuucaaaagccaaguucggucccugguuugccuucuuuuccgcacaagaacaaggguuuugauggcucuggucuccaggaccaucuguggcuuucuauuagcaauaaucgcaccucggugaaaccucauuggcuacgauacugccacugcgcaaagcucauggcuuucuuuaauagcaaauggccucugacuuuuaagaagccauguggcuaccccucagcagacuuaggagaggucuuggcuauuauuuguuguuuuauaaggugucaucauugagcaucuacucuggaugaggcucugugcugggcuugagggguacagggaaguuucacaugucccgucuuguugaaucacacacacuugaucucacuacaacagcagaaaacaaguuaaaguuccccagggguugacacauuugccugccguguuuauugcugcugugauuucugcagcaugguccaaagaaggcaaucagucaacagugaauggguugagauuuugugauuuugguuuaggagucuuaaucucuagaauaaaaucuaaugaaaggguggggcuauguuuuucucuugccuugacuucuuugacucuauuuguaaauuccaaauuuacccaggccucuggcucauucugucuuaaggugcggggaccucuaaaauguagauggcaacaaucuuuagacuauaugugucuugaugguagggcaaucaaauugauuuccucagcauauacgagucauguuuuguaagcaugguggguacuuagucaaugucucaaucagauuugcuucuguuuagcaagauaaucuuuugugggggaguguuauggacugaacuguuuuccuucuuccaaacguauaugaugaaaccuacccccauguacucaguauuaagaaguggaccuuugggagauaauucagguuaaaugagauuaugaggguggggcucucgugaugaaauuagugcccucaaaauaagagaccucagagagcuuacugucucucuucucucucugcuacgugaggacacaaugagaagggagccauccacaaugcaaggagagggcccucaucagaacagaccauacuagcaccuugaucuugcacuuguagucuucagaacuguaagaaaaugaauuuucuauuauuuaagccacccagucuggugcagucuauuauugccuuccaaauggagaaauacaaggaaacuagggccgucuuagcuucacagagagaagauguggagaggaguuaggagguagagacuggaccuugaugguggugauauucaauuagugaaaggcugagaagaggucaaauauacuucuuguggccccaaagaucagaaccaaaauggaaagguagaaacaguaggcaaacagaaagcaacuuaauaaaaggaaaaggaaccugagagaaugcucugucucugacagugguugggaucucaucacuggagauauccacacagggacuguauuacuacugagaggggguggggcugaaaggauccaagcauugcacugugaugcgaccccauaaggucacuuagucuuugggacuugugagcucacagugaaucauuacaaacagaaacgauucccucuuauuuguggagcacauuaaaauuuccaaagcauuuuugugaguacauuagcucccaugauuuauaucaaaacauuagaguugacauucaauacacauuugcugaaugagggggaugcaugaaggagcuauugugguaccuugguuggcagaagaggaauacaugggcagagucauuucuagacuugcuaggaaaggccaagccaggcuuggaccugggucucuacuguacucuuuacucuacucagucuuuuccaagguggaaauaauauuuucucugaggcugauguuuuucuguuuguuuugcauuuugguaaauucaucaacaucaauauccccuuuaaugcucacaaaugcccuuagaaccagcuuuuauuguucucauuuugcaaaugagaaaauggaggcuucaagaguugagugaguuuagcaagguuuucaacucuucuugggcagagcauuaggguugcagacaguugggcacccucuucaaaugaaugugagccaacguuggcccuguugggugugcaaggaguucuugcagaguugauggagacccuguuucgagucacaugaauaauuaaucuagggaaacaguagucaaacagucaacucauucuuucuugcacucuugcugauccucagcaauuucucggcugcuccuccugccagaguccuguuuuguaccuuguaaacaagucacucuaggaguuccuaguccuggcuguauaccauagucaccuaggggcuugcaaaaucuacuaauauccaccccacucccaccguacuccagagauuaagauuuaauugaucuagagagggaucugggcuuugguguuuuaaaaaaucucuuuagaugguugagaaucaccaaauuuuuguugguguggggcagguuugcacauucagguucauggguuauuggaaugaggcaugaaggggccugcuauguucccagggccugcuagcucugugccgauugcuuuugguuuuguagaaaugauuucauuccuucuucccugaagccauccugauuugaggucauagucuaugggggugccauguggauuuauacugcaacucuuguuuuuacuagcucugugaccucagaaaggccacccccccuucccugugccucuguuuccaucuccucuguaacauggggauaauaauacuaguuuccuuauaagucuguugugagcauuaacucuugggauuaugccuguugaauaguuaggguuccacaaauaagucuugcuuaaugguguuguuaucauuguaauagcugcaugugugugaguguauaaauguauguaagauauuuuuccuguuuuuuuuucccccuggcagaguuagccacuucuuccuauguguaagcauaucaucacuuucuauuucuauuauggaauuguaauguguuuuugugucccuaaccugauauauucauuccacaaauguuuauugaacacuugcugaaugcugaggaauggacaagagagacacaaucucugccucuugagccauuugaacuuugaagaggacagaugaugacaagaggaaguggaaauaggcuaggaugcuacggagacuagaacaaaugguccuuauucguaccuugcugugggggagacucuccugacagaguuaguugugucaccugcauucuuucuuucccuuccacauauaguguccugggacuuacugugauuacuuaucucucuaucccucaacaguaaguccuaaucauuggggcuaggaaaugugccuugucaaaugaauuaaugaaugaaucacgcuggaccaaaaugaacaaaaaguuauuuuuuugacucaauuuagcuuaaacaucacauccugagaugcuguguuaaauccuggagucacaaaagaccuuuacagaaaucuuuacagauuucugggaacuauagacacguauaugaggauagguuuggaccauuguagcugcuguaauagcuguuguucuggugagcaguggggacccaaguguuaguaggcccugcaauaaacauguaugggccugagauaaaugggucagugucucucacgaagcucuguuucgucaaggugagggaaugugucuuuuuugcauuuauucccucccaggguuuaggucacugccugacacauggcaggugcacaguggauacacagagaguggccagacagacgacauagcuuuucucuguggauuuauccucaucucuacaagggggguuagccaguauuuugagggucucccucaaugcucacauucuagaauccugugaugggugcugaaacaacgcucccucauuggagcugcuugagaaggucauucauuauuuugcgauaucuucagacucucaucauugcuagaagcugacuaauuaugagaagagaagugaaggccuugaaaugccucucucugcacaucuggccucacugucaaauaaaguacuuauuucugauaagcucuuuggcuucugugaagccgccuggccgugucuggccgugggcggugcugauaaugaaccgaacagagaacacagacuuggcggggaagguggggacccaguggguagaaagaaugggcuuuuuagaccauuucaaaguaacaagaaagcuuugagagugcuuagugaugucugcuaccacauucauuuccucuguuuccauugaaauugaaguucuagauggacugaaccugacuaagaaaagggaauguggacaggaaagcuaaugacaaaugcaacuggcuuauuucuggagugcuuuguacucucagagucuugugcccugaacuuucuucaucuggacucuaggggcacuuaagcaauuagcaugccacaagcugggugcuguggaaagaucauagacuuuagaaacuguccaagaaacuagugggacuccacaccuugugaguuguguauccuugucaaguuuaauuuaccauguugagccucaguuuccucaccuaagagaaagaaaagagaaauagauuuauuuauuuauuuauuuauuuauuuauuuauuuauuauuuauuuauuuuugagacaggguuucacucuguugcccaggcuggaguacaguggugcgaucucagcuaacugcaaccucugguaucuggguucaagcgauucucgugccucagccuccugaguaacugggauugcaggcgugcaccaacacaucaggcuacuuuuuguauuuuuaguagagacugguuuucacuauguugaccaggcuggucuuaaacuccuggccucaugugaucugcccaucucggccucccaaaaugcugggauuacaaguaugagccacugugccugucugagaagugauuguuuaguuagaguaacucuagaugacauaacaaauaaaccucaguauucuaguagcucaaagacaccucuuucuaagucagauaauaguuugaagcugggcgcaguggcucacgucuguaaccccagcacuuugggaggccaaggugguagaucacgaggucaagaaaucgagaccauccuggccaacauggugaaacccugucucuacuaaaaacaccaaaauuaacuggcugugguggcaugcgccuguagauucagcuauucgggaggcugaggcaggagaaucgcuugaaccugggaggcggagguugcagugagccaagaucacgccacugcacuccagccuggugacugagcaagacuuugucucaaaaaaaaaaaaaaaaaaagguuugagaaggguuuuccuggucauuagguggcuuuucuucauucugugaucuagagacccaggucucuuccauguuguuguucugccaucccugggaccuugaaguuacuccaacuggcagcggagaugaaggacaggagagaaggcacaccacuucuuaaacacgucuucuggaaguaggcuacaaucauuucacuugccagggauaaguucuagacgagcuuuagaagggggauggucuuugggaagccaaggugggaggauugcuucaucucaggaguuggagaucagccugggcaacauagcgaaacccugucucuauaaaaaauacaaaaauuagccacgugugguggcacaugccuguggucucagcuacuuaagagacugaauaggaggaucaccagaaucugggagguggagauugcggugaaccaagaucacaccauugcacuccagccugggcaacagaccaagacccugucucaaaaaaaaaaaaagggggcgaggaugguaaccauucucugccauaaauaccuuaguguugcucaagaauaagugagguuggguuugugaaccuacccuugcauaacaugugucaccaacuauggccuuacuuauuuguggauuguuuguagguacacauggccucacaggaccauucgugugguccugaaauuaauguaucccuuuggaaauaugugguagacaucucucuguguuauuaaggauagaucuccaccaugaauggaauggcuaaugcuuacagcuggaucaugauuuacauuaacuccucccuugcugguaucuuauagauugucuuugguuuuguuuucacuacaaaggagacagcacgaauucuccuacaggcucaccacacaacuggugcugugagggagacgaagaugagucaugccuguacugcucuuuaaacacucacaauugaauaagcuacccaggugacacgacaugguuauccuggccagaaagccauggcuuuuccuaaucagagcuucagugcuguggaaacuugaaguuuggagggucugaugucucagucuggaugaggaugaguucccugccauuccuggguuagcagcucccauccucuuagauuccaagaugguggcucaugccuguaaucccagcacuucgggaggccaagguaagaguauggcuugagcccaggaguucaaggcaaaacugggaaacacagcaagacccugucucaaaagaaaaagaaaaguuuccaagaugguguagaacaucagagaggggcucuuggagauuaucuggccaucgucaccccaccugcuuauagauggaaaugcauagacucagagagguugggggacauaugggcagcuauagaaauccaguggaccucaaaucccgacauuucuaaccugaauuaaauucucucacccuuguauggagguccuagaguccuauuuuccaaacuuugccucugaaugucuccaugucaaaggguuucucagugugccagagggcaauggagaauggagcagaaaugaccacagaagaacaggugggaagauuccugcaacagcaaaaauucugcugcccgguuccugagacaugaagaauguguugucuacacaacuacauggccagcugccuccuuaauuuuuucauuuuguuuuguuucugagacagagucuugcucuguagcccaggcuggagugcagugagcucacugcagccucaaccuccuagguucaagugauccucccaccucagccucccaagcagcugggacuauaagugcaugccaccaagcgcuauuuuuuuuuuuuuuuaauuuuuuuagaggcagggaucuugcuauguugccagggcuggucucaaacuccugggcucaaguuauccuccugccucggccucccaaagugcuggaauuauaggcgugagccaucaugcccagcccuccuuaauuuuuuaacaugaauuaauaggaccuggacacacacagccucauuuauaucggcagccaucacagccugccacaugucagaugaggucucuggggcucucacuccuugugucgggggugaugccacauguggcccagcuguaggucacauucagcuccuguguucaccaggaucagauggaaugccagcacaucuuacccuccugcgcccugggaguuuguaauaaucuacgaauacguagauuuauuucagagaacauuuuccgaauccuguugcgcauacgcacaaaaauauuggcugcaguguguuuauaaccaugaaaauuccaaaauagcuucaaucuccugugagaggggagugguggaaggcccuccagcacgugcacagaauucuuucuucagccauguaaacaugaaaauaaggguuaaaaaugacuucauuauggggaaaagggacaggaugcaaauuguucaaauggcaugaugauauuauaaggaaagaaaaagauguuauaaaaggucacauaaagucacccacaggucagcagucaugucaugauuagcugcucugugccagacacaggcuggaaauugguagaugcucuccccaggaagugggcagcagccccuuugugccucugucaccucuguuaggcuccuggaagcccccuucauugcugcauguaaugacaucuucgucaccacauguaacagcuucuuuaccacuauguguaaugccauucugugugcuuauugggcuaaacaaucacagaggaaaagagugcuggagaaaugccagggagauagguaccgaaacguuccagauggaaagucucgucuucagguggccguagcaguaaaugucagggucaaacaggggguguauucuugggagagcuucagcucgucugugaccuaguguccagccagcuuccugggaaggaggcugcauccugacauugaagcccugugugcuaggaugaguguguuacgcagagccuuacaaaugagaaaaucuugcguccucaggacaggcaguuaguguugcugucuggaauacacuggcuaccucccuccuccccccaccacuuaaaauucccugaauccgacagugguagggaaagggcugauccuggagaagauuguuccuugauaauccuaguaugauucauaaugguugcagcagaugagccgcgagguuuguggcucagucugcagcuaaggaaggcucuucccuggggagguguguccagcuucccggaaagaccucagcugucuagcuggucugggcugcccaguucuuagcagugcaucagcaaugagcagccgcugaccaucaggcagcguuucccaccugccagagaacgucagagccacugcgucuggaccagcugaaggcagccacggugcccaggaugcugcugcugccuccaaggaaaagaacucugaaaaugaggaauuacagccuggugguuuuguuuuauguuaauuuuuuacaucugggagauaauggaaaaaauuaaaaauugcuauaauugcaccaaucuuaaaaauuaauaauauaaagacgggaaaguaaccaacacaagcuugaaacccaucccgccccuucuugagauaaucccuguugucaguuugguaauuuaugcaaauguaguggugcacuguuaaacuucucaagaggagaaacaaaaacccugaauuguagguuugucaauuucaauggugaaaucccaccgcagccgauuucaggcaaccaaagcuuuaaaaacgaguucgcaaauuucuugaauauuuaacaaucagcuuuugcaagugcauacaugcucacaacguuugcuuuuuuguacuuuguuuugagggaggcaggaaauggaaacuugcaaugguauugauaagugugccauuuuuauuuacgguaucacggaugucuuccuagaccagcaugugcagauucacuuagcuucucucacuugugggaugggguuuccaugaaggcucacuguguugcuucuggaaaggcagaaucggccccccaggagacaggaauggcagcagcuuggcacucggaggcuagcuccugcaaugcugugcacuugcaguggacaaaaaaguaaacuuugguguuuacuuggaguucacucuagcuuugguuucuucuaaauauguucuuccaaugaccuguagccuaaucaacucugcuggcaacacaucccuuugcucugcucaauuccaguuuccaucagagaaucucauuuuucuuuugggaaauguuuccugauuuucgucuuuuccaccaccccucacugaggcuggguaaaguccuucuccaugauguuuagaacccaggccuccuucuguggcagggcucucuaccccuuaugauuuauugugugaugucucaaccuguuuccuguggagaagcagagaagcucugguaaacagaauggcccucuaaagaugcccaugcccuaaucucugauguuaugccuaugaaugaauauguuacuuuauauggcaaaggggacuuugcagauguaauuaagguuacuaaucaauugacuucuaauagggagaguauccuugguuauccagguggauccaauccaaucacacgggcccuuaaaggcagagguuuucuccgacugugaucaagaaaaugccaugaaagauuguaagugugagaaggaguugaugugccacugcuggcucugaaauguggggcccacuuguaggaacuggagggagagacugguugcuaacgguggccccuagcuaacagccaacagagaaauggggaccgccggccuacagcugcagggaacugaauucagcaacaugaauaaguuuggaagaggauccuuccagaaccuccugauaggagcccaguccgcugucaccuugaauucagcuucaugaaccaggagcagggaaaccagcugagccaacccacauucugaccuaaggagcacugagguaauuauauguguuguuuuaagccacuaaguuuguaguaauuuguuauaguggcuguagaaaauuaauacaggauccuaguguuugggaaugcaggccccaggccccgcuuuuuccagagcguguuugcacuuucgcaggggaccuucaagucccaguaguagcucacuuucaggugucucagcucagcuugcccugcugcuccugaaugagcagguucuaacaucuuccaaacacuucaucucccccaccugccuauagucaccgcuugguggauuuuuaccacugcaaugugggccuuggcuuccuauuucagacccccugggauguuuugguagcuuccuuaggggucuuuucaacuccaggcccucccucugcccaaccauccuucaaacugccuccagaugcaacuuccuggagugcggcuuugcuuccaucgcucccuagcuacagacauccugugggcuuccuguuucuacugaauccagggcacaucccccagccuaggauucacaaucucuacuggggacaggggcauugccucuccaguccgauuccccaggacuugugcuuuuuuuuuuuuuuuuuuuuugagacggagucuagcucuguugcucaggcuggagcacgguggcgcaaucuuggcucacugcaagcuccgccuccuggguucacgccauucuccugccucagccucccgaguagcugggaccacaggcgcccgccaccaugcccgguuaauuuuuuguauuuuuaguagagacaggguuucaccauguuagccaggauggucuugaucuccugacuucgugauccgcccuccucggccucccaaagugcugggauuacaggcgugagcaaccgcgcccggccugucugggccaucuuuauacucaguauaaucaguccccacaaacagaaaugcuguugcagggugagugugcuaaaaauacuccugggauuuuucaaguccuuggagacauccaucuuaaaauagugcaaaaagaaccgaauaaauacucauuuaugugcuauuuuaaugaacaacugcaggcaauaugccuaauauggcagggaggucuucaguguccuuucuccuucauucuugauuagcgucugagcucagauggcaugcaucaguauguuuguggcauuacagaggugcugggagugagggagagugcagggguagggaagcauuacaugccuguaaucccagcuauuugggaugcugaggcaugagaaucgcuugaacucaagagggagagguugcagugagccaagaucaugccacugcaccccagccugggccacagagcgagacucugucccaaaaauaaagaaaagucagcuucugugcuccugcccagaaccacugaaucagaugcugggugucagcucuggacccuguuuggccuuuucuuuccuaugucaacccagcagagcugcaggccuuguguggagguggguuacaaugugcucuccuuauccccaguaaaaccaggacauuuuaagguggggacggggugggaguggaucaauuaacuuggagucuuggcuugaccuuuacccuggauuuauggggcuuagaaauaaagggaaaguugcauucuucucugaggaacugcuuaauucauauccacucucccaaauaaagcugcugguugacugcagcuauuuaauucagugcuauuugcuuucauucuguauagggugaggauagcuucuguuggccagagcuugugcuagaucuccaccugggucaggaaggcauuucccugcgcucacaaaggccuugcacacauaagaugcacugaagaauuccuggcagggccaaaucugguguccgguucacucuuggccuuccaaguucuugcugccucuccuuuguacccaugauaucugauggcagcagcauggaacuugguacaguugaaauagcccaaguucaaauccugacucagauacuaagcucaguaacuuuacguaaguagcauaauuauauggauccucccuucuucaucuauaaaaugauguggugaacugauuacaggaauggcccuaauucuucacucauucccuguaucucauucuggacugacugugucucauaagcuguuaguaaacaugacgcaagcugagauuuuuuuuuuuuuuuuuuuuuuaagacagagucccgcucuguggcccaggcuggagugcaguggccugaucuuggcucacugcaaacuccaccuccuggguucaagcaauucucuugccucagccucccauguaucugggauuacaggagugcaccaccacaccuggcuaauuuuuguuauuuuuaguagagacagaguuucaccauguuggcuaggcugaucucaaacuccugaccucaggugaucugccugccuuggccucccaaagugcuggaauuauaggcaugagccacuguauccggcugcaagcugagcuuugaaauacuguuuccauuuccacuguugaaucucuuuuaucaccaugaaaagagauuucagggcuagucacugguuccgggagaagaaagaaugacacauagaacauaacucaggugcucuaauggucccaguugacaccaaccuagaucaguugacagccagccaacuccuagaccuccaugugagcccagccaagaucaccaaagcuaccuacuugaccacgcagauauauggacacuuagugcuuaugccacugagcucguugugcaccauuguuuugguaauagguacagugggaaacucaguaauaacuauuacuauuacaauaguaauaacuauuggauucaaauccugccagggcauggguugguuagugcuacaugcauugccugauacaucaacuacuuuuggaaugacugaauggucuuauaaggauaaauuauguaacucuuuugcaccugauuucucuauucagaacaucucuaguaggcugcaaucacugccacucacuugaaauucuuuaagaguggaaaugccauuugcuggacauucagagagagagacgugaaguagcuagguuccuaguuuuacgugagaugucgauugaucuacggaguaauuugggucccuggcuccaaggcaagccuguuacauucuucaaggagaaaacagcuugacaucaguaucaguuugagaacacagcaugagugaacaaaaaaaacagcgguccccauauuuugggcauuugcucuacgccaggcacuucuuaucuauucugcguggaggaauugcucuccugauuuuuaaaggggacaaaacagcucagagacaucaaauagaugaucagagagcacacagcuaaggagguaacagcucaaacuucuagauccagagcuaccucacagcaaaggacagccucuuacaccccaccaccgucugcagagcccacagcaggcauccaggugaagcuccucaguuuaucaaugaaggaauugcaccugugaauggaaguggccugccgaaggcuacacggcagugaguguaaccagauuaccugauaccccuuccagggcccuuggugugacuuauugagaucucaugggccagugggugucacugaaauuccuggauaaaaguugcuuguggagggcugucauaguggcucaugccuguaaucccagcauuucggggagcaauuugggaggccaaggcagguggaugguuugagcccaggaauuccagaucagccugggcaacauggugagacccuguuucuacaaaaaaaauaacggaaauuagccuaguuugguggugcaugccuguagucccagcugcucaggaggcuaaggugggaggaucaccugagcccaggaagguccaggcugcagcaagccaugauugugucacugcacuccagccugggugacagaguaagacccugucucaaaaaaaaaaaguuucccauggagacauuaucaguuucuaggccuccacgugagcaccuuaaaagaagcacuaugguuuaacaacaacaacaaaagacacaccagggaacaccugagcugcuccuaugcgccugugcugucuucagggaagcaagucagcaucaugaggaggaugccuuuugggaagaggccugagggcuggcuagcugcaggugugccaucucuaaucaauucauucauucauucauuuauuuuuauagagguggggucucgcuauguugaccaggcugaucuuaaacuccuggccucaagugaucccaucuuggccucucaaaguguugggauuacaggcgugagccacugugcccagccccagacaugccauuucuagacaacaccuccaaggaucugaggagagaagccccucaugcuggcugccccggcaucuaccuauccuucguucugccugccagcucagagggugggagcggugccagggagcuguuugggcuggcgcaggccaggcaggagcccuacuuggcuagcagccccaggcaccugccacacuuguguauuugcucagcgguucgggguacggaagcaggaugccuuccgucauugcacccuggguguucggggccucgggggccagcugcugggcuggcagcuucucugaggagcuguuucuugcccucuuuguaccccugucucucaacuaccugucaggcagguaauaaucccaccaucaccugauguacccagaggagaaggcaggaggccugcgcaaugugcacagaacaaacacuggcaaggugccugagagcccugcaccaggcaccuucagcccucaggggagagagucuccuguccagcucaccccaggcacccuucuccaaaugcccagucuugcaccauucccagaccauuugggccacaucugaaagaauuugccauacugccugccuuugauuagauguuagggaagauuuaaauucgugcagaaucucaauacagcucccuuccuguuggaaccaugugacagacuauuuccaaggcuguuucuuacaagaggaucugccuuacuaagucagagcauugcaauaauuaacguuuugaaagcucccugauuuccaaagcauuuucacauacauuagcucacuuaaggucucccaaacccugugaauggagcauucuuuuuagccccauuuuacaggugaggcaacugaggccaagagagcuugaguagcucccccaguggcuuaauguagaauaaguaucagagcagagacuggagcccagaucuuccuuaugagaauccagccuccuuuuuuuuuuuuucuuuugagacagacucuugcucuguuguccaggccggagugcaauguugugaucucagcucacugcaaccuccgccuccaggguucaagugauucuccugccagaguagcugggauuacaggugugcacuaccacacccagcuaauuuuugcaauuuuaguagagaugagguuucaccauguuggccaggcuggucucaaacuccugaccucaagugauccaucugccucagccucccaaagugcugggauuacaggcgugagccaccgcacccagucccagccuucuuucugauucacucuuguuuuguaguuguggacauuuaagaagacuuuuuauuuuuuuauuuguauuuuuuuuuuuauucaaagggcuugugcucaaauaaagugagaguagggagagagaaauucauguuucucugcucuguuuuuuguuugggcucucauuuaaucucucugacaaccuuuugcagcagguguuauucucauccauauuuacaccugaggaagcugaggcucacagaggagaaauaucuuuccccaagccccacgucgagcaguggguagaaaaugagcccagaucccucugucuccaucucugcaaccugucucucugcaugccacauuggcuuacgaccgagaucagcugcaccagggcaggcuggagggugaggaggcuggcuagaccccugggaaggcaggcagcacccagagcuguuccagcucugcugauccuguucgagaggccagaaaaguucaaauauuggccuucuccuuauagucucccaccuacccucccucuggaagcacagaacuguagugugcaaagaaagaccuuguggauccucugcucuugcccucucauuuaccaaaugagaagacgcucucuggggaacgugaccggccucauuccauagaagagauggaagagucuggagcagaaucugggacccugacucccaggccugugcacugaggcguucuugucugccaccucccagccccucucuuugccuuccucgaucuucuugaguucucuaaugggucaucuguugugaccguugauuacaagacaccaugcaugguuccccugcuuccauuuauguguggaucucccucuguucuuacauaagaaucucagagaugggucagguugugaccuucucuuuggugcuggcuugaaguugaggaaaaagccaggcuccgagucccuuggaucugggucccaacccugccuguguggcucugaagucaagugacuccuccucccccuguuguauuccccggcagcacuaacaguggcuccccuuagcuggacaccuagagugccaggcucugugcucaggacuucacuguuugaggucccuggagaguggaaccucucacccacaagguggugauucccuugggagugggcagcaugcagucagaagggaacuuggguggggacaggcauccuauauccuggguuuacccacuccuacccaugcacugaugggcuugacugccuggccaacacuuacugagcauauagugaaugacgggcacugaggcucaggggaugaagccauaggcuuugagucccagagucagugauggaaucaccagggagcccaggcaucgugucuaugcucugugccaugugacaagucucugccuucucuucauccugaagagacccuggguucuugccucccugggcuguggcaccaugcaagguggccaagguaggggcccugguguucuggcccccagcuagguucucagcacuacugagugcuggcucauggugaguguucagccacuguuggaugaauggagaaaugacucaaugaauuucccagaaugcacagaugcugcaccuaaucccuuggaguuuaaccagcacaagaguuugcacuuugcuggccaucuccugccaaggcacagccuucccugagccuguuucccuuguauguggcucauaccugaggcccccagcuggcauuugguccccuccugcaggcguaggcugcccagugccaagugcaccuugcaucucuccccaguccucccacugcugucucccgcuuccugcccuccgucccgccacgggcucccgccaaaccagcccacacggccuccuuuuguucagccaccucgguuucaggccaaccaguccagccaggucccccagccugcauugcacacuccuuugaagccuugacaggcagccaaccaagcuggcccgagcgcgcaaggcagggugcuggugccggcgcgcuggcagcugcuucccgccuuucuggcuccugggaccuggcugcucccaggcccauucacauggggacagaaaugccuggacguucuccucggcuggcauggguauugcguccagggccacaggcuggggcuguucccacagcccagaguccuuucccaggcucccuguucuccauagugaagcccucugguuugucccaggcagugcaucccacagccucugucuccacaaaggagaacuggcagcaggaauagccuggcuggguucugagcucucugaggagaggcaggacugggcaaaggguaggagcacuggcuuuggcuucagaugagugucgagcgccucacucugccaucucuagcuagggaccuaucugcuucaugccucaguuuucucuucuguaaguggggagcauagagcacccaguucaccggcacagugaagggugaugaauacuguagguuagcacauugcaagcuaagucuucaacaggaguuguggggagcacuguuaauaugugggggaucaucauucuaguagcugaggagcaucggagccuaaaagacucgugugaaagaggggucuccuguuccuauuuuuaaauuuuuaaauguuauuuuuuauuauuuuggggacagggucuugcucugucacccaggcuggaaugcagugaugugaccucagcucacugcagccuugaccuccugggcucaagcaauccucccaccucagccucccaaguaguugggacuacaggcacauaccacugcaccuggcuaauuuuuuuauuuuuuauagagauggggucuuacuauguugcccaggcuggccucaaacuccuggacucagguaauccucccaccuuagccucccaagcagcucuugggacuacagcaccaccaccauggcuggcuaauuuuuuauuugauuuuauuuuuuguagagugcaguggcucuaucacugcuuacugcagccuuggcuucccaagcucaagcaauccuccuaccucagccuuccaaguagcugggaccacaggugcacaccaccacccucaguuaauuuuuugacuuuuuuuuugcaggaaacgaggucucacuauguugcccaggcuggucucgaacuccugggcucaagcaaccugccuaccucauccucccaaugugcugggauuacaggugugagccauugugccuggccuccuauuuucuaaauuucaaaaguaguacaugcugacugcacaauuuaagaaauuuagauaagugaaagaaaacuuaaaaaauacuuguugcggucgggugcgguggcucacgccuguaaucccagcacuuugggaggccgaggcagguggaucaugagguuaggaguucaaggccagccugaccaacauggugaaacaccgucuuuacuaaaaauacaaaaauuagcugagcgugguggcgcuaaccuuagucccagcuacucgggaggcugaggcaggagaaucacuugaacccaggagguggagguugcagugagccgagaucgcgccacugcacuccagccugggcaacagagggagacucugucucaaaaacaaacaaacaaaaaaacacuuguugcugggugcuguggcuugcgccucuaaucccagcauuuugggagguugagaugggaggauugcuugagcccagcagcuugagaccagccugagcaacagagugacaucuugucuuuauaaaaauuuuuuuuaaaaaauuagcuggacaugguggugggcaccugcaguuucagcuacuugguggcugaagaggaaggaucacuugagccugggaguuagaggcugcggugaguugugacugugucagugcacuccagcuugggugacagaaugagaugccaucuuaagaaaaagaaaaauuaaaaaaaccuuuuuauccuaccaacguauauacucaugugugcacauguacauauguaugcauaccccuacacacacuagaauugcuaguuuauuaccauguguaauaauaguuuauauggacauaacagugcaugccuauuauauuauguacauauguaaugcauuuuauauacuuuucauauauauuucauuucauauuaaauucuugcauauacauauauuugaaaaaguaaagaauagguuccucugguuuuguaaccagcuuuugucauuuaauguaaguugaauuuuuuuucuguuagggaauuuuucugcaggaaaauauuuuaaggccaccugguauguuauaauacaaacauguuauauccauuugacaguugaggagcuggaagugcugagaugcaacauaaguuccccaaaauuaugcuacuugaggcacagcugacauccagaagcuucucugggaaggcuuuuggaguuccccaaggcagagucaacaagaacauaaguuucuuaagaacagggacugugugccucacuuacugucaucuccccagcaucugccacaaaguggacauucuguuaauaguuacugagugaauagacacaggaaguucagucuucuuuuuuaucucauuucuugcucaaagcucaucucagcauugaacgugucuuuccacauggccuccucacuagcuucuguaccccucaaguccaggaccaugucagauugucuuugaaucccucagccccagucccaggccugcccuagagcagguguucaguaaaugacuaucgaauuguggaaacagggaucucuccauccuggauucaagacagcgcccucccuaugaagcuuuucugagcucuuucacaccaaaguucucccaaccaucguguugacagcuaucugccugcugcccucaguccaggagcaacuuggacaucagcucugccugucacacuggggucggcgcaccuggccuguuccaggacagaucacaaggcugaggguuaaguaacaccuggagugguuaggaggcugggcaccuccuugugaaucucccgggcugcguggcggguggcggguggcuggcaggggagggacccuuggcacugcuguggcuuuguauuugcugccagcggggccuuugaugccccaggggcugcucgcccagccaagggcauuguagaacacaaaagcugcagaaagcagcacaaauaaagugaaagcgacccaggaaacugccagggagcuuaucagccuguuuccugaucauagguaugggguguagggaggcacggggagcauuucugggcccggugauugccugcacguugccagggccccugguauugcguacaaagcauuaaccuggaagcuaagcaaggcucuucaccuuguaaaacugacuggaugaguccaaacucuuagaguuuuugugaggauuagacaggucgauaaguuaaagugccuacucugugugugugcaucugauaaugauaacagugacaguaguaauaacgguagcagcuaauacuuucugagcauuucauauaugccaaacacuguuuuaacugauuuuuauauuaauucauuuaaucuucauaaugacacuaagagguagguaguacuguuaucuucauuuuauaaaugagaaaaucgaagcucagagauguuaaguaacuuucuuaagaucucacagcacaugagaagacaauccggcguuugaacccggggcucugguugugaaacacugguccaccuugcuccccauuucuucccccuagccuuuggaauauuguguuccccuaauuauuaugauaggacaaccaugucgugaugaugaugaugacgacgaugacagcgauggcgguggugaaagaggaagacaucccuucauuucauguagcaaucugcuucuugcugggauuucaaauccauuuucauuguugauccugagaacaagccuuggaggcggaaucauuuugaaaucccaggaaaccgggccuuaagagacggcugaagacccgagcagucauucgguggagucugugaggcccagagcugaggaggaggacauggguguagaaacggucgcagcccacacugcugugccuacagcucuggauccugacugugugagugggcccagggcugcuggaaccuguggagcuauagcaagaagggugaggagguugccccacuccugcuuccuucaugaacuucguuguucccucaggacaggaaacuuaggcuguuccguugaccucuccagacagcuuaguggugaucucaagccuucuuaugagaugguggaucacagcuaccauucauugaguuaagaccuucauuuauuucauuucaucucaucaguagcccugggauaugcauauuauauuuccaucaugguguaccauaauugcgucaguuaauuuuugccacggcaaugccaaguaacaaacugcagaaucucaguggcuuucaauauuaagcauuuauuaucuacauaucuggggagauuggccaagcagcccugcugaucuuggcuggacugccuccaugucuaggguguggcugccugguggcugaugugauuuugcuggaguggcuggggugucuccacucugcccucugugucuuucgucuccuucugaaaccagcagacuagcugggggaaugucguucuuauggugaaaagcacagagcaagacaagaccacuccuaggugaguaagcccuuuccaagcuucugcuggccucucuuuugcuagcacuccauuggcugaggcgagugaccucaccacacugagugucggagugggaaggcacugcagaggugcaugguggagggugagggugcagguagggugaagagucacccuucagguaagggugcagguagggugaagaccuguuugcacuugaucacaggugaugucaucucaacugucccucaggcuucucugagcuuugcugucguccuuacuuaaaacuauuugcauuguuagaaagaagaagagacuagcaggcaccuagcagugacugaauacccaacaauccacuuaaggagaugaaugguaugauucuccgaggcucugugggaccacggggcuuuaucaagguugccuaacagagcaguggcucagccagcauugaaaugucaccugccugguucccaugugugugugcauguguguguguauguaugugugugugugaacccaaaccugugcccaagucagacuuaugugacucuugcagccaguucucccucacaguguugcuuggaaggaaacuggaaggaaaagaagcuuuaggagagagaaauugugaccuccuuuccgcagguugcuaucgccacaggcuuuccacaagcuucucccugggcggccaccccagaggcuagaacauagcagaggauuuuucguaaaaucuuuggagucuucagaagaaggucuuuugagauaggucauggagaaaugaggccuuugagccauaaauuggccauagugugcaggcuggggccucaccaguucagcgaaaucuccagccuugagaacugaaacugacuuggggcucugauuuuaacaauggccuugaaguaaggcauuccuccuuguguaguuggagcugcuuccccuccuccuuuguuccccuucaccauggcauagccccagggagucccgaugccaaauucagucuuuggccuguauccugaagucaauucccuuaggaauacuuuucuucacuugccugccugaggccccucuccacacuuuugcuugcuuucccauguuaagaagacguauuugaaagugauuccuggguggccagagucagaaggcugggcaaccaucugccuugccggccaccuccccagcccugccgagcugugagcuuacaggugguaccaucugcacuucugcaccuuuuuuuuuuuuuuuggcccugaccuuuggccuaauaaaagcaaagugcagagcuuugaaugagggagauagaaacaagauguucucuaccucccccacccccucuuuucucuccuccuucuccuccuccucuucuuccucuuuccuucucuacacuuagucugugccaaacauaaauccagggauguauuuauuuuucccagugaacuaaagguuuauaaggaggaugcccuuuucucugcaaggacugguauucucuucccuuggaaaacuccuguucauccuucuggaucugggggaagaaacccauuucccucaagacuguucucaccaccuggguggaguugcugacuuuccauuuuggaacauuacacuuccagggcuucgcucugguccagaauacacuuacugugcuguucuagcucaucucuuggugugcgugucaacugaaccauuugaaggggaugacuguggcuccuuuacuuaucucuguguccucugugcccacuacagggucaaacacagcauggaagcuaaacauacaugugcaaaauggacaaauguagguacaagcaggggcacccuuaguucagaagggagcuugggcuccagaucacuuagcucuaacuuggaagcuggaacaccuggcucuguuacacagacaagaccugugucuccauauauacaauuuauuccucacacuuggcaaaugugugccgaagcugaaagagcucaaccuuagaguuugacagguucagguuugaaucccugcucugccuuuucccaagcaggggacuuugaguaaaugacuucacugcugccuuugccacaguuuccccaucuguaaaauaaacauagaaacacuugcuuugccugauuuguugaaaagaauagagaugauguuugcaaaguccuggcaugagcaguagcuauuauggcuauuuuauuuacccugaaaagcaacuguucauaguaucacaaggcaggcagggguagggggcaauaaaagcauuuguggcaaggauccaguuauuugcaggcuucucuucugucuggcuuuguuuacugucaugcaggaaaagugccuucaccagggcacagcaguaaaccuguuggcuacucuaguccugccuggguucccaggaaauuggcaugagaggagcugccugcugcuugugggccugcuauuuaggcugcaauagcugugggaacacacaggguuaggaaaacaaacacaugacucauuggggacuuccgaccucaagccaaugaggugcugacuccuugcaauuucuaaggguucccaguacauauguauaugucugcucagccuuccuuggaccugagcccaucugucucugcucucacacuuuguggggggccaagggauggaaugcuuguguuccuacccuucaucccuccuucugcguuuauugagccuugcuaggugcugggaaugugaugacgaguaagacagugcaggguacagacaagucaacacauguggucugcuggacagcagccccccaagaugaccauaaucccugggaccuucgacuguuaucucacauggcaaaaaggacuuugcagaugugauuaaauuaaggaucuugagaugggaagagugcugaauuacucagguggacccaaagcaaucacaaauaguuacuuauuagugguuccuuauuagagggaggcagagggagacugaauacccuagaggaggagauaugaccauggaagcagagauuguagugaugcagccaggagccaagaaaugcuggcagccucuagaaguggaagacaagaaacugauuuuccuuuggagcuccagaaggacccagcccugcugaugccuugcuuuuaguuccuuaugacuuaguucagccucugaccuccagaaggguaagaggauaaauuuguguuguuauuagcugccaaguuugcgaugauuuguuacagcagcgagaggaacuaauacaauguguccuugcaguauucuaaguguuaacaccacuucccuagugaugaaggagacugaauggcucagugguuccgagguagaucccuggagucccagugcuuugguucaaguucacguucaccuuuuguuaguuaaggggccuuuugccauguuacuucucaaagccccagguuugucugucaucugauguaacaucaugauguaaaauaaggguaauagugauuuccaucucaugcaugguggugaggauugagcugugaaaugcacuugaagauggcugucuggagcacaguauguaccccagcaccuuccucccgugccuuaccucuuguaccucgucaucgacaggaaggcacuggaugcuggagaaccucuccacagggaugucacaaugcagggcaaugucugcagagguguucugggcugaggcuucuggauaggauugauaggacauuuaguaguuagcagugggaggaggcaggggugcccgagacccagcgcuucuggggggcugggcacugugcugggcccucaguaguuuaguggcuauucugaaacagucacucacuccugauccucccgucacugcaguucacaggcagccuuaguuuuaccucuguaagcuacucaugagcauacaucauucuuuuauuuaguaaaugggaaucuugccccugucauguaccugucaggcauugcaggagugaguggaagcugcugcaggguuaccgcaccuggguuuugccagaaagguaauagaaggcugucaaagcagcuccuggaggacaguugagcaagugacuguuagagaaaccugaggcuucguuagggccaggacuuggcugcagggugcuguuccauuccugccugccucugcugcauugaggaugcagccuccaggcccaccauggguuugggcuccuucccugggacauuugggaugauuuugaugcauaacuugcuguugagauucucaccaaauagcugccugggccccucuccuccugaccagucagccaccgccacugccacugccagagguccacagauggaagcucccccaggcagugggaagaggcaggggugcccgagacccagcacuucuggggaaguugggcacugugcuggggccuuaggcccugcagucaccacuccucugaggggcaggagccacuggguccauuuuacagucuccucaccugucuuucaguuggugaugggacauacgcccauuuguuuucauuuugcauguauguucagaggggaguaaucauuaucacugcuuccaauucuauaauuuauguguuuaauggauuuuucagguguggguuugggggagcuugcuuugauucgcuauagagaauguucuuuuccccaccuggaaaugcaguugucauuguuauuguguuguugcacuuuguuugcauuccugaggccgugucggcaacaggcuuggaaagggaagugggggacagccuugaagcaucuggccuguaaguacaguccauuuggagggaggaucucaaugcauuuuuuagcauaaauacacgcuaggcuagcugugcccacagacagaggagguacccaacccucccacguucucugcccuugcugagaagccuggguucugaaccccaggccuccgugggacacagagcuucucaggagcacacgaagcucagucucugccccugccuuccagguaaacacaaaugcugcucgcguugguggcuuagagcccagcagcacauuuaguucagugccuuuccugggcuuggugggcaggugagggugcaaagucacccuugaugaagaaccacugguguagacuagugguucccaacauuugcuauaccagaaaucccuuuuacugguucuccuucccugugagggaguuuaucaaccaaauaaacuucauuguuaaguauuuauuccucuacuuucuuaucuaaaaauaucugccagugggaguuccugaucugggucaccaggcugaguugauauaauucuggccaguaucgaacaaagaagcuugauauuuuaggugacaaccguggucuuauuggaaaggaaggugaaauuucugguagacuucuugacccuucgaaaaauagacugaggacccccguggaggaguccugagauuggaaucgcugguauaaacuuuuauuuugcuguuuggaauuaagaauuuggaucaaauguugauggaagguuucuuugagcuccacauuucccugggagccuccauccugucuuguccccuuuuagcaugagcagugucauuauucagcauguauuuagucagugaucgccacaugccuggcacuucccugggugugagguugccgcggugaacagcagaugcagacaugguacuaauggggucuguagccaagugagggaggcuaagaaagaaagaaugucauuuccagcagugauaaguccuaagagggaggugcggcacgugaaugggcuugagggugcuggccucuggaguaacaagccucuguaaauaaucaagucacccauaucccagcccugcccugaagcacagucuucacuuggccuguuuaggaucauuucacagauucauugacagggcccaguuccugcuaguugacuccuuggggacggaauccucuauugcuugcaaaaauaugcucugcaguaggcugugucuugcuaauugagagggauucugagaaguggagcagcccugccucacuagauucaguaagaggaggccuuauagguacguugaaucuggccugguggacaaagcacccugcugagagcugggcaggucuucggaaggagauuuaauguucuucaguaggaaacaugguaauuccucucucccucuccagaugucugcaaccaagucauuauaacacagaagggaccuugcagccauugugucuuugugcucagguacugucugagggagggaagggaggcagaaggaaggggagggacggaucagcuccauuugcugagccaaccuacucagcaccaggugccccuccucuuggccacuggaaggcuuucuuucuucuggccacaaucaaacaccguuucuucuuucugccuugguucccugugagucaaugacuguugccgugggaaauaguagcugcuuggcaggggaguucaugaagguugcagagcaccugcucagguucuugccucgccucccuucccccuuuccucccuccucccaccuuuccuuaccuggcagcuaccuaauucuucucuuucaaaauacaguucagagaacaauccacaccagcugguuggggaaucauccaaagagacaauuucuacccugugcccaccucuccucuaguuaacaccuuucaguguucccucccuuccuguuguccuuaaguuaaugcccuaaagucauggcccuugcucagccucuaaggcccuggugggugcugcuuccccuuguagcuggguggguuucaggaaaugccccaucuggucaugagagauaggcagccauaccucaggggagaugguggcuggggagacagucuagccacaaagagcaaaaaagauagggaugagauggcucagagggagucuugguaaggacuuuggcucuuucucuguugagaugggaccaucggaaacuuuuuggcagguucugauuugcauuuuaaugagauccuucuggcugcuguguugaaaguggacuggaaguggcaaagauggaaagacagaccaaucaggaggcuauugugguaauccaggguauugcaguaauccuggccugguggaagcagaggagauugugagacaugaucagauucagaauauaucucaaagguaggauuugcugguggauuggcuauggggugccguaagaaauaugaucccgauuguugauuauccugugcaacuacagaaugaaguuuccauuuauugauaugggccaauccucagggugagcaggagugccuauuuguuuuuuuguggauagagguggaauuguuauguuagagauguuggucagacauccaaguggagacaguaaggaggcagcugcauguacagauccagaguguccacuuggccaggccaugguacucagacaugugaucaaauaccaguugagaugucacauggaguacguuuugaaugagguuaacauuuaaaucaguagacuuugaggaaaggacauuacccuccacaaugugaaugggccucauccaauaguugaaggcuuuaagaguaaaaagacugaggaaaugggaagugggaauucugaccccacauugccuuuggacucaagccgcaguaucagcucuuccuaggggcuccagcuugcuggccugcccugcagaguuuggacuugccagcccccauaaucacacgagccaacuccuuaaaaucucucucuuucugucucucucuucaacauacacacauccuacugauucuguuuuucuggaaaauccuaacacauggaagaaagggauaaauuuggauauccaaaauuuaugcaaaaauggauauucugauuuguauuugggacuuaaguuauuuaagccuuaaauaugagcgugaucaucaagagacaauugugggcagagaggagccaguccauggggccgcacagcacagauuaagagauucagaaauuauguguguauguuuguguguguuauauguguuugggugugagugcuuguguguguguauguguuuuugugcuuuugugugugugugcuuguguuugagugcuucuguguguuguuugugcuuguguguuuguguauguacauuugugcuuguguauuuguauguguauuguuuacgugcauguguuuguguguauauguuugugcaugugugcauaugugugugugcuuguauauguguguguuuucugcuuggguguguuugugugcauauguuugugugugcuuguguguguuuaugcuuuuguguuucugugugcuuugugcucguguguguugagugccuguguguuuguguguuuugugcuuguguguauuugugcauauguuugugugugcuugugugugauuguguguauauguuugugcaugugugugcauguguguuucugcuuguauguguguuucugcauguguuuguguuuugugcuuguguucguguguuugcauguguguuugugugugugcauguguguguguuguuuguguguguguuugugcaugugugugcaucuguguguuuaugcuuguauguuuguguugugcucauguuugugcaugugugugcaucuguguuuaugcuuguauguguugugcucauguguuguuuguguuugugugcauauguguauguguguguuugugugcauguguguuugugcucguguguuugugugcauguguauguguuuggcguguauauguguuuggugugugugccuggugcguauguguuugguauguguguguguguguaugcauguguguuguguacgugugugugcuuggugaauguauguguguauuuuguguguguguuuguguguguuugcguguguguacauguguuugguguguguguguguguugugugcauguguggugaauguguguguauuuugugagugcguguuguucguguguguuuguguguguguuguucgugugugcauguguuuaguauguguguguuuguauugguugcugagcacuugcuaugugucaagcauccccuauuacuagaugcagccucuccuuaaaacaguuuggaugucaucauggagagccaucuaucuccuuacuuuuucuggaaguuugggaagggauucucaugggccaccuauguauuugacugaugcuuugcaguuccuguaucacagucccuccaguguucugggcagcagacuggcauccagccauuccuucuccugugucagaaauugauuauucuggcaucuuccuuccaugccauuuucaguuccccuaaccuccagucucuugaagccauuuagcaucucuugguacugaguaaucccguuuauuaaagcaugugaagcuuccuuaauggcaaguguugguacaaauaguuuugcagccccaagggacagggucauuugaacucggugacuggaaaaaugguuggugugaauaaugugaagugcaggaccauggugaugaauuuccuucacccucuuuguuccuuguuuucuuuguaaggcagaauguuuaacccauauuuuccaagaacuguguagguggguugcuggggacaauugauuuuuagagaaguauuauuucucuggauguagaaaccaagaagcaaagaauaauauugagcaagaguccuccugaugaccaggccugggcuaauuauggcgauaguguugcaauguguuuggaccaucauacaguauaagaacaccacuuccccccaagaugugcaggacacaggauacuccccagggccuugcucuagccccaugucacccaaugucaaguggaucagcuacuuucuaagacuguaauugguccugaagaagaaggaguggagccuggcaggaggaagggacacaggucuuugugugaggaauacuaacugguaaugguaguucugguacugcccuggcuugcugugugagccuucucaccuguaugagcagugggaucaccaucuaugaggagauuggacuaggugguuuauuuuauuuuauuuuauuuuauuuuauuuuauuuuauuuuauuuuaagagagaucuugcucugucacccaggcuggagugcaguggcacaaucuuggcucacugcaaccucugccuccuggguucaggcaauucucaugccucagccucccaaguagcugggauuacaggcuugcaccaccacaccuggcuaauuuuuguauuuuuaguagagacaggguuucaccauguuggccaggcuggucucgaacuccuggccucaggugauccgccugccucagccucccaaagugcuaggaucacaggcgugagccacugugcucagccuuggacuaggugcuuucuaaggaguggggaugggucaaugggagggugccuucccuaaauaaaggggccagcccuccauuagcauccacuuaauguuguauugugggagggugcauucagugcugccaaauuaauuuuuggacuuugaauauaaugaaaauuucugaauuuuggauguaggcaauaacuucaaaaauauuugaaacacccuguggguuagaucuguagcuggauaaagcccccuaggacuucacguugcaacucagcauuccugaauugcucuccauggcuucucacaggcugggggucaggaggugagggaagcucuuuugauuuguuuuguuuugaaaucaguguaaguaucuucaaggaacuaagagaacaaaaucagacuggaagcugggucacaagaugcuguugccuagagacuuagacagagggcauggcauucgcucgcucauagaaggagauggccuacggcaggagccucagcagcccaucccccugggauugaucccuguguccuccaccugcugucucuggcucuguggacuccauggcauucagagcugggggaaaucaaguauuucaacaucuuaauuuuuucagucgauaauuauauuuuggagaucuuuguguguccguauguguguguacacauacauuauuuuuuaacugcuauauaguauuauuuucccaaacuauuuccuacacacacacacacacacacacacacacacauacacaaggaggccaaacaucuugucuuuuuuuuuuuuuuuuuuuuaaagacagggucuugcucugucauccaggcuggagugcaguggugcaaucacggcagccuugaccuccugagcucaagugguccuccugccucagccucccaaguagcugggacuacagacaugcaccaucacacccgguuaauuuuuuuauuauuauuuauuuauuuuuuuuuuuuuuuguagagaaggggucucacuauguugcucaggcuggugucaaccuccuggucucaagugauccugcugcccaggcucccaaaguguugagacuacagguaugagucaccgcaccuagccccaaacaucuuauuggacaagccuuucuuggccacucuaugcagacagcacccaccucgcaccuccaucuccccuuuuuuuuucuaucuuaauugaucaccauagcaccuaucaucaucugacccagcauauaguuacuuguuuauuuguuuguugacagucugacacccccaaccccucaugaaccccaggaaugcagagacuucuguuaauuuuauuaagugcuuuauucccuggaaaaugguaagugccuacuaaauauuuguuaaaugcauaagucucuauuuuggagaugaccuccacacccagccucaggcacagagauguaaaguaacuuacucaaaaucacccagcuacugacaggcaaaucugggcccagagcccaugcucuaaucuaaaucauuacuaccucccugcugguaacaaacaaaaccucagcacagugccugcaacacaguaaggacucaguaaauguuaaauaaagguaauaaugcuuauaacaaccaucuuugcccccagaaagauccuuaccuugaggagauagcaaggauuugagauguucaauauaaaauaccaaguauggugccugugcauaguuggccaucaaugagugguggcuauuuacuauuauacuuguuauuuuauuauacuuuagcacauuguguuguacuuaaauaccacuuguuugcccuacuuaucuuugucccuccugagggugcggagugagccuuauucauuccagcauuccuacaaucuuguacauccauacaauucuugauauguaguugacauacacuacuguaagguacaugaaugaguaaguagauaaaggaaugaacaaauggaccagugguuuguuggggccacucuggccagugguuuggggacaugcuuccuggagucuuauccccucuugucagauucagguuuaggacaacgguacaguuguuccauuguucccagauaacauauccuaucuuaacgucuuugcuggggcagcccuuggacacacccugagcuccugcccuaucacuggccccacuuguaccccuugugggcaggcaccacggcagccugcucugaagggagcuuucauguggccgaccaacucuacuccuugacuccucccuucucucauugaaaaaaaauguuuaaggggacauuucucucuccuaaacuuuuuauguuccauugaagaccuggaaaacauguuaaauaaaaaugcuuugccacagcugaccuaugucuucuggcuuguaccccacaacaucuuaucuaauggguaagucaguucuuaucuuuauuucacuacugaagaaacugaugcauaaguguuauaugcuuuuuaaguuacguaguauuagugaaagagccuagggccagaaccagcugucugcacgcaacccaaugcuuuuuccacaagaguuacccacauggcuguauuuguugguauuuucuacccuuaccugcuuccagaagacuuuggaaggguguguuacaaaagcagugauccagggcaacuuucaagucuguuagcuccuugugacaaccgagcugcccuguaaggcguaaugaggagcggcuucauaaugagcugaaguaguucugcagaugacacugcucaaggauggggaugcuuuccucucugccauguuuuccuuuccuguuggauuugacucuuagaucaguuguucuaagacuggguugaagcuuggaauugccuagaggauuuuuuaaauccugcugcuaguaccccagcugcaaagauuuugauuuugucugaaaugggaccugggcauuuggauuuauaacaucuccccaggugauucuauuaugcaguggaguuugaggaccacagucuuagagcaucccuguuauagggauucuggggacuaacaagaagcuacagaccccaaacuauuucagauguaguuccagcccuccuaagcaaguguuagcucgaaccuucucacucuugcucagauucauagcugcucaccuuucagaagaaaugacaaugcugaaagaggaaaccaaggggacaagagagauggcagccaucccaacagcugucuuguguugugccccuacugugugccagacacuguccuaagcacuuuacuuauauuaacucauccagcucacaaccaacaaaauggcccuaagaggccucugcugauauccccguuuuccaaaugagaaaacuguccacggggucggucaguaacuuguucaaccugggaauggcagagcugggaucugaaguccgggagccuggcuccguaggccucuguuuaagccacugcaucuguugccuuguggaauguucuuagaacuguaggauacugguucccacauggccgagagucuucucucacuaguucgugcuccauggugauggagaagcauaguucuaaucugucauucuguugcucuggagccuacacagccccccaucgcaucuggagggagaagcccagcuccuuagcacagcaccugagaaauacccuuuacagucuggccacuggcugaacauucuuucacucuccaugccacacugcucugugaguaccaucugaagguccucucccuuuucucugucuucuaaauguucacucuucaauaucuaacucaaauauccucuucucuaacuuguccaggaagaaugaguaaggcccuuuccuuuguuccccaggcucuuaguuucuccaucucuaaucacguagauuacagcccuuucuuugguuuucuccaggggaccaaggaguggggcucugccuuucucaugucugcucugccuucacggucccccacagugucuucaguggauggccaaccucucaugaacaggauguccucuugucugagguucuacuuuguuccagccauggagucauacucucuuuaucuuuugacuauccaaagguguucuguuggacgacugaugccuuccuccaagguacuuugggcucccaagugugcaguugacauuugcugugccuucuccaccaggcuuuaguuuuugauguaugcugagcuucaguggagauuugcuagccuugggcuuucuguguucuugaaucucucagaguccagaagaaaaggaaagcugacacuuucuaggaaugaccugugagaagagagguuggugucuugcugcuaaguuccgcuugauucugaacuaagucaccaugggccagaggaggcagggauaagaggagugguuucuuggccaccagaauggaaacguuuuuguuuucuugugugcuuuuguggaaaugguggcaguugcucacuaaagagaacuaaaacccuuuuacuagagccccaccaggucugaagaggaugggcgcgugggagccauuaucuuguaaaggacgcuauugagaccuugcuacugcugcagugaagagcacaggaaaagccaagcuuaaaaaacacugggcgaauccuaagaacuuuucaugcagaaacacaugcaugaugagaagagaaucuucauuacaacauuguuugacacagaaaaacgagacucagcuuaaaugcucauuaguuagugauugguugauuaaguugugauaaaauggaacacuaauacagcuguuuaaaaaauuaguaaaaaaaaaucaguaugugagaugaugcaccuguuaauuaacucaacuuagccauuccacaauguauacaucauucaaaacuucacaucauauauuauaaauauauacaauuuuuauuugugaauuaaaaauuaaucuaaaaaaauuaguggcuauaugaaguaauugggaacaaucuugaagcuauauuaacuaccaaagagcaaagucaaccuuaacaaugcugacuuuuuaaagaauagugccuagaacacuguguggaguaugcuaacagcuacacacuaaugcacagccaccaaccccagaucaguuacgugaacuucugcauucacaaacacacuuaacacacucuguggcuauugccucuuuacugaccuguaagucaguucuagaagacagacgauccaugaaggcagguccuagccugcccauuugcauugguaucuccaaggccaagcuagagaaggcacacaauaggcuuuccacuaauauuugugaaugaaugaaugaacagagagaggaguuuucuuuccacaguuuccuucuaccugcuacuccuugagcauaugaggcuggaaucuaagcccugaggucacucacugcucuccuggguacuaucccuggccucccguccuuuuccuugagcuucugugcucugcaaggcuuucucauuauccuuuaggcuacagagaaacaaggagacgggagagccuugaaauggaccuucaagauuacaauguguagcugacauugucaguuaaguugggcagaucugacuucgcugauuaaguggauguaugagccgauccuccccagaagcugggaucagcuuccccaucugauggugagucagaccugcugggguuuggguccucgcuccagcauggcugccugugugaccuuggccacuuuacuuaaccuugcugaaucucaauuuccugaucuguaaaggaagcuaaaaaugccucucuugagguuguagugaggauuaaaugugauagcauaagugaaagugcccuuugaagaaagaggaaggcgaaagcgcuuauugugucaggagaaauguguggagagcccccuguuguucucaggugucucauccuucccagggaaaaauccccaugccaagucagaagagguuauaauuuggcucuuacucuuuuauucaggcacuucuuucggcugcccaggguuuucagcuuaagcaaauaaauuacccuucuccacuggacucuguguucugcagccagccauauguuuaagcuugauagagauuuuuaucuggcuugguaauauuacccagcaagggaugacauuucuuaucagaggcccugaggaaucagagauaggagcccuuucuuuuuccuggccgccaggccuccaugugcagggcuggcagggaggcugggaggggcuggcugggucugguagugggcaucagcuggcccucauuucuuaagacagcacuucuguuagcugaccuacacagaagcaggucauuucgagauguuugcgucuuggagccacugauagaagcagggcaagggagagugaaugaggaaggaaggcgggagugugaugacgcaugcccagcuuugcgcggaggcagagcacuugccuguguggggcccugcccuucucuugagaggcaggcgggcccuagcugcagcgucaaggucuggggauucuguggcucuguagggugaagggcacuggagaccuaccaggggcugggccauuggaguggugggugcuggggagcuuccgugggccccuccagguccacuccuugcucuucucugccuuguuuugugcccagaaggcugaccuguguggaugcauuaucaggguggaugcaacacagggcugccaugcucucugguaucaguuuggaaggcacuggcaggaugggaaggcaggcggggagugaggucagggggccuauccuuccacugccucccugcugcucccugacugauucagguaagguuuacaccggggcucuagguuugaauuuugauucuggcauguacuugcugugugauauuaggcaagugguggaaccucucugugcguccgacuucucaucuauaguaacgcuuuugcauuccauugaucucuuugccucucauuugcccugaaugcugaaggaaaggacacugcuguauccccugagggacugucugagcccaaaguacacuggggacaagggcuucagggugggcaaggagaugaccgaugaucacgugauuuggaacuauagccuccauuggagacacgugcucugggcucuuucccuccugaguuuugggaaguccuggccugugcagccuaauucucaaguacuaaucuugcaaucauaagaagaggaaggagaagugguuuucccucucccuggacccauuccagccagcaguuccugacuuugcuuccuuccuguuggugcccacucuguuuccuuccaucccuuccccaaccucucccaucccaugccucauguugggcaacuugaguuuaacugucucuucuuccaguggccaaguccaaauucugaaagcacaguucugaccaugucccuguccaacucaaaaacaguagcuccgugucacccacaggcuugaagucagaccucucagggggcauuaaguccaccgcaacaucacuccagccugugaauaaagacugaaugccuccgagccucuuauguggggaaucaguucugguaaacaggucucacuucuugucuuuuaaacacuacuugcuuuccuugacgucugugcuuugaucccauuguuuuuucucccuuggaugccugagagauccaugggcucuggcuucagagagugcuggguucagaccucagcuccaacaguugcuggcucugugacccuaggaaugucaccucaccacuccaagccucuguauccuugacauuaaccugggcugauaguuccuaccugcaggguucuugugagaagaaccugucuaaaggcuccuacuggggcuugacuugucagauaaaugaaugggguuuucccuaaccuucuaauugacuaccccacugauuauucaaacuccaccuguccucaaguuccauuccaucauucacuuccucuguggguuuuucugccacaaagucaucuuccucuguuugaaagacucuuaguuccucauguaugacagcaagaguggaccucaucucuuucuuuuugugucugacuucccagcacagucucaauuucuucagggcauugacugugguguaagauucucagcuugagcacuggaaccauuuaugggacgauugaguauucaacuccaagagaaugaaagagagucacuuguucuuucauugaacgaaauugauugagugcacaugauauguugugucugugcuucacacuggaguuguaaggaugcauaaaaugaagauucugucuucacauagccuaucauccagugaggagguugcauuauugggaaucugugccaagccuggauugcauaagacauagguagcugagaaccuggugcugacuggggacugggggaaguucugugcccaaggagaggaggacucuucccuucagauggaugcccauaauuuuaucuuuaacuuuuaagaauuuggcuuuaaugugccucaaugaagaccuccuuauguuuaauaaauuacaaauuauuuggacuucauggauugagauguuuauuuuccucuccagauuuggagaguucuauguauuuuuuucuuuaaauaaacuuucuaucaccuucuccucugcuuuuauuccuccucuugaguucccauaauguguauuucaguucacuugauggugucccauaagucccauagguuuucuuuuucauuuuuuuuucuuuuuauucuucugacuaauuucaaauggccugucuuugaccucauugauuccaucuucuggucgaucaagucugcugcugaaguuccuuauagaauuuuucaguucagucauuuugcuuuaccaccagaauuucuguuugggucuuuuuuuaugguuuaucucucuuuguugaacuucuacuuuguuuauguauuguuuuucugauuuuguuguuuauguucucuuuaaguugaguuucuucaagacaauuauuuugaauucuuugucagacaauguauaggucucaauuucuuuaggauugguuacuggugcuuuaguuuguuuuuuagucauguuuccuugucuauuuguaacccuuggggucuuguguugaugucuacauauuuuaagaaguagagaucucuuuuauucuuuaccaauuagcuuuggccaagaaagcuguucaccagucaagauauuuuggguggauuggcuggcagggucugagggcaaguuuacugcuggaauucuuaagcgggcuggccuggugccugaguccauggguacaggccuagauucugggucccugggggccagacuggcacugagauacagugggauggcuuuauugacuguguucaugucuguagcaugcgucugugaaggccaaccugguacuaggaucuacacugauguugggugcuuacuucacucuccuuccuccacaugaaggguuucucucuucaugcugcacugugcugucuugggggaagggugaugugagugaugugaaacucuuauuccuacccuuuucaaugcaucuuuuauuauuucuaugcuccacccagcugcuguaauugcucaucuggauuucuuagcucuugugaagguauauuuuucaugggugguuguucaaauugcuguuucuaugaagggauagacacuggagacuacuauucugccaucuugcucacauuacucuucucuucauaguauuauuuaaaaugauacauuuaguuuuguuuauuucacaucuguauuccuucacuagauugggauccuguaaggggaagaaugaggucaauuguguuuaccacagucauaacaauaaaaaccagugcuguugucacacuaugugcagggcacaguuuuaaguucuuuauguuuaccaaauuauuuuauccucauuagacccaacugagauauacugucacuucauuuuacagaugaagaaaccaaggcacacaaaggcuaaguaauguggucuagcucuccuaugaagacaguagaugguaaaaccaggauuuuaaaccucacaguggcuccaggauuuguguaucuaaccacucugccagaccuuucuagugcuuucuucuaguaaccaccccagcaaagaugcucagcaaauggguggugcaugaaacaaagggucauuauccuauuucuuggguaaguucucacugcaguuugugcucugggcacagaguuaacagcauaguaaagaggaggggaccuggaucuaggaauuuaacacagcuagauugagaucugagcucacucaucacuaagugacuaugagcaaaguguuuaacuucauuaagucuugguuuuguuagaucaacauggaagaaaugcauuaauaauuuccuauuaaucuuacauuaaugguggaaaaaaugagaguauagauuauagugggugcucagacagugucaucugccaucuuggagggcuauauauacauauauauauacacacacacacacauauauauguauuuuauauauauuguauauauaauaccuauauauguguauuuuauauauauggguauuauauauauagguauuaauauauauagguauuauuaucagcuuuagcuuuuucauccaugagaugagaauuugauguaguccugccugauguccacacaggcuccucagaauggcuuuguuuuacuagagauguuaccccuaggaaacaagcucaaucccuugccccucaguggacuagaggcagcauguuuaugagacaggaaaggaugugagugaugugaguuucuuagcuggcuuuggaacagaacagaggcucuuuacgaugaugccagugcuccuaauuaauuaucauaacaagucuccuguucucagcaucugucagcagguacagcugcaccagcacaguggacuggcugagcaaccagaaggguuggggcaaggccaggccagggcagccagccuguaucuccaagugcccagcugguuccguccuuguaucugacagggcccucugaucuuccugcauacaauggauugcagggaaaaagaaacuuccuggccugauugacacaaauuuguaggaaacagcugccuuuaguggggacaaaaaagcaaaauccagugugagugauaaccucuugccagucuggguucuggguugcauaucugcuggugacuauaggagguggugggaggaugugaauuccuacaaaugcuaaguuagcauccagugugugacaacagggugagaaucuccuauugguucucccaacaaauaggaagagaagagccugaguuuuggggguucccaaguuuuugagguuucaccagugacuuacuuuauugccaccaggaagugcaugaugcacucuguaccccacuuucuuuguaguggcaaaaugggauuuguuagauuuuuuucccacaguugaaaggagguugcuauggcaaugaccugugccuaagaugaaguugaagagaaguauggaaagaacuugacaguucuuugcagaacagcaagcuuacauggagaacugaggcucagagaggugagguauggcccaaggucucacagcaaguugaggguaaagcuggcuccuggaaccaaccauggcuuccuaauuguugccauccucaguuccuugcaccuguugauugaaacacugauggccugcuucaacugugucaguucuccuugucuucugggcucauuccuugauggguucaauguggcugguugccucuugccacaugauuugggcacuccauguuuaaucugacagauucugacugcaguuuucauuuauuuugcugcuugugugaaucaugacugugacugggaaugcugggcccagguuuucagggacacagaucacagagugagagaaaugccaugugaugguuaauuccaucugucaccuuggguaguuacccagguuuuccuuaaacaccaguccagaugucacugaagguauuuuucagaugagauuaacauuugaaucagcagacguugaguagagcacauuaucuuccauaauguggaugggccucauccaaucaguggaaagccuuaagagaaaacacaugagguucccuaaggaaguagaaauucugccuccaggaugccuuuggauuaaaacuacaacaucaaggcuucucuggaucuccaucuugccaaccugcccuguagaauuuagacuuaacaguccucacaauugugugagucaauuccuuauaaucucucuaugucccuacagacacacacaugcacagacacacacacacccacauacacacacauucuauugguucuauuucuuuggagaaccuugauauuacaugcaagcuuuguguuuauuuguuuuauuuuuauuuuaaaaaccuuggacaucauaauaugcagacuuuagaaugagacagauuuagguaugacuccaagaacugccaaugcugaggguaaguuacuuaacuuuuccgggcuuaagucuccuuaucaauaaaauggaaauaauauuaacaccuccuacauuaaugccaauaaacacuaaacaagacaaugaauguaaugcacuuaauacacugccuggccuagugcucaacacauaaugcugcuuauucuaaaauuuauacuuuacugcaagccauguagcugcaugaaucaguucucuauuugcugcacaugaaaccauaacaaaauguuguggcuuaaaacaacuuauuuuucucauaguucuauaaguuggcugagcucugcuggugguucuucuguuccacaugggagcauuuggaaucgguguguggcugcauuaaauuaggagucuggugcuucagcuggggugacuggaguggcugguggcaucugucuugccaugaggucucucaucacgagcagucuagcucaaccuucuuuaugguagguuggguagcugaaucccaaguggauagaugugaaaguuuccuaggacagaaucauuuccaucaccuuccccugguaaagcagccacagaccagcccagacucaagacagggaaaccaacuccaacucuugaugggagaaacaauaugcauguacagaaaugggaggacucauaucacucacuacuggacacaguccaccccaggcacaaguugcuuuucagguuuaugacucucagcuucuacucugcuuaaccucuuggguugguuuguaauaauguagugaccucugaacagaaacucuggagccagucugcccuuuucaaauccugccucugccacugacuagcuaugggaccuuaggugaguuucuuauuuccuucaugccucagguuccuuauaaaggaaauggggauaauguugguacugaaguggaacuugugugaggauuaauugaaauaggaguguguguguauucaugccuauaugcauaugcaugccuguauacaugcguucauguauuuacauuugaaugugcagguauguauacucauauaugcauacauaugugucugcguauacaccuacauauguauauauuucuauauacaauauauauucauugcguguauacauaaaauugcaugcauagcucgcacagauguuuccuuguuuauacauauguuugcagccuguacacgagucccaggcugcuuuaaccugggcccugccccaguguauuugagaaaauuuuaucacugugcuugagaacuggucuucagcuggguguugaacugggaccucccgaggccaaugccuagugccuucuccaccacacgaaugguugccaagacugcccuugggacgcaucagaaguauaucagugggucuugguaaaaugcagaauccugggccccaccccaggccugcugacuccaagagauugaccuagaaucugguuauuucacgaguugcuccggggugauucugauagaaacgucauaggcgcuucugaucguggcgggucccuggcagcccaugcuugccccagcaguaucuucuuuacucucugguuaauucauuuuccuuucccuccccagaaaaauugaaugcauucucuucaugcacaaccaugaucucagaggagugcagaacacagggccaguuucacauuuggaguuuuaguuuaguuuagcuucccgcaucauugagaaagacaggguauucucaccucaccacuuccaggcugagcugacgucaaguuuagcugugagauaaccagaccacccugagcuucccucccauucacagugagcugauuuaccccagguccagcuucugggugauaugaccucauugcuuuguaacuuccccgaggccuucccacuaagaaaauuacaacugcucuuuauugagcauuaauacuguauacaaacguugcuuuucuuauuacuuaccauguagaaaagguauuauuaccccgaagcuaagggauaauagcuuacaaaagggcacagaacaaggauucaaacccuuaugaccuaaccggaaaaaccccuuucucuuucuacuauacuggcagggagauauguuaagauuuguuuucauggccccagguccuaaauucuuccuaaauacuucucuuuaauauaugugaacaaaaaccugcagggauauuuuauccaauuucaaauguacagauugucuuugggguuacaaacaagcaccagaaagucaggagccacccuggcacuggcugacgugggagguacagaaugagguguccgucccuccaaggcacggugaccuagaaucccacugcucacugccugucucuguucagccuuucaguucauaaacaugcuuuccucccugcauuuugacauccaucaucguuuaaauuccaggucgucauccuuguagaacgagguucggaucucggcauuaaaucucccccacggugugugcggggccuugccauuugcagaacacuuccugagccuuggcuuauccugacagcugcgagagguuacccuguuugugagugaggaaaagaaaggcucacauggugguaucauuggccuagcuuucaauccaaacacuagucuuaccauggauaccagaaggucuuccgucaaauugaucaaaagcugauugugugaggguguaagccaacccugagaucaaauuaggguaagaggcuggacccuucaucaggagcuggggcuccucucugcaaauacuguagaacaucagcgucacugaaugaauggaguugguuaccugaccagcuuuccuacucaacauggagcucugucugucucaucucucucgauucuucagugcauaacccaguuccuagcuugugauggauccuuccuaaggauguauuggguaaauuaaugaauagugauucgaccuaaccaauuaaaucccugggaguuuuaaacucuuguccaacaucaguuuuauuucacgucuuauuauaaaacaguacauaccucuuccagaaaaagugaaaaacccuuauaucacuuagauguaacuaauuaaacaaacugaugcauguguguguguguguguguguguguguguguguauaguuguauggugguauauauauuaguuuguaaauagcucuucuacuaaauacaugauaaauauacuuugacaucaucauguguacuucuacuacaucaccauuugacugcuuggacaccagacuucaccguuguucagaccuaaguggcaaaacccuuuguauuuuucuaagugucuaggcagacauuuaggaaaugaauucaacuuuggcacuauuauaaacaguguugguaugaauauuccuaaagcuaaaucuuugugaauauguuuuccuacuuuaugaggacauauucccauaaacuagaauggcugaaacaagggcugguuaggcuauugagguugcggaguuuccuuucaaaaaguggggaccagugucucccuccacccccagcaugacagacgaccauguccucgagcccuccacagcagggcuucaggguggauuuaccuuuccagccucaucuguuuggcacuugguauugcaccagacgcauggcuguucucaggccaucaucccuucuuuagagggucuccuucacugcuuacuguguagugagugcccuuuuauuccuccuuccagcccuugcuuugugcaacacacaucucagaugaauuaaaucaugauuugucuuguuuggaggggagcccaagugagucaguucccuguugugucccgguggccagcacauauuuuaucauggauagaagcaauggcucacgucagaaagaccuggauuuacaaugacucugcuucuuuucucgccugaguccuggcuuuuucaugugagaacccccuuuguacaauuaugauaagguuugaaugagauauggcagggaaaggcucaauacgcagcucaacacaggugaaugcucagccauuguugcccaggcucaauggcugggcagggcaguugacuauguguuggacacuguuuacguguccaccagggguggucaaacuaugccucaugggccaaaucugugcccaccacuguauuuguacaauccuagugugaaaaaugguuuucacauuuuuuagugguagugaagcaaaucgagagaagaagaauauuuugugauauaugaaaauuacaugaaaugagaauggaaauuucaauguccauaaauaacauuuuauuaaacauagcagacccuuuuucuuaacauaucuccuauggcugcauuauguuacaauggcagagaugacgaggggcaguaaggccagguggccucacaaugcccaggauauugaguaucuggcacuuuauaggaagaguuugcugaccccuggguuacauguguaagcucauccaaucccgcauaguguuggcaguuaucauaccauccccauuuuacacauggggaagugagaugcaaagagguucagaaacuaccugaagccacaugcagcauggaagugguagaguuggggucuuguuccuagaacugggacucuucaucguucagccauaggguaagucauuggucuuugcaggugagggauugugaggcaggaaaaaagaaagucaugcacuaauguaugguagaauaagaauuuagaggcugggcgugguggcucaugccuguaauccuagcacuuugggaggccaaggcggguggaucacaaggucaggagaucgagaccauccuggcuaacauggugaaaccccgucucuacuaaaaauacaaaaaauuagcuggguguggcagcgugcaccuguaguccuagcugcuggggaggcugaggcaggagaauggcgugaacccaggaggcggagcuugcagugagcccagauaaugccacugcacuccagccugggcgacagagugagacuccgucaaaaagaaagaauuuagaaccagguucguuggccucaaaguucuuggucucgcucucaugaugagcuccuuccaccacucuagucuccuaggaucaccugcuaaacgcagggccagacacacagaggcauucaagauaucccuauaaaugcagccacuucauagcaaugucaggacuaaaugugguuuuguacuuccuacuaaacaugagcuuaauaaauguuuguggaauaaacagaugaaucugaugaauaguuccuggacucucggaguuuaaacucugggaacagggcagggacuccugaggaaagcagacaacuccucaaccuucucaugggagggaaggagaccuucuuuccugaacaccaauuaugcuucccagguggcaugggguccuuaggccacaaugccaaacacuuuugcaguuaaacuuccgaugaaggaaaacuggucugucuucucugcccauuacaauugucuuuacucuuuuugauucugaauguucuuuuuucuuuaaacagcuuuguuaagauauaauuuacauaccguacaauuuaccaauuuuagaauauuuuccucaucucaaaagaaagucuguucccuuuagauaucaccucccaaucucccuucuauccccaguccuaggcaacuacuuuuuuuuuuuuuuuuuuuuuugagacggagucucucucugucacccaggcuguagugcaguggcgugaucucggcucacugcaaccuccaccucccagguucaagugauucuccugccucagccucccaaguagcugggacuacaggcaugugucaucacguccagcucaguuuuguauuuuuaguagagacgggguuucgccauguuggcgaggcuggucucaaacuccugaccucaagugaucugccccuuucggccuccaaaaugcugggauuacagacgugagccaccaugccuggccauggauucgccuauuguagacguuucacguaaauggaaccacagaauauauggucuuuugugaggaacuucuucacuuggcauaauguuuucaagguucaucuaaguuacaacauauacuucauucuuuuuuaugcccaaaguauauuccauugugugaauauaugccccauuuuauuuauucauucauuaguugauggacacuggguuguuucuuuggggguggggcuguuaugauuaauucugcucugaagguucguacaagacuucguauggagguauguuuucauuugucuugggcauguguauaccuaggaguggaauugcugggucauaugguaacucuauguauaaccuuuugagcaacugcuaaagucuuuuccaaagugucuacccuguuuuacauucccacuagaagcugcucguucuugggcucauuauucguguuuaucuuuaaacacagaacgugacuccauucauaugacggugcuagaagucaguacagugguuuucucugggacgauggcagaggaaacuaugaagggcccaggaacacuuucugggaaagggaaauguucugugucuugcugguuuggugcauuugaauacuugcauuugucaaaacucaucaaacuguuuauuuacaaauugagcauugcacggcaugugacuuaugcccgauuuuuuaaaaaaauguacaaaugaaaaaacauagaaagagaggaaaaagcaaaauaucuguauuuuaauuaucacaugaccugacuggcugcuuaucuuacccaccuucccauggacacagggccagugccuggcaggcaaggccacgugcaagaaaagcucuuaauugaugugauuaacuacaucucaauagggagccugguuaacaacaggggagugaaaaggaggcuauuuuucacucucccaacuggugaaugccuggaaggggugaugggggcacuuggagggcugcccccugcggugcagggggagacaggacagcugcuuuuuccuuuggcauuaagauaauuuuaaaaaauuauuuucucucaauugcuacaaaaccuacucuucauuuucaucuaugaggaggaagaaaccaaguuaauuuuuguuuaguguguuucugaaggccacauuaucuaccagaacacaacauuuccuaggauacucuuuaacccuuccuaaaugcaccuguucagaggagcaggcaacaacaggaaacaaacaaauaaaaaagaagugaaggauuuccucuuucccccuuagaagguggaaagaaauguauggauugacauaaauucacagaaggugagaacugggcaagcaaacacauuauccauguucuuaaaaaggcaaaauuauauaaauuuugauaaaauuucuaaaauaguaucaugucauuuguaggcuagaaaaaauauguauuugcuaguaaaaauauagaccuauaaaaacaccauuacuugggggaggaugugguuauuuguguauuuuuuuucuuauugcuaaucugugauuuauuuuuuuccaauaaccacuaguugcuugugaauuaaauuguugagaaauuacuuggguuguuauuucugauuugagagaucaguuuccucagucucccccuuucuagaacaggcuuccuucucccaucccuccuguguuuaaagcuagggaacuuucaggcagcacugcacagggcacugaaugugaacuuugugguuagcugggucaggguuugaucuugcaguaucuggggcaagucacagaucuuuucuguguccugguuuccucacuggaagaaagggacagauaaugcucuccccaguggauugaugugagacauacuaggaaaucccuagcacaguacuuggccuuuugaauuaguuuacccuuucuuuccaaccuaccccuuuauccuggucuuuccuggcaccaugaaaaccagcacucagcaguacaguuugaugacuucuuauugcuagguuucaucuguaaucguugcagaugcuuaaauacacacgcaggccaggcacaguggcucaagccuauaaucccagcacuuugggauucugaggugggaggaucacuuuaggucagaaguucaagaucaucuuggccaacauguuaaaaccccaucucaccaaaacuacaaaaauuagccaggugcgguggaggacgccuacaguccuagcuacucuggaggcugagacacaggaauugcuugaacucgggaaguggggauugcagugagcugagauugcaccacuacacuccagccugggcaacagagugagacucugucucaaaaaauaaauaaauaaauuuugagauuuaugugugugccagacacacacacacacacauauguacacaagcaauuuuuguguguguggcucaagccaggcagagaaagacaaauacuaaaugaucucacucauaugugaaaucuaaaaaaguugaucucaaagaaguagaaaggagccuggugguuaucagagucuggggaggggguuggggagauauuggccaaaggauauacaauuucaguuagguaggaggaauaaguucaagaagucgauuuugacuauaguuaauaauguguuguauucaugaacaaggcuaagagaguggauguaaaguguucuuaccacaaaaaggauaacuacaugagguaaugcacauguuaauuagcuagauuuaguaauuccauaauguauccacuguguccuucaaaacaucguguuguaaauaguaaauacauacaauuuuaucugugaauuaaaaaaaaagauuaaagaaaacccccauccccacggaugaguuaagacugaucacugacggagcuaguauguauuacuaaccaaagcuagaacucauugccgcaagcaucugggugacagcgcuauugauaguccuuccugcaguacccgucccuggcagaaacaccuucagucuucaggcugggugcccaaugauaugcuagaaauauuaacuccuccuguaaaucaccagaggggaugcagucucagacugaguuugaguauuguuuuccgggccuggaggaggggcucagcagagagcgauucaugguuuuacaaaauguauuuacucugguggaacgugugggcucacgugggcagaagcacauuugcacacaugcaaaauguaagccaugcaccgucaucuuuucacccuuguuuggucaccuuuuaacccuccuuccuccucccuaauugccucccccagcccauuuccucagccucuuuuuauggcagugguuuucaaaccucaguuugcaaaugaucaucugggaaaugugcuauaauggagauuccuggguucccccaacagauuuucuaauucagugguucuaggguggggcccugccugcaaaugacauuuuuaccgaacaucugagagagucccauuugaccaguuaagugcuauaaacagaaugucugggacuuacugauauuucaaagacccacaaacaaacuugagaacaaacauguaaaauucuuagcugaaaaauaugaaaacaaaacugcaaaauagaaauaguuauacuguauguuuuauagaacuuuaugucaacuugucaaguucgccucaacuuuuacaguuacauaggaauuauuuuuuaaugaaggauaugagugcaauuaaugcauuugauacaaugugugugaggccuacaaaagccuuauaaaagcugucaccccauggacccugcucugagaaauaugcccuuagaugauuucuugcuuguagcauuuuagaucuggaaggccccuuagaaaugugcuucuucaauacccagauuuuacuaucagagaaacagaggccuacagggggaaggaauugcccaaguuuacacagcaaguuccugaagaggccagacuagagugaagcauuuacaauguacgugcaugugcaugcgugugcaagggcugguuacaucccucucagaagucucuucuuuuuuauuuuuuauuuuuuuuugagacacaauuucacucugucucccaggcuggagugcaguggugugaucucagcucacugcaaucugugcuuccuggguucaagggauucucaugccucagccuccagaguagcugggauuacaggcacacgccaccacgccugguuaauuuuuguaucauugacaggguuuugccauguuggccaggcuggucuugaacuccugacugcaagugauccacccaccucaaucuuccaaaaugcugggguugcaggugugagccaccacgcccagccagaagucucuucuucauuucucuuucacucuggcuguuuuuuucccuuuggucccuauguucucaggccagucugaaacuuggcccugaacccugaggguaagggagaaagguuaguggggggaucucaggguugaaaucaauaggcauaguaucugucaagaccagucuucagcuucaagucuucagcucucaagucccuguagggggaaagagagaggaaaugcaccaaggggggaagaagugcugagucaugucacuucaagcagacacaaaaaacuggcuaacuucuuagcagcccacugaguuccgacaaugugcuggacauugugcacacuaaauuaagcugacggagucccugcccuguggaaccuuucguucauucaccuacucauuucacaaauauuugcugagaguccuacugugugccccacacugccaacaaggcagauagggagcuuagaaccuagucugugacacaggcaacaacagaugacagauccauaaacaauuaaggcauuucaguuaagauauuucagauagugacaauuacuaugaagaaaauagaagaagauaaugagaaggaaaguggcugggugcagagcaugccauuuuaaaauaaguucuugcuaguugaauggaugaauaguaaauuccaugugaccugaaaggggauauacuuaggccauuuauuguuucugacucugccuuccacaggguaagacugaacuuucuuacccauugugagcaauucuggccaaggaguagugagcagaauugacaugucauuucuggccuucauguuggaauucuagugagaaacccuccagaggucauucucucuucuggccugcugcugaucagugcuauguguagaggcugccacguuggccuggucuggaugaugcugagauugagcaugaucucagguugaccugugaugaacaugcagcugaaaaaagaaaugaaucuuuguugcuuuaagccacuaaaauuuggaaagacauguuagugcagcauaacagcgucacuucugacuaauacuaauacaaccugcaaggcaaaauaaguuugaacugucacucuggauccauugguagggguuuucuuggcccugaaugggaaacaacucugaggucccaacugggccugguaggaaagugggcucuaaugacuugguguugaccaccacgccuguaggugggagguggcagcucugguaccacaugccugucuuccuacuuuaacuuucauaaaagguucuuaccaggaucuuuuucuagucuguccugagcaucuauccucacaaaugacucucaucagcugcacugcuuuauguggucuucacucgucucuuuccuagugcagauucuucucauuggguuuuaagguucucaaaauucugacccuaacacacccucccucaggggacuucuugcuggccacugagcauccaauaccccuccccugcucuaggccuucaucacugaaugcuauccuuucaccccacccccugcaaaccuaccuguccuguggguauccuuuaaaucuggcucucagaggacuuuccuuugcagccacagugacccugcucuccugaacccagaccacacagugcccacacucaauuaaucuuugacaaucuuguuuuaucuuauacuucauugcugcaugguuaucuaacaauccucauguugaagucucgacucccuaacucgguuauacacucaaggaauggccuggguuuugcaauuucucacugcaacgucuuggugauaacaggcacuugagaaauaaguuuuuaaagaguugauuggauuggugauguggggcuagagaguagaaggggaaaacugacguggagucaucuaaugggcauuguccagcccauucugccuguccugucuccaaggccaguccuuccuuccacggcuggcacaguccccgugugauguccccuuccugaaaugguuagacuucuaaucaaaaggucuauauuggagcagcucaguacaagccauugcagugggaaacucagaaaaggaacacacaggaugucuuggcaggaugagacuaggcagcaauucgacuuuaggggaaaggggaggcuuccugggggaaaggauguuuaggcucuucccagaaggagguguggggauuaacccaacagaggagccagaggaaugcucuguggagaucccaacccaggccugggcuggagaacuggaguuaggggugagcuggagcaaccugugaccagcgaccagggagggggcuggaggagugauguggggccucccugcuugcaggaaggaguuugaccuuauccuuagcccugagggaugccccagagggguuuuaaggauggaagagacugaucaugcugucuucauguccuuauuucauuuucugccuuuccucuucugacucugcucuuauuuuucuauucuuggacuaacauacuuuguguuuuuuuuuuuuugguuaucuuauuugaaaaucaauauaaccacaucuauaaaaacaauuuuaaagaaugcccaaaucccagagccaucaucucacccaauuacaacucuugccuucaugucugcuuggccucuugcccccuguuccugcugugcaugcauacauuuuacagggauguguccucaguggacgugagauuuuuuuuuucuguuuugcaguuuuuuacacaaacauuuucauuuguuguuccuguuuuuccuucuuucccaggaggcuuuaggcucccauucuccucucccuggcuuucucucugucccauccaccgcucuacccuucaggccugccuauaugaaagaggucucuuucuaugcagaaaacucacuuuaacaagaugugggugcucuuacacagaccucauaugaggaaaauagcacaucagugaacuuggggucccugggagucacagugauguucaccagaaaaucagacaacgguaauguaccucccccaucagguugccaaaaauuagaauagguuuuguguuuuuuguuguuguuuguuugagacggagucuugcucugucaccaggcuggagugcaguggugcgaucucggcucacugcaaucuccgacuuccugguucaagugauucuccugccucagccccugagaagcugggauuacagguacaugccaccacacccagcuaauuuuuguauuuuuaguagaaacgguuucaccauguuagccaggauggucuugaucuccugaccucgugauccaccugucucggccucucaaaguguugggauuacaggcgugagccacugcacccggccaguuuugggguuuauuuuaagaaugugucagagccuggcauaugccuccauugccgguggcagcauaauuuguucuuuuggaguaacaauuugucaagaggcaucaaagccuuacuuugaccuuguaucccuauuugggaaguuuauuuagaagacaguuuccagaaaaugagaaagcugugugacaaaaggggguucuugcagccuauugcacuucagggcaaauuagaaacaaaguggacuccaggguccuucuguuucacggaaucuuucccagacaucugaagggucaucauggagaagaggcggcaccuuaaggacagcagugacaaucucugauguggcaauuacauaagguauugcguccuuccugagauuacacaaaaccuguauagagagaggcuagcuguucauuggaaaaaugaagguuuugccuacuuggaauaauaagagcaugacagcuucuuuuuuucucuucuuucaucucaucucuucucuuuuuuuauagcuugucuuauucaguuaaacuucagucauuaccauagaauaaaguaaaaggcaauauauauugaauguguaaggcccauguuccacuaggaaugacgucacgaaaggacagccugacccucgcugcuguaucaggcaugggcacagcgcacacugcugcacucaggggucagagcaggaggugcuccuggguuucaugaucuugcuuuuugucccucauggucaugugucauuucaucugcaccauaaucgugcuggguggguaacguaaauccccauuuuauagaggagagagcugaguccuuagggcuccuggcaguugccauccaggaagccccugcuacguuccaagcuuagaaucuccccacacuaucuccuuggaugcucacauaacagcucugcagagccacucuucaaaccugcucuucaugauggggaaacugaggcacugugauuugccaaagagccguagccaguaaggaucaaggcagcauucacgccuggguucucugacuguaaaucuggcuguguuuuuuucuuucgaauuuuauuaugaaugccuucuuuguucauugucauuauuaucaucaucauugaucucuaccaggcccccuacccccagccacuugccuccucuguugcaagaggagaugaggagacaaauguggaauuuuuauucccauucccuucccuccuccauaggcagccacuccagugugcuugcugcaggcccugcaugagggccugcaugaggauccucccugucuuguucugauuggguaucuguuuuuaauuuagacaaaugggauucugcuauagaucucaauuugguucuuuugcuuacucaacacucuuuuucagagccagucuuggugcucuguguucaccugguucaucugaggagcugcaucuacccugcccaugccauagauccugcccuguuugcuucuccuguugcugcuaguggacaugagguaaccacagccuaguucugugauaagcucuucacaccuguacccauauggacugugggagaguuucucugauauggacugugaugcgggugagucauagugcacacucacacuuaauuucacaaguacugccagauuguguuccagaaugacuguaccaguuuacacuuccacaggcagugcucaagauuucuguuucccucuguccucgccagcaccugguauuggcagaugcaucaaaaaggaugcauuugacagcucaaccaccucagagcacuugauuagcaucccugugauggcccuuucugcugcagacaucacuuugucauaacagcauuuugagcaggaagaagcaucaggcaggaaaaaaggggcccuuuuacugugacucccuaucuucuguuagggaagaaaauuuuccccagaaauccccaguagacuuccccuaugucucaguggccaaacugggccagguaagcucccagccagucccugacagagauaacaagauugucauggcuguuucaagccagggccaauucuucccccugccauggacuuuuuuugagcacauugcuaucucccuugucccugaauagaacugggaauauuuuaauaaagaagaagagaccaguggcugaucaguaacuuggcagccaacagagucuucuacaucagaguucugcauuugccaacuuuuugcaugcaugcugccucuucuauauaagggaucuucccccacaucuguuugauuugcagagaaugucagaagcggcgagucacucauacauguccauugcuuuggggauuagauccauccagcucauuuuggaaacggcaauucuuuuugccaggcagacaugagacccauuuccacaccagcugcuccagcugagguucccaugcagguucugcgugacagaaaucaauagaaagauucgaagggcagagcaccaaaguuccugcccugcaccaugaugucaaagcagaaugccugcugaggacaggugcagaugaauaccugucagagaguaucacuucugcaagcagcaacuuccccuucuugucagccacguggaugccauaguaaccuuguguuucuggcuagcucaagaaauuaauuuauaggaugugugcagcaggucaugccuguaaucccagaacuuuuggaggcugaggcgggaggaucacuugaggccaggagauuaauaccacccuaggcaacuaaggagacccccaucucuauaaaaauuuuuaaaaaaaaaaagcaguuuugguggcacaugccuguggucccagcuaguuaggaggcugaggugggaggaucgcuugagcccaggaggucaaggcuacagugagcucugaucaugccauugcucuccagccugagagacagauuugagacucugucucuaaaauaaauaaauaaauaaauaaauaaauaaauaaaaauaaaagaaauggaaaccguauaguuauaauuuguugagcacuuaucuuugccagguggccugggaagcauuuuauuucuacgaucucauagauaucucuuggcagcccucugagagcauugauauauuauugcuacaucacaggcuccuacagaauccugauucugacaauuaucagccauguggccuuaggaaagucacuucauuuuuuguaccuuagcuuucucauuucuacaugaagaaugauaauaguauauugcaccugcucacagaguuaauaaacauaaagugccuagaauggcacuugauacuuauuagcuacuauuguugccauuuuuuaaaaugaagaaauugagagguucagaggggucaauuugccaaaaguuaguuauuaaguagcagggccaugauuugaauccaaaagcuucuggcuccgaaacugggcuuuuauccaagggaacaucaccauugcgccccucaucaguagaaucaauuuucaggugaagacucggugacaaagaccacaaagacauaguguaauucuucuaacacaugacuggaucauuucuggaagguggcuggggacauggauacugggccacagaacaagcaugcaugggauggaaaagacacagcgcucaauuccuaauuugaccacucaaucuugcagagccuccaccuccuuauuuuuaaaaucagguuuucauuauaguuccucccagcaaggauuuuaaaagugccuuauaagcugaccaucuccagguuccuuauuccaaaauuaggauuuuauaugucacuuuauauuaugugucucaucucaguuuccacuuacacugacaaaaagucuaagagucauuuccccccaacuccauuuuagucaccgcgaggcucaggaaaacagaauuucagaaucuucuggaagagauguuuccuuucuuaaccaagcuaaauggacuggaggcaggcaccgcugguguuuuuagaaggcugguuaaccacagugccuagcgguuuggggaaaaauaaaucagguagcuuucuguggcacgagacauucccuuaccacauuuguccacuugagcacuuuuauuuuauuuuauuuuauuuuuauuuuuauuauuuuuauuuuuuugacagagucucacuguugcccagguuggaguacaguggugcaaucucaacucacugcaaccuccaccuccuggguuccagcaauucuccugccucagccuccuaaguagcugggauuacaguugugcgccaccaugccuagcuaauuuuuguauuuuuaguagagaugggguuucaccauguuggccaggcuggucucgaacuccugaccucgagugaucugcccuucucggccucccaaagugcuggauuacaggcgugaaccaccgcacccggcccaccugagcauuuuuagauguagaccuggugaugggucugaggggcagcauguucugucugaauggggaucucaagcucagugauguggcuuuaagcaaaaaggauggcuucaaggucuagauuuccuugggagcacguuuuaaccuaaaccugcauaacuaguaacucgaagaucuuuuaauuuuauuguuuuuuaauuuaacugaccccguucucccuccuuuucucccuccaucccuucauuccucccucccuuccuuuugacacaggucacccgauauagaaucacacaccugggagauggcaccagccagugaggcucaaauuugaaccacacacaaaucuccagggguacuugguaaaugcagacuuuugaccaauuuuucggcguggggcugagcaucuacucuagcaaugagcucccaggcaguacugaugccgcugguccaugcaucaacccacuucaacuugugaggaauggucugcuacccucccuagcccuccucaugcgccaacccauuucaacuugugaggaagggucugguccccucccuagcccuccucacacaggcaguugcagauacugucuagaauaccagauugauugugcacacauuugaccuuccugaccauccugggagcugugagaauaacaacaauuuuuuuuucuuuuuuuuuuuuuuuaagaugagaaaacugcuagucagagaugcuaaaaauaacuaggcacagcugauaaguagcaaagaugaaaguccaagugcagaggcaguuccaagucucuguagucuucuccaagagcugauggaugaauguggcccuccugggauggaagguguccuugugcuagucaugaacccaacagaaagcaagugccauuuucucuucucuuccccucuuuaucucugagaucuuaacuuggcugcuucuuuucagaagacagugaugcacuguauucaagugauagccccagcaguaacauugaugcagagaaaauggaauacuuuuuacaagagaccagaagacacaugaagcuagaaaaaggagcccagaaaacugccacauuuugcccauauagaaaagcauaucccgaccgggcacaguggcucacgccuguaaucccaggacuuuggaagcccaagauggguggaucacaaggucaggaguucgagaccagccuggccaauauggugauacccuaucucuacuaaaaaugaaaaaauaaaaauaaaaaaaaaaauuaguggggugugguggugcaugccuguaaucccagcuacucaggaggcugagacaggagaauugcuugaagccgggaggcggagguugcagugagccgagaucaugccacagcacuccagccugagugacagagugagacugucuaaaaaaaaaaaaaaaaaggggggggcuccuucccacucauuucucccauaacauguaaugcuuuuuauagugauuuggucacugcugagcuaucuucauuuaaugugguuuugacagaauaguuggucaggaaaauuuauuuucaauuaaaauaacuuguugaacugucucgguuuugaaaggauuccguuaggauggcuaauuauauagcgguugcuacaaggagauauuugcacucaauuucagcucuuagguaauucaaaucaaaugcuugagauuuuccucccuggagcugugugcaaccaucuuccucucacacugcaggcuucccaugaguuauuuuuagaaacccaaauuuaagcagcaauuuuggcagagccauuucuagucuaguggaguaaaccauauguacugauaaaugcagccaaagaguuaguuucuuuaaaaaguaacaaaaccaucucucuccguucauggggguuauauguuuacaaacugcaaacuauccguuguacuauuauauucauuugugaacucuagcugaagugagagaucauggauauuacuuuaaaauuacaaagauguguccuuuugcaaacuguugucauaauacucuuuuuuuuucaagauggcaggccuuggcagaauugacuggagacucuguuuuggccuuuggauuucccgugaaacauggagaucccuuucuuuauuuuccuacucugcucugauuucuucauucaccagagcacuuguaauauaucucaucaugcuuauaagcaggaaaccuccuccuucuguguuagaacauauucuuguggucaggggcuggauuuuuuuaccuucuucaugccuggcacauaauagaugcucaaauagugcaugaauagaucgaugaaucauuaaaauuauauuucuauuuucuccuuuuuuuaaaaaaaaaucuuuuauuacguaaauauuaaaugauugcauucauuucggaaaaauuaaaaauuuuccacaaaaggccaaaguccuuuuagcucacccaucuucaauccuugucuccucauuaguucuguguaggucauguuuguuaucuuuuagagcacauuccugcagaccauucuaauucauuuaaguguauacgcaugcacauauacacacugaguacuauuguguacaccucugguagaguauuuugcaguuuaccccuuuucacucagcaauauauugaggagugcuauccaugguagccacucuauucuuuuuaacugcuacauuguucuauuguuucauguggauguacccaccuuuuauuuggaccaaauacacaaauuauuuaucugcuuucccauucauuauacuuacagaucgcuucucuuguauaaguugacaaacccagccagguucacugcuaucuuuugguagcuacaacacauuuuaucaaaaucagccacuugccuuagaaauuauaucaaaccaguagacagauuauguaaaauucgaaguguugucagagggaccagaguuuccuuuguccucacagucuagagaaguacccugugcucugggaaccccacaggguuggauagugagugaugcugaccaccacucacucuguguugugacacagugaucuggugucugcucugcccacagccagcuggguuuccuugagcagaucauuucuucucccgggacguuacuucucuuaucugcacaauggacccagugagcagccugaagcucuuuagacugaauaacugggccuacacacugccaccaggauugacauaaagaauguccuguuagcucacccuucacuauauguugggguggggaagggcaauuccugauaaaguuccaagcuccagcccagagcucugagcugagacaaugucucaaagagcccaugaguggcaaggaauguauugucuucagauuuuccuccucuuuccuacuauuuuaccauccaauuaaaaugaauauauauuuuuuucuuuugcuuagguuugucuuuguucuaagcaaggcaguaugaugaugggaaaaaagguuguggaccccugaauucuacuuccaaaguuguuuaauucuagcuguguguucuuaggcgagucgcuuaccuucucugggcuuccgucuauugacaucacaauucccagugagccagguauccacuaaaaugacacugaaaaguugaaaaccacacucgcuuaugagugauucauuuggcauuugugagccuugucaccugcaaauaggucaucucaugaacugaugaggcauccucagagaccacgagagcccaugaaaucuucuuguuucacaggagaauuugcagcuguccuggccccuggugacacaugcuaagcccuucaggggcuucugagagaggcccagagaaggugcugagcugccaugauucacaggugaaguuuucucaccuaggcccugaggcuuugugguggauccacggcaaaggguauuccccugcuuugaggcucaggaccacagaggucacaggaucugauucagaugccagcggguuucccuagggggcccaaugaggcuuuccauguagggcaagaguuauggcucccugcuggguguuucacaugggucagcagacucaaugugguucugaaggugaaaggucaguguaaaugggugugaagccacgugggaggcauagcccaucuaagugucugggguuuugguuccccuagucccagaacuuuguuuuuugccccuacugugaguuucuguuccugaacaccccuuaguuaaguguucccugguugagcagguuucuaccaaaggagaccaaagcucagugcuuuuccgcugcugagcucgcugggguaggugacuaacccucuccuagcaucugcuuccuaaccugcuugggcuucagggggugaaaugagauucugcaauaggugcucaauccacauuucuuuuauuucccuuuuccuguuuuauauggaaaaaaaacucauaauuuuauaagcacugaaucuauaacugagcuuccaaaaacccacccugggcauuuuuucacauuaaccaagauaaaccaaaaaggcaguaccacgaauagagaaaaugucauuaggaagguguacaugauaaauucguuuuuuaaaacaggaauggugaucguuuccauuuaucaagccucucugcaaauuuuucagcagcugccuuccucauuuuaauaaaaugcuugcagaucugguuugcauuuuuguagauaaauguagaacaagucacauugacacucccuacaucugaucauccucccagccaucaauaccauuuucauucacagccuggaaucuuuaagaaaugagucaaccugaccuaugauucacagauacuugaucugaaaugcuugguggugugggguugguggaugggguagaaacaaaaauaaauuuccugacaccaaaagucaguucaagugaacuagaaugggcagagaggggucguggggaugguuccugcccuucaggagcugcacuuccaagucugacuuagggugaucacacauccaggcuugcugguggagcuucaguuuaugccuguggucccagccucuuaaacaguuagcgugccuguccacgauuagaaaugucacacguuggaagauguaggguucugaggagaguagaguggcaguucuuaaaggccagagauaacauuuaaucauguguaucuccagugccuagccucuuguaagaaauuaauacauaaaugcuugcuggguaggcgagugagugaguaagugguuucuuaaacuccccuccuuguucucuaaauuauuucucauuuuucuuugcauguuugaagcaccuggugacucuacuggguucucaauaaguauauuuugaauaagccagagguucagagaucaguuucuuacuugcuuguaagcaaccccaugcucucuagcucugcgacuuugaguggguuagcccagauuacuuagaacuuaguacuaagaacaguggcuuccacguagucaguuccuaagaaaugguaauggaggagguggaggugguguuauuguuauuagccaucuagcuuuacugccaguuuuugucuuuucucccccuaacuguaggaaucguagacuauauauauauaagaccucauauauauuuuuagaagauaagucaaauauaagaaauugaaaaaaugaauaaaauaguuauccuaaucuugugcccuugguaacauacuaucaauuaucauuaucaaugugcuauaccccauuuauguccguuuauaccaguguugacagggucucacuuuguugccuaggcugccaugcaguggcgcaaacauggcucacugcagccucgacguccugggcucaagcaauucucccaccucagcaccccccgaguagcugggacuauaggcaccagccaccacacuuggcuaguuaggguuuuuuuguuuuguuuuguuuuuggguuuuuuccuuuucuuuucuuuuuuuuuuuuuuuuuacauaguuguuaucuuaaggugauuuccaauuuuuuuuuccauuuacauuuuuccacaagcauuguccacuuuauucuguaaccuuuucaacuaccauuuugaaauuugcuuuuauccaugugguuguuugugaugaacuacagguugcugacuuucuuccccuucuguaaauaaaguuuucuuccuaguauguccuguaucucaagaggaucucaucaguggaaucauuagaucaaaggauaugacuguugcucagcucucuguguguauguaaauuaauaggcuguuuauuugagcaguuguaggcuuacaaaaauauugagucaaaaguauagaauucccauauauucuccucuucucccgucauauccccuauuauucgcaucuugaauuaauaugguacauuuuuuacaauuuaugaacuaauauugauacauuaagaguuacuggaguccauaguuuacauugggcuucacucuuuguguuguauaguucuguggguuuugacaaaugcauaguguuguguaccuaccauuauaauaucauacaaaauaguuucacugcccuaaaauuccccugugcuuccccuaucucuccucauuacucccucucucacacuaaccccuggcaacccacuaaucuccauaguuuuguuuuuuucagaaucacacaguuggaaucacauaggauauagccuuuucuuuuuuucuuucuuuuuuugagauggagucucacucugucgcccaggcuggaguguaguggugugaucucggcucacugccagcuccgccuccuggguucaagcaauucuucugccucagccucccgaguaguugggacuauaggcacccgccaccaugccuggcuaauuuuuuguauuuuuaguagagacaggguuucaccaugguagccaggaugguuucaaucucgugaccucguaauccgcccgccucggccucccaaggauguagccuuuucagacugauucuuucacuuaguaauaugcauuuaaggucccuccaugucuuuucauagcuuaacaccucauucguuuuuagugcugaauaauauuucuuugucuggauguaccacaguuuauuuacccugucaccuacugaaaggcaucuugguugcuuccagguuuuuggcaauuaugcauaaagcugcuauaaacauuuguguguagguuuuuguguggauguaaguuuucagcuuauuuggguaaauaucaagguguucuguugcuagaucuuaugguaagaauauguuuugcuuuauagaaaacugccaaauugucuuccaaaguggcuauaucauuuugcauucccaccaacaaugagagucccuguugcuccaaauccucuaccagaauuugguauucauguuuuggauuucagcauucuaauagguguguagugguaucuaauuguuguuuuaauuugcacuucccugaugacauauguuuauuugccauguguauaccuucuucgaugagaugccugcucaguucuuuugcucauguuuuaacuggguugcucauuucccuauucuugagauuuaagaguucuuuguauacuuuguauaaaauuccuuuaagugacaugucuugugcaaauauuuucucccagucaaugccuugucuuuucauucucuuuguagugucuuugcagaucagaaguuuuuaauuuuaauggaguccaggucaucaauuaguuuuuucauagauuguggcuuugguguuguaucuaaaaaguuauugccauacucgaggucaucuaggauucucuccuuuguuaucuucugagaguuuuaucguuuuaaauuuacuuuuaggucuaugaugcauuuugagguaauuuuugugaaggguuuaagaucuauauuuagauucuuuuuuugcaaaugaaugucugguuguuucagcaccauuuguugaaaaaaauuaucuuuccucgauugcaaugucuuugcuccuuugucaaaggucaguugacuauauauaugugggucuguuuccaggcugucuguucuguuccauugaucugcuuguuuauuauuuugccaauaccacgccaucuugaugaccauagcuuuauaggaaguguuggaguugaguagugucaguccuccagcuuguguguucuuuuccugcaguauugugucagcuauucugggucuucugccucgcuauaaaagaaucagcuuguagauauccacaaaauaacuugcugggauuuugacauaccacagauuguuuaucuauucacuuauugaaggacaucuuaguugcuuccaauuuuuggcaacuacaaauaaaggugcuacagacauucguacauagguuuuugugggaagaggaaaucuacucauuuggguagacaccaaggagcgcaauuauuggaucacauggugagacuauguuuagcucauuaggaaacugccauagcuauauguuuuuugcauuuguucagagauuuuucguuacaaugucacuaacaugauuaauccucagaauaaaccuuuggguuggggguuauuagccuugccuucuggcuaauguuauuaaauguuauugcugaaagaaacccugaagguuccuaagccucuaagcuuucugagugugagauccacauccccuaucacugcucuucuauggcuuccauggcaccgugaguauaauaguugcugaauuaguguccacuacacacugaauaccaauaauggaaaaaccacuucacuguacagaugaaaacacaaaggucccaaaacgagaaaugagauacuucuggccaaacggcauuuuaacuaguaacagaaccaaggcuaaaacuaaacuauuguagauccguagaccuguauuuugagccaccaguccuugacucgcuacauucaagcaagacaagcuggaagauucuuaaaucuguaauuaguauuguauugaacacccccccucacuuucaggccuacccacuacugacugccauuaccagauagcccaaagacgcccaaaaugguguucuaaucugaguacaaggccacuauagcuacaaagucucauaggguaaugagugauaauagcagugacaacaauaauaaaaauagccaagaauuauugauugcuuaguauugucagggucuuugcauauauuauuucauuuuacacucauagcugccccuugguucaacaucauuacuagccacaauuuagagauaaauagauugagcuuuagggagguuaaguaacuuguucggggugcuacagcuuucagugguaaagccacauguguguccauccauucucgacuccacuuagcaauguacuacuuuacaguuaaaauaaugagauuuagaguuagauggaccugcauucguauucuggagcugccauauugucagucaugugaucuuaaccuugugacuucuagcugcaauguucccaucaugggguagcaacauccauggcagacgcugucucuuguuaccucaaaaccauugccucccacuguacagaacaucaauauguucaaaggguuggcaggaggcaccaagucucagggaagucagacucuuaucccaaccuggugacugguuuaaacuagauaugguaauggcaggcaaguuacccagucuuguuaggaacaguaugcugaggagggagucucuucucaaaugaaaaggcaaagccccuuacaaaggaagcuuauuacuccuuuccuuucuuccucccuagaucuuggacaugauaccuggaugugcagcagccaucugguaauuaugaggugacaagucaauagacugagaugguggagcagcaaagauagaaaaggucuggauuuuuuauagcauuguugaacuguuccaucagccuaagacaguugacuaucuccagacuucuuguuauguacaacauguccuguuguuuaagucacucuaacuuggauuguuucuuauuuucagcugaaauuauuucuaauagauauacagauuuccaacaaagcacaguguagagcagcuuaacaugguaccuaugugccaaaguuccagagcaagaguuccuggguucuaaucuuggcucuguggcgugacuuuagacaagucacuuagcuucucugugacucgcuuuucucauguauaaaaugcucaguaacuguguauugacuguugaauaaaggauaauagugauacugaauucauaugauuguuaggaucaucgaauggcuaaacauuuuauaaaaugauuagaacaucgcuuggcgcauuguaauuggcugcagaugugcuugucaaaguaaaauuaaaagaaaaguagucacuauuauaggccuggguuugcaucuugaucccaucauugggccacuugugguauuuaagcagaaccuucacccuuucacuacugaggcucauagagcaugaaacucccccuaaaaucugucucaaagcagccacaauggugguuucuuuuugacaaaaaaaggcuccuuagagaacguuggcuugcaaaggagaggcugugacuaccaagucgugucaacaacugaauggcugaaauacccaaacuugcccaugcaaaugggcuugggucucuccuggcagccgccuuugaaggcucuagacuuaucugugaacuccuuuuuugagagggucuuuccaacuagugguuuauucuuugacucuccucauaccuuuuuugccagagagugagagugagaagggagggcuaaugccugagcuccugcccuuucuaugcagugagggucaagauccucagcuaguguuugagggaacugguguaaccugggucucucauuuucuaccauccaaguugccaccucugucggggucccacucuaauuugggcagccacuaagcaauauuuugaaauauaccuuguucaugaguuuaaaggaucaacugguagguguguccauuagcaaauccuauggaacaaauaucugcucuuuuuacccccuacuuaccuucuccaccaaggacaguucagacaaaguugucaccaccuuuagccugauuuacugcaggagccuccuaaucuaucuuccuguuucuacucuauccuuuaucccccccuuggcagccaggggauccuuuaaaaaugugaaccaaagcaugagacuaaaccacucaaaaucuucccauggaucucaucucagauuaaaauccuaagugccuucucuguccuuagugaaccccaggugcacccuuccucugccacuuucccccuuguuuauucuacuuuccacacuggccuccuugcugugggccagacauaucugagaccaguguggcuucagggcuuuugcacauacgauuuuccuuuucuggaacacucucucuuccuugcacaucugccuggcucucugcucagaugucaacucucagagaggccuuuucugaccacucccucuaaaagaguuucccccgccccucauuucccaucauuaucuguaguacugaugacuugcagauguuauuacaaauuugguuauuuuuugcauccuccagcaaaauguaagccaagugaagaaugagguaucguuuuguucaucaaggaauccacagaaaccagaacauucuguagcaggugaucacuaaauauuuguuaaacuacaaagagccauuuuagguuagaaauaagguauagcugacagaauucuaagccugauguuucuuaugagccugcucaauuggcccugaaaccacuucccagaaagcucuagauauguucugaauaaugggagcaaugcuggaccaguguuugagguuccaaagugaauacaugaaagugaaaaugaagcuacaugugacuggaugaacccucuugcauugguuuaaaaauccuauucaucaugauuaguucacgcucucuuuuucuugcuuugcucccaggcaccagacaagucauuccaaauauggggucuugguaccagucagaacgagguucccaucuguggugguuuaaaaacaaaaugaccuuguuccuugauauucuuuccauugaaagaugggauauaugacuuuuccuugagucugugcaggcuugugacugcuuuaugcagcuccugccugguuuucugagcauaauuauuccagggaaagcacugggacugucaagccgaagaggucccuggugggugcucuuguuuguagccucagcugagcucccagcaucagccagcaauccugagagccgccaucuuggaugcacauguaggcccucugcaccuucaaaaguccgcggcccggcugacaucugacuacaagggcauggaaaacuccaagugagaagcacccagccaagcccaucccaaauucuugaccaaaaaaaucaugcaacaugaaacaauuauuguuuuacaacacuaaguuuugcaguaaauauguaauccacaauaguaaugagaaccccaccuuaacucuuccuccuauguacuaggcaaucaugagaaaaaccuuuuuuuuuuaacacucugggcaucagguuucucaucuguaaguuaagagugauaacauauauugaugugguuguuguuucaagcaaaagcaaguuuuguccaaaaccuagcacgcuucuccacacaaacaauauuuucucaaacuuaagaugcuuucauuuuacgacucacccuuaauucauguguacuaagaaagaaacaaaugcuuccaauuaaacuacugcauuacuguaugccacugguuguaggacacauaccuguuuuggagauauugaaauuugaaaagauguaugucuuagcaucuuugauuuaaagacugauuaacauaagcaccuagcuaagcccaggcaaaaaacgagauccccaagauuagaguuugugaaguguaagaggagacauuaaagcaaauguaccuuuguaugaaugucuccaaucugccauucuguuuuauacgauaaaacacaaagauuaguacagacauccuugugguccagacaaaaagugccuuccuugucagccgucgaaugguuagaauucaaaugacaucaugucacaguuauugagccaaaauguauuuugcaaaagggaugaagucagaucccuaaaucuggcugugagucgauaaguuguuuucagcaguaacucaucccuaguaauaguaauaguccaagccccauuucucuuugguucuugagaauuuccuuuuuuuaggacacgaacuaguaguuccuugaguauuccagccaaugggcagaggggggucuaggcagugggcaaaaggaugacacagggagacccagggccacaucuagggggacagaagcauaagcaucagcuuccuagcaggcuugacguuaaguguucacauggagcucugcaguuaguacggcugccccaagugcuacuaugcuaauccucaugugaaaggcaaaccuacuucaggacaagagggguuaagucucuuccccaaagucacacagcuugauuaugucaacuuagaccaucagacaccagagccuguacuuauacccacagcacuguacuaacaagaauguuugcaaagacacagaaauagucauaaaaggcuccaacaaacccaaagcucacaccacaacagcugucuugucagcuuuaccuaaacagagaauuucuuuucauccauaccaucuuacuuuguucaguauggguuuuccgauaaggauguucuuaccuccuucucuuucugguaaaaaccaaaacauccuucaagacccagcucaaauggaacagcuuaacuccuuguuccuacagggugggcccuggcugcguuuggcuccagcauauugucccuugggcugcauggcuggcucuccuggaauuguugggagugguuucuguugauuacuccuauuggacuggaaguuucuugagguucuggaguuagacugaguuugacucuaugauuuacagcuauguccuuggacaaaugucuuagcuuuccugagcuuuaauuuucuuaucuacuucccagaauugucauaaugcagcgucuuugcuuagguugcacgaucagugcccaauauuguuuacuguuaugugauuggcaauaguggagcaucuuugugcauuaucucagucuucaauagcccucugagguagguucuuucacuaccaccccuuuuucacagaugaggaaacugaggugaaacuucuugcccaugguuccacagcucagaugugacaaaacugggcuguaaucguaccuuuuuaaacucccuucccucgauggaaucccagugagagccuccaugaacugauugccaaggauguuuugucauguaucagucucuuuagaugucuuuuaauucagaucuuaauuuuccacucauuugugccuaggugacauuauccuaguuugccggaaaaugaugcugcaaccagcuuugucucuguaaacugugguuguuuacacauuucaggcaucuggcaauaaugugucccucccccaggcuguuaugcguggcagauuauuaacaccacaacugccguuuuaguuaaugaaucaaaaacauggaucacucccauuauuggccuugaaaagcucaagcaaacucuuaagcauaacuaagggcccacaucguuuuccaacccaaagaaugccagggcuaugccuccuauuuacuuugaaugauuggcucaccaaaguuuuugcugguuuucuguguuguugcaaucauggaaacccucuaacucugcugacauuccugaugugcuacuuuuuuuuuuuuuuuuuuuuuuugagauggagucucguucugucucccaggcuggagugcaguggagcaaucucggcucacugcaaccuccaccuuccaccucccagguucaagcauucuccugccucagcuucccgaguagcugggauugcagacacgugccaccacacccggcuauuuuuuguguuuuuagcagagaugggguuucaccauguuguccaggcuggucucaaacuccugaccucaagugaucugcccaccucggccuccuaaagugcugggauuacagguguaagccaccgugcccagccgcuacuuguuuuuuuucccucaagacauaacaguuaaauuccccaaacaaaacaaguuugauuuuauuugccagaaaauauucugaguaagcagaacaagauccauuacuaaaucaagccucaccccauaccugggcagcccccucagcaaguuaggugccuuguuuggcagaaugguggaggucuuccugucuaagcauggaucucgugaaagcccaugggcucagcgcaggggccaagguuaauucacggucccagcucguggcgcagacuugccagugaaagacacacucagggcuucagcaauguccuuggcugcugguuuaccuucacuuucagcagcagcagagggguuggucauaccugagguggagaaagauguuggggcagggguugggggauggagguaauauuauugaaagccuacuuugugccaagcacugagcgagguuccccauuugcagguauucggggauugucuaccuacuuacuauuguuaacuucuaguuucuuuccauuguccucagaguagaugcugugcacgacuucaguccuuugaaagugguugagguuauuuuauggcucaguguccugugacgaauguugcaugugcaccugaaaagaaugcauccucugcaguuuggggauggaguguuccauaaauaucaacugugaaagguccaguacucagcugguauagacucacuguucaagaaaaacucguucuuucacuuauugccaugauuaccagauacacccacaagcaagaggcuauuuugcuaguuguguagaccagcgguuucgggagagaauguagucuucacucugcagugagcucagaggaggagagaggggaaaaguccaugugggugagaaggcacugccaggcccugaccccaggaggcaggugcugugccaacuuguccuccauguggcccaaauaagaagaaaaggccaagaacucuaaacagaucacugaggccaggggaaaauaucuugagauuugcuggagggagggaaauuuacccauggaaaugagagaaguuaugugugguaagaccccuucucaucucaagcacagccaaaacugaucugaucagagaccuacugucuuaguccauuuuggcugcuacaacagaauacuguaagacuaaguuuacuucucauaguucuagagguuuggaaguccaagaucaaggugcugacagauucugugucuggugaaggcccaguuccucguucauaaaugauugcuuuuuugcaguguccuaaugugaaggaaggggcaggagagcucucugaggucgcuuauauaaugguacuaaucucagucaugugggguccaccgucaugaccaucaccccccaauaaugguaguaaucccaaucaugaggagggcuccacugucaugaccaucacccccaaaaggccccaccucccaauaccauuacccuggagguuagaauuucagcauaugaauuuugggaggacacaaauguucagucuauaacugggaugcaaggauucaacauugccccugcccuucuggaauuugcaggccaugagggcauacagauaauuaaacacacaauuacgcauagcaggguguggggggggucauaauuggaaaaguauguugagauuagaagaaaaucauucuuucuuuguuucucccucucucuuucucuguuacacauauuugcagacaaaccaggaggauuuccacagggaagcugaaaggggaaaacaacaggauccuaucuauaagccuauuagaaaccguuagagaaugauuucaugaagaguaaggaacaugugaguucgcuagggccucacccacuaggaucaggaaugcuuggaacguuuuuuguaccauaaacccuuuuggcaaacuagagaagcuauggacaucuuuucagaauaaugcuuuuaaaaugcauauaacaaaauccucagauuuuauuucaaaggauugcaaagaaaaccaauuguguugaauucaguucuaugcauaggccuuccccuccaccucacucaaucuaugggauggggaccugaauguuuauggacuaguggggagauacuuugcagagaaagaaaaaagucuuucccagggccagcaguuuucuauauuuauggaauucguuaccuccaaggagggccugacuggaguuuuuacuuucaaauagguuuggguaacuccacgcaagacugucuuuaccugccuuuggugagcuuaugguuucuguuucuuuucucaaaagacugcgugcccaaacuuccagaaagcagacauauugaugcaguugaauugcccaccuuuuacauuucccuuauuguuccauggauggaguauaaugaauuggcaauggagggaagagaaaaguuaaaggcugacuuugauggggggcuaaguccucagagaacguguuucuuagggagccuuuugucacuuguuaggcuuuggaauccucuuugggaguucaccaaacagagagugcagcccaggaggauggggggcugaggagaagucagagguucagggaggacccaggucauauucugggagguggcaggggcugugggucccaugagaucagacacuaguuaugaaggaacuacuggcagacacuuugcucauuaaugucaccccccaugcucauuaccacccuaggaccugggguccccacuauaccacugagacaacaguugcugagcauaguuaauccaagaucauccagugagcagcaguggagcuaagaucugauuccacauaaucuaggcuccuaaauauuuuuuuuucuauugccacaugcccagcgaccuuccugcggcauggaggucgugggugcagcuuguggagucagguugccagguuucgagucuagcuccucuauuuaaauagcuugaugaucccaggucaguuccugauccuccucuguaaaaugggaauaauuuuuucaccuuucccacagacuuuccugggggauuaaagggagaauguaucuaaagcucugagcacacgugccuagcaugugagugcuccgugaauguuaguuacugugauuauuuuuagcccagcaggacagggaggaguguuaggucccugggggcgaucacuccucuguuuacuccucggacugucccggccuggcaggcguucaugaguuuguuucuccugucccaagguugcccuggugcucugcaguggcagggcugagaugauuauacaaccugcacuccaggccaaguccgguacucgucccagcugucggcuaagccugcacugcuaugggugagggaaucacuccucuccagcuggcuuucucacgcuggagaagccugaccuuuauucagaaucauccuccagcgcccacaucacacagcacccuggcucacccgcuccucccccaacauguccuuuacauucucaucuggggagauaauggggcuccaguguccccaagacagcugcuuuuccuuucuucuucauucgugauaacucucuguucuccagaagugcugcuuagacucuagagggauacaugaaagagcgguaaggugacaaagaaaacagcuggguucaauccuggcugcauacucagugugggacagaacaagugcucuaccuuuaaaguuacuuaucaggauaauauacaguauuucauguauauauacauacauuuauaagauguaauaaauuuuuguaaaguugugaggaugguaaaagcuuagcccagugccuggcacaucauaagcaccccacaggugucagcuggcaucauuagcagucauaggaaaacucaggguaugucuccauuccaggcuuuguggcauaugggucucaguguccccauuguccugugggguugcugagagcuguccucauaagauugugagggugggaauaugagaggaguuugagaaagcugaagccuaacaggucaacaaccggacugagcucuccccuucuccccugggccgugugcaagcuuugggccugguggugacaccuaccucuccaucccaccuggcgggcccagcugacccucccagugcaggggcugggaagcugcaaagaacccuuaggcucagaauuuccugcugucagccagccccccugcuguuucccauuuauuuuucucuaucuccuuuuccaucuccccuuccagcaccuucugaaacucccuaguccuguacuaccaacacaccaaccuuugcuuaauugucacgucagacagauggcucagguguccccagcucccugaagcucuucccuuccccuccccugggcaggggccucaggccuuccucugacugauccagcccaccucccaguguccauacuauuagguuggugcaaaaguaauugcaguuuuugccauuaccuuuaauggcagccccggcacccuggccauuggccccuggacagcuguucacucccuucucaggcuugcuggggacacauacgucaugcccugaagcguuccggaaccgguaggggcugccuguccugccacucacccacuccagcuaggaacuccucagugggcaagauaauugagcccagguugaauuaugacguucacagguaagaagcaggguucagaugagggcugggucuacagccaagugugggagagcuggugaaagccuugagagaggcagagacuggccagccucacccugcauucccaauccccuccucuuugucaaaaucuuacucucagcauggugccauuaccuuuaauggcaaaaacugcaauuauuuuugcaccaaccuaaauacuuuugcaccgccaggagaucuccugccaucuauucagucuuccaucccgcucucuggggcuuuauucuuucuguucuuucugcuucuugcugcgcacggugcccccaccuccuguggcugaaaugcugcccucucccauccugcccagaugccucuuccaccaagcuuuucugacugccgcaucuggaauaauauauauaugcaacuuuaagaucugucuuucuuuuuugaucuuuucauauuuuuuuauuucuauuuugguuauuugcugccauguuccuuaaggaaaagauucuacccucacaaugccuaagcagcuuggaucacggaaagagcuugggcuucucuccccacuucuguuuucucaucaguaaaauggggauaagcauuguaaauaaccaacccucuuaagaguugcuguaaggcuuggccaggagcaguggcucaugccuauaaugccagcacuuugggaggccgaggugggcggaucaccugaggucaggaguucgagaccagccuggcaaacauggugaaaccccgucaauacuaaaaauaaaaaauuagccaggcuugguggcagcugccuguaaucccagcuacucaggaggcugaggcaggagaaucucuugaacaugggaggcggagguugcagugaacugagaucgcgccauugcccuccagccugggggacaagagcaagacuuugucuuaaaaaauaaaaaauaaaaagaguugcuauaaggcuugaaagaggccuuuggcacgacuaucaccucccucagggcucugcacauuuuuuucuuuuuuugagacagagucuagcucugucacccaggcuggagcgcuacagcacagucucggcucacugcaaccuccgccucccagguucaagcgauuccucugccucagccuccugaguggcugggauuacaggugcgcgccaccacgcccaguuaauuuuuguauuuuuaguagagacaggguuucaccauauuggccaggguggucucaaacuccugaccucgugaucugcccgccucagcuuccuaaagugcugggauuacaggcgugagccaccgugccgugccagcucugcaaggaaccaaugaauaagugauugaaugauugaauggauaaaggccuuuacuguucuacuugaggcugucaaaauggauagguuuuugcuacaguccucaccaccccucuuaaugccaugucagcagcauggcauauggaccugcaaacccaggcucugcaucagguugccaggucaccuaaaugacagcugugaauucuucuaaaacaggggucagcaaacuaugauccgcaaguuaaauccaguccacagccuguuuuuguacagcuugcacauuaaggauuuuugcuacuuuuuaaaugauuuuuacauagaaaauguuacauuuuuaaauguaaauguaaauuaaaugcaaauauaaacauuuacauuuuuagauguuuaaauaaaaaaaucacaagaaauguaauuuuauagcaugaaaauuauaggaaauucuaucauuagcacuuguaaauaaaguuuuauuggcacacaacuaugcuuguucauuuauguauugucuacauaagcuauaguuggugugugcagagcuuucacucaaugauggcacaguugaguaguuucaacagagaugggauggcccagaaaaccaaaauauuuacuacuuggcccauuacaaaaaaauuuugugcugauccuuggucugugaaacaggagcaaugaugaauaccuacccaucguguguggguaaaauguuaaagugcuugauaucaagugggcacucaagaaaaguuuuuccuucuacucucuauuccucccugucuucauucccuuucacagagggcucuuuuauuucaggguccaagccaugaaaaccauagaaaaaggaugacagggagaaucugaaccaguaccaugcccauaccaggccucaaaacagcagagcuguguuugucaucuccaccuuccugcuccagagccuccccagaccucucagucuaugggacuguugguggacaggcagaguuuaaauccauugcgucuuuugcgucucgugguuccagauguggauggggccagcccugcaugaccagccccggagagcaacuucuauuagguuuaucagaggcuggacagcguccacugcaucuuuucuugcuuugggcguuuuaaaacuugggcugcuguugcauaggagauugcagcugcaguuuggcuuggcuuaagauaagaugcagccucugggcugaaauugaggguccugauucugcuuugagagaugguauggcauccugaaaagaaccgagauuuggaaucugggcuggaaucccagcugugccccucacaaguucuaggauucguaccuuuugcuuuuucugaaaagugggggugaugcuuuuucuuggggugagggugggguguuggcaggguucuccaccacguaagcuugagggagcaggguuuugucuuuuucugcacugaagcccagcuucuagaacagugccuggcugcgggugagcacucggcaaauaccugccuuagaaaggugauuaaaagauguagaguuccuggcacacgauagaaucucauuaaguggucacauugccauugucuguacucaaccaggaauuggcacacuauggcccacagccuguuuuuguaaauaaaguuuuauuggaacacagcuaugcccauuucuuuacauauugucugugacugcuuuccugcuauagugggggaguggaaucgugagacagaccugugcccugccgagccuaaaauauauauugucuggcucuuuacagcaaaacuuugugguuucugcucugaaugucaggguaacccugucugaggaugaucacggauuucauuuucccuuguuuguuagcguugcggucagccgcaaguugaaaacaaggaaccagcuugagguacgcauucucgaugcccuuucuaagauacuuauggagacuuuucuuuuccacuccaauucugccaugcucuuucggcauggucagagcuggcuucucugugcccuccagaucucauauguaagaugguguuacuuucauuucuuuguaaaaagaaacucaacccaccugucaauugcugguauauucauuagggauuaaccauggguccugcaacaaguaggcucagagcacagaggacaugagucaaaauaaaaaaagauaaccaaccagguacaacugugcuuuguaauauuauagaauagaaugcugaugggguucaggaaggaguccacuguguuuguggggcacaggauacauaagauucugauuuacuuuuccaucauggugaauggcaugaucuuagacaccuuaguuagcuuuauucaaacucaguuuuucaaucuguaaaauggcaauguucacuauauguugucacucucuuugaugggcagggcccacaguuaggagccucucgaggccuugguaucuagaauggugaaggagagcuuucuggaaugagugaacaugugucaaaugcucugacguccucauuugaagggggcccuguccccuguaccagcugagcaaugcgagugggccacuguccugcuaccauuuuauagucagcggaucuuuuuuuuuuucucuuucucuccagaaggacagaauaacgggcucccagauucacaagccccaccaagaggaucaccccaggaacgcuuggaggcugaggaguucacugaggcuacugcaucuugagacucaggaugaagacccagcuuggggcugucaaaggugcgaccugccagcugagaccuccaggggucgagcccaggccccuuugccuuguucauggcuuaggccagugcuuagcauauaguaaacaacuuguaaauguuuauuagaggauguauggugggucaucccuucugaauggcacacaguccauugucauuguccucagaggcuccagccucaggugcuucuuaaacugcgaugggaaugauggcagcagaugggcccagggcucagcaugagagcucacagcaggcugugcuccaccccacccaggcccccagucuugccauguuuccucugccuccccaggcuggccuagaaacugcuuccaacugaaaccagccaaaugccugccccuaaccacaccuacaacucuaggguuaccuuuagucuagaucagggguccuuaaacuguagccuuugcuggguacaguggcucacaccuguaaucccagaacuuugggaggccaaggcggguggaucacuugaggucagaaguucgagaccagccuggccaacauggcgaaaccccaucucuacuaaaaauacaaaaauuauccaggcaugguagcgcacaucuguaaucccaccugcuuggaaggcugaggcaggagaaucacuugaaccuaggagguggagguugcagggagcugagauagcgccacugaaccuccagccugggcgacagagugagacuacuucucaaaacaaacaaacaaacaaaaacuaagccuuugggcuaaaucuggugaguguucugugcuuguaagaacucugaguuaagaauaauuuuuaugucacuaaaggguugaagaauacaaaaagaauauucagcagagaccaucuggcuagcaaagccuaaaauauugacccucuggcccuuuacagaaaaagugugccagucgcaggauuaggcaguacugaccacaccccaggcucccugugaaaauuucaaccacacagacucauuuccuuucucuuaucaacacugaggcaggugugauuaucauuccuuguaaacauggagaaacuaaggcauggagagguuuaacucguuuaccugagaaucuauuaaguaacagagccaggguucaaacccaggcaguccagcuucagaguccauacuuccuagcugcacucugggccuucagcguagggaugagcuucagacaagaacuccccucuuaauuucugcccucuccugccccacagccaguggacaggcauuuugcaccccagccugcccccagccagcuccuacucagagauuuccugcagggacuuagacgaggcucugggaccacccuccuuuucugcccuacccggcaccuggaacucugcuugauccugcucccucugaggcuggacacaucuccaugagccaggccugaaguucuuccccucucuggaccucggggccucccuuccuaggggcaguuccuguguccccucuacucucugccuuccccccgccccaccauguccuuggggcuggaauuguagugugcagccuugggaacagggcugggcucagggguugggaacagaggcccagggcucuggcugacccucucucauccccaggaggagaagcugcuguguuuagagugucacaaagaacagugcuggaggcuucagaaaucucgggagauucugaacuucuaggcggagcagaugggauggugccucugugaucaacaggccuggcagaggggugcaggagggggugcgaauggaaagacagcugccaaggggaacggagagcuuuucaagucacccuuguccccuccccaccccaccaucagggcuaagacuaaaccucaccauccgguugcggccucucggcccuggggauggagauuaguacauguagaguggagguagagaggccauguucugguugugugaccuugcacagguuacauaacauucugugccucacuuuacuuguuuuuaaaaugaugaagaugauaacuaccuggcagcgugucuuauauuagagauaauaugguuccuggcacuuuguaagcacucggugugaaauugucuucugcugcuccucuucaucaguccaccccuccucugcagagguuuccuccaugcugagcaagcuggcagcaccuaaauuccuguuagugcacccuagugccuucugcccaggccucgggacccccagggauccuggccccuguggacagggacuuuugugcccuccuucucuguuaccagcaagagugaguccugcacugaauuuccaugggaucauugcuugcuaacauuugugagugaguuacugucuagaaagcagcuuuucuggacuuuucccauuaauuucacgaaaguuaucuuccuuugcccuuacuacauguucauuacuacagguucauuaccccauuuuacagacaauuaauacuccgagaugaagugacucaccaggggucgccuagcuaagcaguggagagugggccucccacccaggccuucucacucugacuccuguucuccacgucauugcauauggcgacaugcgggucacgugaucacacaucccuagccgauauggaauugugagcuucuccugggucuuccgaggaaggaugcuuucaggagugcuuuggaaugaaggcaguggaggccaagagaccucuaggucaaagccaggcgggaggguccucucaggggcccagccgacaaguugcauuucucccucagaggccugaagaggcagaacaccccagaggagccuggggccaccacccagcaucacugugggaaaacggcagcaggaaauguccucucgccugcgugcuccaccucgguccacgccuucccuccuucuggaagccuugccugaccacuggccugccccuucuaugggaaucacuacugaccuugcagcuuauuauagacuuauauguaugcagaaauauaauuuuaauuacuuuuauauugcuccgagagugauaccaaaucaugauagaaaauuuaaauaaacaaaauagccaaauuaauaccaguaaucaccccagucaaauauacccagcucacauuuugauguaaaaucuuccaguacaguuucuauguacauauauauauuuuuaggaaggagauuauauuuuacaugcuguuuucuagaacguucuuuuaaaacuguaucauaaacaucuugccuuauaauucaauagucuucuacaacaaacuuugcuaaugaauuuuuuuuuuuaucauggucacuguuguguuaugugcaucuuaguuuagcaucuucaguuacguuauaagugucuuaagcccucagguuccccagccagccgcaggguggguuuguucauugauugauggcuguaugggguggaggagggaaguagaaagugagugagauuuggguaagcaaaccuggguuuaaaugcugagucugcaaauuccauaaauucuccuucccucccucccucccaaccuuccucccuccaucccucccucccuuccuuccuuccuuccuuccuucuuuccucccucccuuccuucccuccuucccgaaacaaaugccuuguuagauauuuuauaucuuuauguaaauaugcacucauuuaaauaucaugugggcaccuccucugaguggcccugagcuugguucuuggauguagcacugcacaagagaaaccaggucucugcucuccuggagaucgaugcauccaguguggggcacagacucaaaucaaggcaauagaccaaaaccuaagcaggccacuaacuuguguuuaaguacaacauccacauggacgggaaugagaauuacagggggagcacacuugagcugcgguccagcaaagcccucucuggggaggugacagucaagcccagaccuaaaggaaccugcugcagggaggaugggaaagauguucugacaaaggccuugagauggggaaggcuaugguuuagaugaggaacuucaguuggucauccccucucucauccauccuguugaaaccaccuuugcaaaaggugugucaaugagaaaauuauaacaguaagcuaagccaacccaaccuccaucuugccuuucucuuaauuauuccugggcuauugggucaagcuaacuuuggaagacauuuaggcuacaguuuaaaugauaauaggccuugcccaaaacucagccacuuuuguaaagcuguuagggggccaucagggugcggggaggagaagagccugaauccuacuaagcugcagacauuauuccgaagguuauaagauaugcaacuuucccaauugcuccugugaauaacacuacuauuacagauuggccuuuugaaauaucuuuccagguuuuuugcaugucugacacccaugacuccaccuggaccuuauggcuccacccagaagcaauucagcccaacaggaggacagcuucaacccauuacgauuucaucucugccccaaccacucagcagcaagcaccuguuaccuguccacccccaccccuucccccaaacugccuuugaaaaaucccuaaccuaugagcuuugaauaagaugaguacgaacuucaucgcccacguggcguggccggccucgugucuauuaaauucuuuuucuacuacaaugccguggucuuucuuuaugcagugggcaggaauaaccccuugggcaguaacaaauuuggggucucaugugggauugugcugguggcuaccuguguaugauucgguagccccccacuggcaacaggccuggaggccagcucaaacggcugccuaguucuccuggcagagagaugggggcugacucuggcaccaucucuaccggcgggacacugcugaccauggugcauggaugcagugggcaggaagaaucucuugggcaguuaugcuaucuauccaguccaucugucaaauguauccagacuaugaccuccucucacuucuuggucgaagccacccucauuccugccuggaauuuuuguaacagccccugggcugggcucccagcuugugccuuugccucucagucugucuucaaaacagcagccagggugauccuuugaaagggcagccagagcucauaagcccauuugcuucaaaacccucaaaggguuccaccuaauucugaguaaaagccacaggccucacuguggccugcgaggcccgugggaugcagcccugugaugucucugaucacguccucguccuuuccaucucauuucgcccuggcauccuggccccuuugucauaacucagacccuccaggcauacuucugccucagguucucugcaccugcuguguccucucuagccuauuuguccacuuccucaucccuucucagucuuugcucggguaucaucauuuccaugaggccuucccuggccaccagauuuaacacugaaacuuccccacaucccacgaagcucacuaugcucuuugcugguuuuauuuuccuccauuguucuuggugucuccuaauggguucuacaauuaauuguuugaguugauuuauuaguuucucuuacuccccuggaauauaaacuucaagaaggcagugauuuuugucuuaucucuuuccaagaaaaguaucugugacaugguaggcacuccauaaguauuuguaaaacaaauaauuggacuuccuuauaccaaagacagucugcacagaaaacaaaucuuuacuucaagcacaaaccuuuugauauacauauauauguccaaguuuuccuuuuuuuuuuuuuuuuuuuuuuuuuucagagaagggcccuuucugguuuccccugcugcccaucaggaugcacucaggcagcaacuguacaguaaaaggggacaccuuuagccucugguuucccagagcagagagcugucaacaccauaagcuauuuuugccucaccucuggugcuccggaguggcaggccagucacagguguggugcaucagacuaugaagaggcuggguggccacaacucugugcugggaugcugaccucuuugaggcaaacagcaugagcuggaaaaagugugucuaucucagaguuaaaaacuggugaauuccccuguugcucuuuaccaucuccuggguccguaugaucugacugccacccacuuuccccuuuccucacugggcuccagacacacuggcuuccuuccuuccugaagccuccaucugcugccgagcucagggcuuuguuagacgcucacccugccuguguugcuuccugcagugugcugaauugugucucccaaaagauaugcugaaguucggacuuccagaaccugugaaugugaccuuauguauaauagaaauagggucuucgcagaugcgaucaaguucaaauaaggucacucuggaugacgguggccccuaauccacuggcugguguccugaggacagagacacacaguggggaggccuugagaagauggagguaaaggugggaaugaugcaucuacaagccaaggagcaccaaggauugcuggcaaccaccagaaacuaggaagaggcaaggaaaggcucuucccuacagcuuucagagggagcacaguccugcugacaccuugauuucagacugcuagucuucagagcuguggaaaaauacuuuucuguuauuuuaagcuccccaauuuauaauauucuguuauggcagccccaggagaugaauacauuucuuucuccuccuucguuucauaccucuagugccaucuccuugaagagucguucuuuaacucccagucauuacuagguucccaaguucuacaccuuuagcucugcagccuauucccacgggagauucucuugguagccucccccgacacaguguaagccccuuuguguccagguugcucacuauggguccucagucucugagagcgucuucagcacacauugcgugagcaaucaauuuuuguugaaugaaugcauugcaaucuggagugagcauaagaucccagucagaagauugcccugggugcuuccccuagaaauccucaaaguacaauuauucagauugagucacucagcccaugguacccuacaguugcagaugacacaagaaacaugagaaccucugaggacuuuccaagcuggggccuguucuuacuguuuagcaugaaauguguuuuccugcuaagaacaugaaccagaaaugaguuuuaccgagugguuagcaagaccuuaaauagaaaggaaacuccaaaaaauguaacuucucucacacuuaagccuccuuuucaacuucccuuuccugcuucccaucacuagaaccuccagaucuuauuuccugggugaugaugaauggugggcccuauuucagaccuccccaaauucugcugaacuuccucucuuuggguuuuagacagagagguaugguaagugccucuagaacugacaucuccugugagacccuucucuuacaugcuauguagguuuggcugcugauggauucagaaugguuuuuauugagcaccuacuaagugcuagcuuuuacacuacgcauuuugacacucuguaacuucuuuuucauuuaaucuguuccagaaacuuauguucacuaugaugugaucuugcuuuugauccauuuuacugaugaggaaauugaagcucagagaggucaaguaauuugccuaaggucacacaguuaauaaaugguaacgccauuuucaauucuacaucugccugacuacaaaguuggugguuuuccuuuccuaaauguuacaacuaaaaacccacucuagcucaaaauggcaaugggcuuuauuguaaggauuugggcugugccugggacugucuggugguuauccagcagccucuuaggaggaguuggccuguuggauuuauggacuugggacccuugguaugugcucagcacaugccacagaccuggcaagcaugcuggccuggggucaucugcucuuggggcuguguuuucugauuaagggacauuaggcuagccacuucccacauccagcuucaguuuccccaacuauaaaauuaagacauagauaugcuuuccacgcugccauccugcccugauaaucagauuuuaguaucccagggcuauaacgccccauucuuccauaccccucaaacuccugccuuucuauccuaucuggaacuguggcuuacauaaaaacucccaaggcauccaugcaggucccuucugucagaggcuccagcuucuccaucccuuuccuccccucagucgacauccucuccucuccuggaguuaguccugcugggggaccuugggcaaguuccuucaccucuuugagcuuccguauccuucucuuuaaugaucucgaauguaacaaccccaccucauagccucauuaugagagcuagaugaaaugaaacaauaaccacuguuuaccuuucaggcaccuggcagaagugcacgcucuggagcugaguggaugggugcaaaucuuggccaugcugcuccuccacacccaagcgguuugggccuggacuaguugccugaugcuccacaccuccacaugcucucuugucaggcagaaacaguaacagcaaccccccacgccuguuaugagaguuaagugaguugauauuucuaaaacacaucaguguggggcauuaggcuagccccuaaugccacucaugccaacaagugcuguagaagaguuagccauuauucuuaggucagcuaauuauccaaucagccugacaaaggagguacuguuauuagccccauuuuauaaacaggaaagaucaguaacuuggccaagggcagaggggcaggccuugagcccagacggauaagacauuccagggggaggcuccucaccuucaguuacacugacugcuggauauaagggggcuccccacuuggagcuuaaagguuugcaauagccaccuugaaauucuugaaaaucuuaaucacuuuauguuugaguuuguguuuuguaagugaaguucugcuucugccaccucccccuuuccccaaaugugcccaagacugaagagggucagagucaaucccauaauugugccauggggcagggcuguggaggucuucaaggggcuguauucacccuacaaguauuccugugcccaaaagaguaugacauuaaauagcagauaaaaacaaaacaaaacacaccaggacggagaucucagaauaaagaaaaaagcuuuuuuuuuuccuguuugaacaagcauuuucauucugcaccaggccuugcuaauaagguagccagaucugggugcauagcaugucacgggcgggaaugaaaugauaguacucuuucgcuucaaaaaaaaaaaaccccaaaauacuuguuccaaguuuaguaacugagugcaguuuguucugacuuuugauucacagguagagacaaagucuuuagcugaaagguaauaguuuugccaccuucuacaaauauagauauauuuuuucccuaaagccuccugaguccuuuuuaagauuugcauccaaaauaugggcccuuugccaccgacauuccuguuugguaguggaugagagggcaaucuuauuuuuuucuucuucuguuguuauaauccucagaugcagaguguucucuuuaaaagacgcuuuuaaagggcaauuacuuuaugcaaaugugggcaucucuggauggcuggcaaggcuggagucaggccguggaagccuggaaaguggacugcgcgggcugggcaggggaccaggagggaggcccugcuugccgguaucagcaacuuucuucugcugcccccuggaccucugggagaagacucagcagccacagccagaguaaugggaagaucacagccgcauagggcugugaaucagggaggacaccucaucugguuuaucucaugugaaauagaugaggcuccuugagaucugagcaagcagccacucgaagccaaucaugggcgccacugcagaccuguguccaaugagagaucucaguuaaaguagaauagaccacgcuucugugucuccugcuucaguguaggccacagcacagcagaggguggaacauuccaggaaagaguuaaggaugcaggagaaacccccuaagggaggccaguaugagaaaagguggccugggauuguauggugggggagaggcagcugggcuccagauccuuuucuuacccuuggagccuaugcagucuucaagaggccacugcuggccgggcgcggcgguucacaccuguaaucccagcacuuugggaggccgaggcgggcagaucacgaugucaagagagggagaccauccuggccaacauggugaaaucccgucucuacuaaaaauacaaaaauuagcugggcacgguggugcgugccuguagucccagguacuugggaggcuaaggcgggagaaucucuugaagcaggauaaucgcuugaacccgggggcggagguugcagugagccgagaucgcgucaccgcauuccagccuggacaacgaagcgagacuccuucugaaaaaaaaaaaaaagaagaagaaaaaaaaggggggccacugcuccaguggcuaggcccaaucucauuuccaaagcugcuucaggcaucugugaaacccccagauggagcagcccgggcuguggacacucugccgcauccaugccuccuuguugcuuagugagccuguucucauuacucccccagcgccacccucugcauuugcuccacuccuccuagagaugcaucuuucauuuuugcaucacuaaaugcacuucuucuguuucucuguuuaccggagaaaaaaauaggaagcgugggaggcagggcacaacagucuucgccucggguucguuggguaaguuucgcccauucuccaagaggggaccugacuagggaggcucacgguucagaucggugcuccaaauucccaacauacaacugagucauuuuuacuuguuucuacaauuuguuaauaguagcuggccuuugcugaguuccaucuaugagcuuggcccccuugcuaaucucucuacuacauacaauaccccuuuuaagucuuuuuuaucgcaauauaguuuacagaugacaaaaugcaaagaucuuaaguuagaauuugguguguuuugcaaauguauacauccguguaccuuucacccccaaacaagaacacaggacauuucuuucaccccugggaauugccuugugucucuuucuauauuccguccugcucaccccacacgaaggugaccacuguucuaauuucuguccuacccaugcauuuucucuguucuagaacuucuuagaaucaucuuuacuuuccucaugucuagcuucuuuucuucaguacacuguuuaugagauucauccagguuguugcauagaucaaaaacacuuccuuuuuaucgcuauuuaguauuccauucucuggauacuccacacuguuuauuauuucaucuguuugauggacauuugggauguuuuaagugugcauugaugaugaauaaggcugcuaugagauuucauggacaagucuuuuuauggacauaugucuuggggaaauaccuagaagaggaauuguuggaucauaugcuaaguguauuuguagcuuucuaagcaacugccaaaacuguuuuuccaaguggugguaucuuuuuuuuuuuuuuuuuuuuugagagauagucuugcccugucaccaaggcuggagugcaauggugugaucucaggucacugcaaccuaugccucccaggcucaaacgauucuccuaccucagccuccugaguagcugggauuacaggcacccaccagcacgccuggcuaauuuuuguauuuuuaguagagacgggguuucaccguguuggccaggcuggucucaaacuccugacugccucggccucccaaaaugcugagauuacaggagugauccacaaugccuagccaauauuauuuuuuaacucuugccaggagcagaggagagcuccaauugcuccacauccucaccaacauuugguauugacagucuucuugauuuuuggccaucuuaguggguguggagggcugucucgccaugguuguuauuuacauuuuccuaauuacuaauggcauugggcacuguuucacacacuuauugcauauaucuucuuugugaagugucuaggucuuuucuuuauuugggaagauggguuguuugucuuuuuauuaucgagucgcaaggguuauuuauauaucauugauacaaaucccuggucagauacaugugcugcaaauauuuucuuccagucucuacucacacugucucuuuuaauccucccagcaacuugaugaaguagauguuacuauccucuucuuuauuuccuagaagccaaaacugaagcacagaaaguuuaagugaaauguucagaaucacacagcuacucaguauggcagugagagugugggccuacugcagugugacucagagcauugauguccagaaaaucccaggaagcuucuuuccacacacgaagccuuguaucucccuggcagucuggaggcauguggcccucgagccagugcugggcuggguuauuucgguucacacucucgcccucugccuugcacauaccagaccauccugggaaguaggcggcucccacaacccgguugggagcguggucuucuggggaggaugccacacagcuuugaguugcucugaugaaagacaaacugcggggauucuuaugggccuccgaggacgcugacaguauuaccucaugccaggaauaacaaugaggggccuaggcgagcucgccgccagcccuucucugggaggcaccgcuggaggaaaccagccaggagaugggaggacggggcugggauauuuaguccacagcugucucaaaggagaacuauugggugccucagggacuucccucuuucuuucuccuuucugagcaggugaaagggucccugcggcagucagagcgaaaggcuaggagguuuugugagaguaagaacaauggcaacuccagcccucaaaaugcuaguuggaagagcgagccucucugagcacucgcugugugccaggcaccgcguccacacuuugcagccccacuugaugcaagacucuguguaguggcuuugcauuuacucccucaauccucgucacacccccaugagacacgcacuauuaaaaugccuacaggaggaaacugagguccagagaggugaaguaauuugccuaacgucacuuauuuauaagugguugaaguuugaauagggguuuagcuaauucuaaagcccaguagcuuuacugcuacgcacuucugccauucuguuaaaaaacuuugucaaauuucaaguuugugucaugcacuacacaugaggugucuuggucaguggaauauaagauugaacaagaccugacucuucuuugggcacuguguggguuggaugguggacccccaaaagaaaugucuacaucucagaaccugugaauaucaucucacuuggaaaaaaauauuuuugcauauauaauuaaggauccugagaugagaucauccuggauucuuugggugacccuaaaucuagugacaaguauuuuuauaagagacagaagagaaggucauuuaaaaaggaaacagagauuggagugauguagccacaagccaaggaacaccugaggccuccagaagcuggaagaggcaaauaauucuccccugggacauuuaaaaggagcuuagcuuaauauauuacauucauuagaagugagucccuagguccaauccaccugcaacuggaguacauuacacaaaagcuugaauaccgggaggcaggaaucagugggggcaucuuacaagcugucuagcacagugccaagaggcagggaucacaccuucuuuugcuuuuuaaauuucuuuuuuaauuuuuucgagaaugugucuugcucugucacccagucuggagugcaguggcgcaaucuuggcucacugcaaccucugccuccuggguucaagugauucuccagccucggccuccugaguagcugagauuacaggcacacaccaacacgcccagcuaauuuuuguauuuuuuaauagagaugggguuuccccaugcuggccaggcuggucuugaacucucgaccucagauaauccgccuacuuuggccucccaaagugcugggauuagagguaugagucugaccccaccuucuauuuuucuggcaauccccauccccaccuucuguuuuucuggcagucccuggccccuaacugaaagaaaaagaacuaacauuuaacauuuuuauuuauuaagaaauaauagcauuuauuaugcauugacuguguaucaacaaccaugccagacuccuuaaacacaucguuucaugcaguaucacuugacccuccuaugaacccugaaaagggagguguucuuaccuccauuugacagaggaggaaaccaaggcucaaaaagaugaaggccacacaguagccucucagaggaagccagugguucucaaacuguagcugcaucagaaucgcuugaaaacaaucucuaagcccugaacacagaguuucugucugauuuugcagcuuuagggugggacuucagaaucuguuucuuuuugcuuuugcuuuugcuuuuuuugagacagagucucugucuagcaggcuggagugaagugguacgaucucggcucacuccacccuccagguucaagugauucuccugccuccucucaaguagcugggauuacaggcgcccaccgcuacaccuggcuaauuuuuguauuuuuaguagagacgggguuucaccauguuggccaggcuggucucgaacuccugaccuuaggugauccacccaccucggccucccaaaguguugggauuacagaugugagccaccgcgccuggccagagaauauguauuucagacaaguuccaaguugaggcugaggcugugggcuugcggaucaagcuuuuagaaccacuggagaaucaauauauuuugcagcaacagacaaacccuaaaguuucaauggauuaacauaucaaaugcauuucuugcuuaaguugcagucuuacugggguagggcagcccuccuucaugcuauagccccuaucauuuggagcauaugguccccaaagucaccauggaaggaaaaagagagggcagagggucacuuaggauguucaaaaaaggcuaggccuagaagaggaggcuuuuaugccuuuugcuuagccuucaugggccaagacucagccccauggccucaaacuaacugcaaaagaggcugggaaauguagucuuccccaggaggagcaaaugguuaagaugagcacacagcuggucagggcagggcugggauuugugcucaggugcuuucucucuuucuucucuugccuuuuuccugguccagguguuuuuggugggcuuucuuaguguuaaggaacuucuguaugugugugugugaaacugaaaaaagagaagaggaaagagacauuuucgagguccuucagcccacucucuugccagcagccuucacccaucuucacuucaucuuagaggugcaggugacaguugauaaguaccuugaaaggccuccaugugugugcagggcauucuuucguaaguuucaucuguaccauguuaagugauucagggccacuaucucugaauuugaagaacccucaagcuacugguucuccaggaccuaaacccuggacuccaggccacagacaagcucugagugaaaaaugaauccuucuugccgcuccuccccuaugcuucacauugcuccaaaccuaccugccuccaacacguggugcaguuucuaccuucccuuccuuugcauauacugugacaucugcccgauaucuuucucuucccuccagacuugacucagaugauaccagcucuaugaagccuucaucaaucugucaaagaaauauucaacuuacccucauucugggucagaggcacaggcaugcuucuuugucuaaccuauggucuagcacuugucaaggccuguguagacuuugcacuugccugccucuccuuagagaacgugagauguucuugagccaaaacuguguagcaucuuuucuuggccucuuaauuucugacaagacugagucuagaagccuuccugugaugugcaaagcccuccucaagauccacagguaaagaaggaagucucuggcauuaguuugaaucccagcugagccacuugugggcugugugaccaaggggaaauucuuagucucaugaaugccucaguuuucucaucuguaaaauggagguaguaauguuguguauguucaaugaaauaaugcaccuaaagcccuuugaacagugcauggaaaaaacucaggaagugccagccaucacuguguucuuaucauugcucuuguuaguaucuugcuacuuuagcccacaccagccacaucagaucacuuacucgcugacaauuuugaugaucuugcaugcuccuuugcuuuugcacuuaaucucuucugcucagaggucccugucucucaccuauuaaugaauuaauucauacuuauucuuucauuuauuuaacaaacuuuuuccuuaacucauuccugcucauccuguagacucgucuuggcccuuccuguccauucccauuggauuuaccacuccuguuuugacuuauguuuacuuuucuguaucuccgugaacaacuugaaagcagaaaaaaagaugcucauuuccuacuggauuuacugcucugaagccaguuccuaauaucuugauugucacauagcgggagcuuaaugaacauuugcugaaugaauauaugaacguuucucaucucugaaucuguucccaaagcuuagugcauuguaggugcuuacccaggacucuuucucuugcaggaaaccagaucacucuggaugcauaucaucuaaaggcccuaguugugggagggcuacuuuuaaucaguguauuggccgggcgcaguggcucaugccuguaaucccagcacuuugggaggccgaggugggcggaucacgaggucaggagaucgagaccauccuggcuaacacggugaaacccugcaucuacuaaaaauacaaaaauuagccgggccugguggcgggugccuguagucccagcuauuugggaggcugaagcaggagaauggggugaacccaggaggcagagcuuguggugagcugagaucacgccacugcacuccagccugggcgacagagagagacuccgucucaaaaauaaauaaauaaaauaaauaaauaaauaaauaguguaucuagauuuugccaccuucagaaccagaagguucuccguggucuagccugaccaaguuuaaaaugucuggggguugggggguucccugaacaaugcaagaggcaccauuucaucuguguuucuuggacaaucccuagcguuauccaagacuucucaacaguugccacauuugaggacauacugcagaguaucugucucaucaucuucugauaucacagugcuuagauuagugccuaguaaccaaggaaagagggaauaaggggacgucccccacuggccaaugucuuagauauguggauuuggagucaaaauguuugcccgacuagccuaacgguguggauggugacauugcgcuaaaaccgacccucagacucuuauuucaugaauuugucugauuucuuugguagcugaggucugguuuugaugugcaaacuggcucuaaaaauuaaucuguucccuuucucucucacccuuuuuaauugccugauuuguuugucucuugggaguggcaaggugggaagguuucucugcccaaggcuggccaggguagaaccuucugugcuggugcuggucugacuguggaaagaggugcagauguugggguuuggaaagucauugucuggguuccaugucauauggccuccugaaagggacccucuugguuauugccugcucaugucauggaggaacugcgcgugguuuuuaucgacauuuugguuuuguuucuauuuauaggagguuguucagagguugucccaguuuuuacuccuucuuauuaauugucgugcuuaaagccaugcauauuuucugacuauccacuuuucuuuucccugugaagcaaaaauaauauuaauugaaacuguaauguguggcagagacuuugcuugguauuuucgcacuuguuguuucauuuguuuuucaugaucauucugcaagguagguauuaauauuauuaguuccauguuacaacugaggaaauugcagcuuagggauuuuaauuucauaaagcuaguaaacaucuuuuuuucaugacauguacaaucuggcuggcuuuuuaaucauccugccuugaagcuaacuucgagguucuuuuuaggcgauuuugguguuugacccuucccggguugcacagugugugcccuguacugccgugcuuguauuucauggucucuuguaauaaacgcuucuaaacaugggcucacacguuaauuuguuuauaguaauuauuucccugaaggaaaaaaaaaguccauuuauuuuuuucucuucuuuuaucuuuccagacccuuggggccugauucuccguggcucuuuuggagcagauguaaccaagaaaucaauauaaccauuagauucauccauggcaaccauaaugucauagcaucuccugccuuguaguguugacagaaguggcagagccaggaggaggggaaauacuucaaagaugggacgggagccucuaaagugaacgggagaauuaaaaucccacggaaucucacuuagcagaugagaaauuguagguuguugccuacggcauaaucaggucuucuuucagagaauguaauggcuugaugucagguauggcagagggaucuccagcauucagguaucgugaggcccuuuagcagugguggggagcagcugauggagccggaauuucguauuuguccuuuagguaccaaugcucaucaccuccagagguaggguuggcagaucucaugugauuuccuucuuccagugaucugggcuuuuauuauuauuguuauuauuaaugauuaccugcggcgaggagagagggcauccuuuguaagcacaguguucgguuuauggaaagcaccgcagguauguuugacuaguacauguuggucuagucuaccuaacacauucaguuacuuaacaacuauuuauugagcaccuuuuuggagucaggugcuacuguagguauggagguggagauucugcagaaaacaaagcauacaaaacccaugcauucagggaguucauauucuaguagggacuaggaauucagcugagcuagcagcuugaauuuucucucuccaaaagagguugccaguugccucacaguaucucuucuccccuucuuuaguguaaaacaguauuucuuaaccaggagcaauuuugccccccaaaagacaugucuacagacuuuuugguugucacagcuugguaggaguuguauccuguguguguguguguguguguguguguacuaggugccugugcucacacuacuaguaucuaguaaguggaggccagggaugcuaccaaacauccuaccaugugcacaggacagccugacaacaaagaauuauccacccugcaaugccaauauugcugagguugggaagcccugguggagacagaaguggcugcuuggucagugacuauauuucccagcuucccuugcaucuagcugcggccuugugacugguuuucaccaagggaccaugagcaggaaugcugugcccacauccaggaggagggcuuuuaagaaguggauguacuaggccgggcgugguggcucacaccuguaaucccugcacuuugggaggccgaggcgggaggaucacaaggucaggagaucgaggccauccuggcuaacacggugaaaccccgucucugcuaaaaauacaaaaaauuagccgggcgugguggcggguuccuguagucccagcuacucgggaggcugaggcaggagaauggcgugaacccgggaagcggagcuugcagugagccgagaucgcggcacugcacuccagccugggugacagagugagacuccgucucaaaaaaacaaaaaacguggauguauccuuuuccuuuccucaggcuggaugaagagaauaacaaaguuccaggugacccuggagucaccaggggcccuaaaucaccauguggaggcgacugucuguaaaucugagacucucaccuuggacucccauguauaugagaaaauaaaauccuguuguguuuuaaccauuacgaauuugaggauuucagcuacggcacuuuagucuacccugacuauuguugucccuaaguguucucaacaguucuucaacaauaacaauaguugacacuuacgcugugagcacacaccgugagccagacauaaaacuuuuuaaaugugagauuuuauuuuaucuucauacaaacucuauggaauagguaccauuauuacccuuguuuuacugauaaagaaacaaaugcucaaggagguuaauaaggcaaguaagugccauaagccaguucucuuccagguucuagucucaaccacugaagcagguuccuuucuccagccuuaauaucuuuuuaucugggcauuagcaucuuucuucagggucgcuguaacuguucccucuuugguuccucugccaccacuguggauacuccagauugaaugacuuuuugaaaaccaaaucugaacaugcuucuuuccugcccaacuuccuucagugacuuuucauugcucccaggauaaagcacacacuucuuacagggcagaaugguccuucugcaucuacccagccuaccgccagcugccuucauccuuugucccuuuuuccuuucgccacauguuccaguggugagugcaggcuucaucagcacagaaaaaaaaaaaaaaaaaaaaaaaagggcuauuuuuuucccagaauuauucucgcugugcagagggaaucacaguuaagguaucaggcuuccuauguggauuuccaagaguucaagaaaggauuguuugaccauccccugggaacacuguugaaaggauucuuacauuggguggguggcucauuccaaccagauauugcuacaguucuucaaaacacauaauugcauaauguaaggggaaccugguuuuccagcuuuguucagcucucacauucuauuuguucuauuaaagacuauauugacuuuggaaaguaauuuggcaguauuacacuacagcagcuuuacuccuuuuuuuuuuuuauugaucauucuuggguguuucucgcagagggggauuuggcagggucacaggacaauaguggagggaaggucagcagauaaacaagugaacaaaggucucugguuuuccuaggcagaggacccuguggccuuccgcaguguuugugucccugauuacuugagaucagggauuggugaugacucuuaacgagcaugcugccuucaagcaucuguuuaacaaagcacaucuugcaccgcccuuaauccauucaacccugaguggauacagcacauguuucagagagcacaggguuggggguaaggucacagaucaacaggaucccaaggcagaagaauuuuucuuaguacagaacaaaaugaaaagucucccaugucuaccucuuucuacacagacacggcaaccauccgauuucucaaucuuucccccaccuuuccccccuuucuauuccacaaaaccgccauugucaucauggcccguucucaaugagcuguuggguacaccucccagacggggugguggccgggcagaggggcuccucacuucccaguaggggcggccgggcagaggcaccccucaccucccggagggggcggcuggccgggcagggggcugaccccccaccucccacccggacggggcggcuggccgggcagggggcugacccccccaccucccucccggacggggcggcuggccgggcagaggggcuccucacuucccaguaggggcggccgggcagaggcgccccucacuucccggauggggcggcuggccgggcggggggggcugacccccccaccucccucccggacagggcagcuggccaggcagaggggcuccucacuucccaguaggggcggccgggcagaggcgccccucaccucccggacggggcggcuggccgggcggggggcugacccccccaccucccucccggacggggcggcuggccgggcagaggggcuccucacuucccaguaggggcggccgggcagaggcgccccucaccuccuggacggggcggcuggccaggcggggggcugacccccccaccucccucccggacgagguggcugccgggcggagacacuccucaccucccagacgggguggcugcuggguggaggggcuccucacuucucagacggggcggcugccgggcggaggggcuccucacuucucagacggggcgguugccaggcagagggucuccucacuucucagacggggcgaccaggcagagacgcuccucacaucccggacggggcggcagggcagaggugcuccccacaucucagacgaugggcggccgggcagagacgcuccucacuucccagaugugaugguggccgggaagaggcgcuccucacuuccuagaugggauggcggccaggcagagacgcuccucacuuuccagacugggcagccaggcagaggggcuccucacaucccagaugaugggcggccaggcggagaugcuccucacuucccagacgggguggcggccaggcagaggcugcaaucucagcacuuugggaggccaaggcaggcugauucugguacaagcuccuuuucucaucgcagaccugcaguuugaguagcguugcuuaaguuacacuguauaaacauuuaucuccucuugagaggugaagcuggcuaggcuucagggucagguggggacuuggagaacuuuucugaaucagcuuuacuccuaauuauacucccuagagaaugcucaugugcaaagcagaaauguaguauuugcaacaccaaaaaaaaaaaguuaaauuaaauguccauccaacagagaauggacaaauaaacucauacaaagaguaucacagagaagugaaaaucagagaauagagcuacauauaguaaauauaggugaaucucaaaaacaugauguaaagcauaaaaagcagucugaagaaucgguauauggccgggcauggugucucaugccuguaaucccagcacuuugggaggcugaggcagguggaucacuugaggccaggaguuugagacuagccugggcaacauggugaaaccccgucuccacuaaaaauacaaaaauuagccaaagggggaggggaguggcacaugccuguggucccagcuacuugggaggcugaggcaggagaaucccucgaaccugggagaugggcaagggagugagacucuaucucaaaaaaaaaaaaaaauagguguaguaugauaucauaauaauguuauauacugugccugguagggucccaguaggaagcagaaggcacauccagaugcaacuggaauucuaaagagaaggaaaagaagggacauuuauagaggucucagaaagaggagauuguuuaauaaccacagauuccucccauuccauuauuuauucccuauuugcugcuccuuauacccagagaaggaauccauuuucccaucccuuuuaaucugggcuggcuuugugacugguuuuaacaaauaggcugaagcaaaagugauuuggggugaguuccagaggucuugugauuuuugccuugaccuuuuuggaaugcuucugacuucauguaaaggagccugcacuggccuacuggaagccuuuuggagagaaagauacaaccaacagucauuaccaaccaggacgagcugacauugacagacuacaaauguacaaugagcccaaucagcaccacuuggagcagaagaacugccuaggugagcccaagucaaauuaccaaccuacagaauaaugagcaaagaacugguuauuguuuuaagccacuaguuuuuggguguuuuguuaugaauauauaaucaacauaguggaaucaaggaaccaacgagguucugagguuuccaggaacuagcaaguugggaguuaccugaaggggcaaguauaggaggcaguguuacaggaacccggugggggccugagggucagaggagaggcugucaggcaggccccaggaucacauaaccauagcaaggaggaagugugguaggaaauaccccgaucucucucuccuccugccccggcugcaaucucuugccaggcucuuuggcugaacccaauaagaaccagauaacaagggcaucugggagaugcccucuacugggagcagucucugaggcacagagauggaucuggguaggacaguggcaaacagaauaaccaggauguauauuguucacaaacagcagaccauacacacauuuaagggaaugagaaaccucaaaguuacuuuugggaaggagggauuuuuaccuuaaauagaagagcagguacaugaguacucauuauguucccauauauacuuuuucuuugguaugucugaaaucagucacauuuaaggggaaauuaagccaccauugagucacagccugggugaccuuggaaacaccacuugaccucugcaagucucauuuucucuguaaaaugagggugacaacacuccccucauggaauccacaugggguaaagcuugugaauguaugaucgcagugucugccagccagguaauuuuuaaguaguuaguucugucacacauaagaaaucacauacaaggauguguguguguguauaugugugugugugugugagagagagagagugagagagagagaaagggagagagagaaagagagagaaaggcagacaaauagaaaaacagagagagauaauacucuauuuuggugaaaaccauuaucugcauguaaaguaagggaacucuuaaugccuuuccagcuacccugucaugcgcaaucuccucgccaccaagcaccauacaccuacuacacacacacacagaggcacacacauacacacuuaugcucugucacacacacgcaugaacacacacucacacuugcucucauacacaugcacaaacacacaugcagguacacagagaggcacauaaacacauauucaugcucacacaucugugcauguagacacgcacacauacaugcauacacaugcacagacacaugcaggcacacaugcacagcgaccucauaaggcccaccaagugccuguuaagacaagcaggagucaaccuccuuccuucagcuugucauuuuuccugcaggccgggcuuccuccaacccagcgcuauggcauuugcugacacggaauuaggacauauaaauaggaaagcaggcucaugccuguaaucucagcacuuugggaggccgaggcggguggaucacuugaggucaggaauuugagaccaaccuggccaauauggugaaacccuguuucuacuaaaaauacaaaaauuagucaggugugguggcacacacuuguaaucccaguuacucgggaggcugaggcaggggaauuguucaaacugggguggcagagguugcaaugagcugagaucaugccacugcaguccagccugagugacagagcgagacucugucuccagugaaaaagagaaagugccauuuuguggggguugagaaucagcaccuuuuauuucagucuguugaaguccugccaccugccuccugcuacugcugugacuugaaccacuugugugacaucucuugaaaaccagcuucuucuucagaaaaaugggaguagugacaauaccuuucccagggcaugcuguaggcacuaaaugggagaaugugggugacucagcaccaggccuggcacacaguaagugcucaauaaauggcacagggguugcugaguuuuagacucaagucucuccaucuccagcaccugugucuggaugaaagauccuucuuggugugaugggcagguaaauaaguuuguuggccccucccucccucucucuuucccucccucccucuuucccucccuugcucucuuugcaguugaggaugggggaagagacgaaauaauuccugcauaauauuugucuaaaaggaauguguaagauaaaacagugugugugaggccugucuuuuuuuuuuuaauagccccauagcaccuggcauaggugggcaccacaggaucuaugaugauugaaaggaguguuuucaaauucagcugucaaagacagggcaaucauccugccuccugccuggaaagugauuuacaauuuuccuccuugguggcauccuaaggcaaacaggcacuuuuguuuccauggagaacccacucuucccucuaagguagaugauccuccccgccucgcuccuucucucccucuccccuuuccuuccuccucccucucucccugcauuccuuacuucccccccucuuucuuucucucucccuuccucuuccccuuuccuuucucucucucccccacuuuacuccucagucucuccagcccuuuccuccucccacagaggcuucugccccagaagggccaaacacuacccuucagcuuuguccccaggaagggcuaugcccaucccuccuuccucccccuauggagaggugagacccucugagggcuuagaaguuuugcccuagcucuuuggacuguuuucuucuuaagaaacuguuuacucaaagagcucagagcuccuugagaaccaucuacccaggacccaggaaccaucuaccuggguccccaggccaggccccgggaggcugcacgguggucucggcuccaguccgaaggccaagugcaaguguacgugccaccucaucucucaguuucuucaccggcaaagugagagcaacucucccaggagcugccaugagaaagagcugagggccaggggcuagagaguugccaugagaaagagcugagggccaggggcuagagaguuuccuuucuguagguccucuggcucacucagcugauaccucugccuuuuggccuugaaauuaacuuaacagcccaaaaaggagaacccaggacgcuccucagccugauggcaagggauccucuggagauugauuguugagugggauccuaggagugccgucuuuauccagagcugaggcccugcggugggcaugggcaggcggaacaguuggggacucuggggcugucuucacccuugguaucuguggagcuucagaaaugccaguaaccaccaagagcagugucucaguauuuggaacacauaagaagauaaagcuaaucucagagugugugucuguuuccugugagcagcuccaaaugugugcuccuuaguguguaugugugugcgugcccuccccaccagugggggagcaggaaguucgaacaacagccauuuauuuauuuugcaucagaugcaggcuacagugacagaaugugaaucuuggacgucuggucagaacacugggauguucaacuccgaguggaugagccuggucugggaaaccgggagcccuaaccuggagccccaauguccccccagugcccaccucagggcaccaucucuguguuagagaagaucuguguccguguggccucuuucugcucaagguggggcuuacugucagguacccaagcucagguuuucaugcauuuccagaauauaaguaucacuucugucuguguuuuguuacgaauaauuaugcagauuuuuagguggccccugcuaaauauauggugaugcuucuuuccuuuuacccucccccaucucucuaacucccacauauacucagcaccuucucugggccaggacaucuuccaugugcacucagcacacacagaugauucagaacuagucccugcccgugagaaacuucuagucuguuuugggggaagauaagccaggcuauggcaauaguguacaguccugaaggggacacagagugggcguucugggagcacagaggagagccccuauccucccagggaacccaaaaacgguguuagggaugggaggaugauagaagaggcuuuguaagaauagcugcuguguuacagaggugggcuguggggagcaggacagagucauaaucucguuucuggaagauguaagaggcccuguaguuucuugcaaaaaaugacugggcuuguguguuacugucacagcuuuguacuagaaagacacauuuaaacacauuuaauggaauggcaagcaauacagggaaaacgaggagggggagaugagcacccuucggucuccaugaauuaccaacuuagcuccucaaagcagagaaggaacaugagaggaggagaugaacuuacugcucaccuauugcauuucagucuacuuuaaacaugaucucauucaguccucaucagcaacucuguaguagauuuauuaaccccauuuuacaguugaggagacugaggcucaggcuaaguaacuguccaagcaaagagcaggauuuuaaacuacgaucucuauggcucaguuccugagucugugcucucuuuccaacaaacccuauugcucacaagaaccuucuauagagaacacagcauuguggucaaugaacuccuugucgaggaucauaaacucagaauucaauauaaagucacuauuauuccagaaaaaaaaaaaagaaaagaaaaacccugaugcccgccuccuuugaaaaaauagcaugccuuagugagaugggcuauuaauauacuuugucgcugacaucaguauugcaggcugguucuuugggagagccaggaugaugcuaauuugcaugcugcuuugcauuuauuugcauucucucuccauaugcaaaauccaacacagcuaauuagugcaaccuuguuacaaugagaagcaggcccggcguucagugccagggcagauggagaccagaacagggacagaaccaacccaaagccaggcacguccuggguuggacacaccgggagacuugaaggggaggcacaugcccugaaugaaaaguaguguaacugagcaccauuauucuucaaauauuguuccuuugaaguagcuauugcagagaaggagggugagagagagaaaaugacggugggcgguggguggggaggggauggagagaucgaagaagguggccagaacuuugccucaggcaggauuuuguuugagaaagagcacaggauuuggaucccaaaggcuucagguaaaguccugcuuggaguuuggcuucgccacuuacaaacugugggaccuugcacuucauggguuugcagggauuacaugggaaaaagaggguggacaugcacuuuuugcaaaugguaaugcacaauauagaugugaggaauccaagccaugccauaugaccauggagggcagcaccagagccagguggggucugcagacucagccuccucuugggguccagacccuggaugugauccacaauauagagauauauuauaacauauggaugauauagcauguguguauguacauauauauauauauauguguguguguguguguauacacacacacaugcuagcauuuaaugaucaucuaauauggaccacauacugugcugugcuugugcaccuaucaaucauuucuuuuagugauucccaugaccgcucuaagaccugcuuauuauuaugaccccaucuuacagauaucacuaaggcaaaaaaugcuugccaagugcacuagggcacucuugccaaaugauugggaauucauauuuuaugucacccacuuccuuuuccagcuccuauggagacuauggcauuucuguuaaucugcuuuuuuucacauugccuaguugugauaauuuugauuuggccuuggguuuuguuugugucaucugaggacuucuuccucucaacuggucauuuugguuggucucgaauauuucagcucuguguuucauuacuuaaaguggcccguucuacaaggguagcuccaaucaagcaagguagauugaaguauuguucacagauauucacugggcuucauagaaggagaauuauauuauccugccccauggguauacagcaugguuauguagcuugcucuggccaaugaaaggugaguggaagugagaccugucauuaccaggcagaaggcagcaugugguuuaucauaguugucuuucucuucuacccugaugauaggcgaaguugcagacagagucugcuucccagaggguccagcaguuucaaaggcaacuggugaagaacaagucaugcgaauaagaaauaaacauuuguuguaauuguaagccuucaugauuuguuacaggagcacgaacuagcauauucugacuaaaacauucauugucuauugaauauuaugagauuagcucuuacaggauggccuuucuccuaaauugcagaggcacauuauucgagcgcccugugaacuggcuguaguuguuucuguggauggccggacaauucucccaaugauauugccauuacucaaaauauuuucuacuuccauucaaaaaacugcuuuacauuauaaaaguacuaaacuccugauaacacuaguacuccugcuaacagccaauacuuucuaagauuuucuuauuuaaucuucacaaaagcuaugugagauagguguucuuaauuuucauuuuccaaacaagaaaaacagaagcucagaaaucuucgguaaugcauucaagaucacacagcuaagcagagagucaagauugaaaucagcauucgucucaggcacaaacccuaaucucauuacuacucauauuuucccccuccaaaauggauauuaacuagcugagucacacaccucauuugccagagauggcugcaaagauuuugucugcuaugaaaagcaaaguaauuauaaugaaaauaacguuagacuugauauuaggagauguggaguugguucacagcuguuucuaguaaguccagugaccuugaguuagaugauuuuccucucuggacccugguauuuuccucuguaaaaugaagaacuuugccucagaaaacauaguguauggaucuggccaacagaguccuucagucuccuaaaaguguaugcaaaacauuguguaugaauguauuuuucugagucaaggaucuauacuauucaucaggucuuggaaggagccuguuacuugcagaagaugaggaacucuaauucucugacuuguugaaaugauuuaucacuuuccucagaauugggugugcaggcaaaaagaauucagucugaaaaaaauggcaguuaaauuuuguagggugagugucagauucaucaaagaauaacuggaaggcaagcuguaucauuucauuuaaaaaucauuaacaaauguuucugccucacauuccugugguuccuuauugcuuacucugcauagaagcuguucauucaucuccucagccagggacugugucauuaguuguggcuauuggucauuuccugucucauucagcaaguaaucauauuauuuugacugggaagagaaugaguccugagcugugaacucagucucacaauaacuugaggauguauuucuuugaaugugggagaaaacgaaaacagagcaggaaaauaacauucauugagccccuaugauaucccaagcucuucaauggcauuuucuucuuuuuuuagucacauaggucuauuuucaaccaaaauuuugggguaacuaucauccauuggccacuguuuuaggugcugcggauauagaaaugaacaaucagaccaaaaaaaaucacauucugugagcuuauguucuggugggggagaaaaaaaugugcuaguaaaauuuaguaaaaaauauauuaguaaaauauauaugcuuacauaugcuacugcgguauaugcgauauccucguauuacaggaucagagacauucaauaccauugauuauuguuauuucuauaucuaugucucugucuauaucuauaucuaucuauaucuaaucaguuauugaccucuuuauuaucauagugucucucaaugucucuaguaauccugcaguuuauuuugucugacauuaauauagccacucuagcuuucuuaugcuuauugauugcaugguaucuuuuuuauucucuuaccuuuaaccugcuugggucuuaauuuuaaaauaugucccuuguugaaagcauauaguugguucuuaauuuuuuauucaguuugaaacucucucuuuuuuuuugagacaagagucucacucuguugcccaggcuggagugcagugacaugaucuuagcucacuggaaccucugccuccugggcucaagcgagucuuguggacucuuucccuuuucuuugagguuauuauaauuauugguaaauuuguauugaggucaucuauuuuuaucuuuauuauuuaucucauuuguuuuuuauuuuuucucucuuuuccugccuucuuguuuaccaaguuuuuuuuaauauuuuguuucaauuccuuguuuucuaucuauaucucucugauauuucuguguuugauuucucuauggaucuuugaguuaauauuaaacuaauucugauuuaucugaaaauaucucuuccaccuucauuuuuuaagcaaaauaauuagaaacacaauucuugauugauaauuuauuuuguuuuaacugcacuuugcuguuucaauaucuucugauuuacagaguuucugaugagaugucugccauagauuuuauuguuaguuuccuauuggaauguauuauuucuucugguugcuuccaagguuuuagcuuuauguuaugcuucuggccaaagauagucauaguuuuacugugauguguucaagaauauaugucuuugugcuuauuacgcuauagguuuguuaaguuuuggggaccuuuaaauuaaucauuuacacccacuuugggaacgcuccgaccacuauauauucaaacaacauuuauauuccuuucuacgacuuuacuucuucuauucuuauuauauacauguuggaucaugcuugauauugucucauaggucuuugaacuuccguuuuccuuaaauauuuuaaauuucuguuauuugaaucaaaucauuucuauugcucuaucuucauauucacugauuuuuuucuucugauaucucuaaaauuuaacuaauuuuucuuuagagcuauaauuuccauuguaauaguuucuaauuccccauuugaauuccuuauuagacaauucauucaugucacauuuugaaacacuuuucugcugacuacaguaucuuugcaaugccauguuuuuuuuuauugccuuuuuuuccuuaguaugggucacuguuuucuguuucuuugcauguguaguaauuuaugguugaaaagcagacuuuguagauaacacauuauagugacacuggauuauguuguguacuuuugaggauuauugcauuuuuguuauaguaaguaguuaacuuaaaaggauucaaagcucaaauguuaucucucuuguaguguguagcaccugauagccuuagucucuucuuauggcuuccaguguuguauuuuuagccugacucucuggggaucuccuaggugccuacaaaacuugguuauuugccaagaauuugggcggugugagguucacccucucaguuuuguuuucuucuaggcuuuuccccuaauuucuaguuugucuacccaccucagguuuucuauccuuacauuucaggccuauaagacuuccuuuuucugccgcccaagcugugcaaaaugggaaagacacguaauuaaaaaaaauaauaauagaaaacucacagaucuuauccuuuguaguucuaucuuuaaagaguaaauguccagcuggucuacuuaugccuuuuacuggucccuuugggaugcuccugugcauguacaguuuagcugucagcugaggaauuuggcagaauuuauaacugguguuuauaucucacuacuucugugauucucauugccaggaaucauucuuuaaaguguuaccuccucuucuaucccuauaucccgaccucuggcacuuuaggccaguaagauuauggguuuucgcaucugcagccacggggaucacagagcacccucaauugagaaagcuguaaauuaccaauccuucucacaguugugguuuuucaggauuaaacucuccucuggcuacugucugguuugggaugcuuuccagugucuuuaaauuguuuaaaguuuuaaaauccaguuuuuauaauagccaucugcaggaggauucauguaaccacucuacucccguaccauugcuccuaauuagauuuggcccugggaaaauacuauguguaagacacgcaggguggggugaaaaguuuuucuguuucagacaucuuauuaagcugaguccauuuuuuugucauuuggucuccuuucauuccuuuuuaucuccugugaaauuccuagcggcuaugucuucaaauaaaauguaagcucuugaggcuagagcucuucaugaaauagaacuggguaugcugaaaaccuucaguaaauuauacagccucaucaauaacaauaacuauggugaaaauaaaagcaauugguccucuuaaugcauuccuacuagaggaauaagcacuuacuauggauucuacacuguauuugcuuugcacuacauugauuuagagauggaagauugaauguaauggcagccaccuggaugcuuucuucugaacacccaagguuuauucaauuuugucauucaccucuuuugaaucuaaggcuggcauauauugguuuugccugcccugcagccauccucccuuuugauccaaugucuuaauuucuccuucuggaaccauccuugacucauccagaugagugggaccaagugcaauaggucuauguccaggauaauuaaaaugucccuguccuuggcuggggacugaacauguaauaugauccagguggguccacugaaauuuauuccugaaaaucuuuuuuuuuuugaacuuuggagaaaaagaaauucuccuucaccugauauugcuaagaagauugagaaugaaacuuuauugacuucucacuauuaauaacuucaaagaaaaauaaaagcaauguggauuuggucauugguuuuuuaguccuauuucuggagagauggaagccaccuugacgucuccugggaagagucuaccucacugaaaucaaaacaggagaaauuauacuuaaaagauggcauuuguuuguguuccuggaagcagccaucucggaaacuuuuauaccuaaaguuuacaucugaauuuuuuaguaaccugagcucauacauuucuuuuaugccaaagucaguaugagguaguuagguuucuaucacuugggacccaaggaacccugacuaaaaaguaauaauuaauugucucuuuagaucucacggaugcauuagaaucacccaagacccgacauaacuguaguggguugaauaauaucuccccagaguucauguccacauagaacuucagaauguaaccuuauuuugaaauagggucuuugcagacguugaaaguugagaugcuaucauaccggauuaauguggguccuaaaucuaauggcuguugugguuguaagaagaggagagaauacacagagacacgaagaagaaggugaugcaaagaugaaagcauagauuagagugaugcaucuacaagacaaggaauguaaagguuuaccaguagucaccagagguuggaaaaaucaaggaaggauucucuccuguagccuucaaaggcagcauggcucugcccacacuuugauuucagaauccuagacuucagacugagauagaauaaauuucuauuguuauaagccacccacuuugugguaguuuguuaugauagcucuaggagacuaauacuguaauucccacuuaucuuuccagccucauuauagaggcaacagagagcacagcggauagugguacagacccuggaauuggacucuuugaauucaaauuuuggccauuuuacuuaaaucucuguaguaguccagguuuuccagauaagcagaauuuauaggagauagauauauuaaaaagagguucauuauaaggauuugguucacauggguaugcaggcugagaaauuccaagauccaaagucagcaagacccaggagagcugauaguauaguucugguccagguacuaaggccugaggaaaagaucaaugucccgggucagcagcagucaggcagagaaugaauuaucucucauucagucucauucucuucagcccuucaaugaauugaauggggcucacuugcauuggagcaggcaaucugcuuuacucauccaccauuucauaauaauuucacugagaaacauccucaagacacaaccagaauaauguuuaaucaaacaucuagguaucccaagucccaaucaaauugagacaugaaauuaacuaucacauccugggucucaguuaccuaacagagcuaauaagaguaauaacucccuucuuaauaagguuguggugagaauaaaaugaguuuauauuuuaaagcacuuaaaacaggcuuuggcacacaggaaacacuuaguaaauagcuauuguuaucauuuauuaucauuaucauuaucacucucuccugccacagccccacaaaugcugccugcuccaacuauaguaaacuguuuguaguucuucaaacagaacuuagaccaaggaacuugagagagcuucuugcucaggaucaaccagcuuccaugugucauauuauuucuuuucaauuuaccuuuuauuuuuaaauuuaaaaaauuauuuucaacuuuaguugacacauaauauuugcauuuguuggguacauggugauguuuuaauacauguauaaaauguguaaugauuaaauuaggauaauuagcauaucccucaccaaaaauauuuaugauuucuuuguggugagaacauucaaaagccuccuccuagcaauuuugaaauagauaauauauuaacuauagucacccaacugugcaauggagcacuagaaaugauuccugcugucggucuaacuguaccuuuguacccauugaccaaccucucccuauucccccguucuccccauccaugugucugauuuagaauucaaauccugguuugcuucuaugcauaacaggcacaaugacuuauuccagagcaaaaauagugaaugguguggaaggccccucucuccauuucuccaaccuauucuuuauccugagcccucuccccuagcugucagggcuuuugaccaaguucaguaaucacacuguggucguaggggauggcccgcacucugaacagaaguguuaauuuuacuuaaggccugccugaguuuucuucccuacaguaacagacuccuccucuugucuuuaaaaucaggaaauagcuuuguuuuuggggagggagggaaggggaacuuuaaaaagcucauuacuucuauuugucauauuugcaaucaguaagacauacccuaaaagaacuuuuauaagcuuagaaagacagacuagaaaggagggcccauaaaccuuuacagauauuucugauaaaaacaagugggaaacauucuucaguguucuauaaacuuugccuucgaagccuguauugaucuugucuuggucucugucaacacagguaucccuugggucaauauauccugauuuuccaucccagcacaggcuggaaugaagaaacgacuuuuugauauuuccagucaagacauuuucuuuguguugaggacauaaacacugucacaacccuagagagguaauaccuguguauacauaagauauacauaguuuuuaaaaugucuccuauuccccucauugugugauacuuuuugugauaaccuguccuuuuuucugccugucccuuuccccugugucccuauuucuuauccuuuuuuuuuuuuucuuuuuuugagaggcaguuuugcucugucaccagggcuggagugcaguggcaugaucucggcucauugcaaccuccaccuccagaguuugagcgauucuccugccucagccucccaaguagcugggauuacaggugugcaccaccauguccuguuaauuuuuuuauuuuuagucaagacaggguuucaccauguuggccaggcuggucucgaacuccugaccucagaugauccacccaccuuggccucccaaauugcugggauuacaagugcgagccaccacgcccgacccccuauuucuuuucacccaucuccauggaugucuuucugccuuuucacuguacucauuucucucaucugcauuucucuguuucuguuucugucucaggucucacaacagaucuuccauugacuguuuaucaugagaaaauaauguuucuuucaagucuagagcuaauugccaaacucuuuagcuuuucuugucuccuaaauugggauaaguucaucaaguuuuuauuuccucuccuacuacaaaggggccauccuguaacaggaaguuuuauucuauaaaauaaaguuuuauccugagcagggucagcaaacucuuucuguaaaggaucagauaguaauuacucuuuggcuuuguuggucauacauaggucucuguugcaauuacugaccuuugccauugcagugagcaaaacagagccauaggcaaugugcagacacgccaugugucuguguuuccaauaaaacuuuauucguaaagaaaaaguaguuugccagugucuguucuagaacauuccuugugaaagaugaggugauuugguguauuucugauuuucuuacuugguuuuauccucuuggugugguugcccaagauugcaccauuaagagugcgacuagauuugaaccaggucugccugaauccaagcucaugcuuauuccuccuucaucacacuucuucuccagggauacaaguuuuugcugaggcagacuggagucauuuuuccuuuccaaacaucuuuaauggcuuuucuuugcccauuuaauaaggaguuguuuccuuagccuggcaucuaagucucacuaaaguaggguuccaaccucuuuuuucaagcuucugguccacugggccuuuccccagaacuuccacugugucuguccccuuuuacccacucacucuuugccaggcagcugaagugcauuuucacugcugcuccaaggacugcguggccccccugccaggaacaccuucccuuguuccuauaucugucuuucucuacuuucaagacaaguugaauuccacuuauggaaucuggguuagauacucuccuagguauucuaguauaacacucaccuaccuaaaacucuccaacaccuuuccaucacacucaccauggcuuacaaaguccucugugcucuguccacuggugaccauagccucucccacaaccagaaccccccaccuccacuuacccagcucuacauguaccuggcuucauggcuguaugugaagcacucucccaccucacugaaugcucuucuucuuuuuguauaacucacuuccuuccaccauucagaucucuccuuaaauauaauccccuucaacaucccuucccuggcuacgugauguaacacagcauaccccaaagcuguuauggggccuuguuuuaauuuucauauuaccccauaugaaaaaccugacaauauaguauauguucauuuguucauugccuucuccccaaguaaauggaaagccccucaaaaaaagggcucuucauguuuuauucaccaaauugaucaacugcuuaaucaacauuuguugacugaaugaggccaucagcagaauaaaacucauucugggaaaaacauaaacaaaagauagagcaauucaggcaucagauaaguguuugaaccaaaucccuuuacaacccuucugauucuaagguuugaugacuugaggugauacuaucucucucugaaaaucagaucacccccuugacuucuguguuucuguugauggguccgcuguccuuuuagucauucacgguuuaaaacacaccaucugucagaguauguugucaggccccuucuccauccuucagccuggcuuccuauacauguuggcuucaugccaccuggcuggcuuucucuaugggguagagaacauggcuguauauauuuccaauuuguuuccuccuaguuuagcaacaucagcugagaaaagacuucucuuucccaauaucuguguauugauccagaaaaauauucugaguggcucuuguugaggaaucugcccaccacuggacuggucauuauuacaguggauggguuuuuaugauggaccuucuugcauccacuccugagacugaggguuagagugagacuacccugacggaagaccuauuagacccauuuggaauggaaaagguugugguuccuucgaggaaguagaaggacugggaagacaguagcagcacaugucuccuguguaguugccuauaaauguucuuaagaugcacuuuugauuguguuacuuccuugcugaaggaaacaaaaagggccagugccucuguguggaagucauggccagguccaugauguuccagcacuguggguguaggagguuucuagaagagcuggugagcuugcugaauacuugagguuagacuuuuucugcuccggagcacugucuuuagauggcugucuaaucaagcuuuucugaaaugcaccacccauuuucugucuuucuguuugcuucaaaugcuuuuucuuccuggaaugauuucuuccucugucuccaucugaacccacacagaagugcuuuacuccaguguuuucuaaacacuuucugaaaucuuuucuggugccccucccuugaauauucacagucuuuuuuuuucuuuucuuuuuuuuuuuuuuuuuuuugguacauuuguauuggcgcuucuacauaaacagguugagcguaaggacuucuuuuuuuuucuguuuuauuuuugcauccccuccuguuccuauaauguuucuggaaggcacaauuaauauucauuggacugaauuuaaugaaacagaguuaaauauaucagucuaccuaacaucuauagucucuaucauucauuuaguauuuacauuugccaaccucuauuguuauuuacuucuuuaugcauauuugucuaagcaggauuacuauuaucuagcauggagccuucacaacauuagguugccaaaagauguuuuguucaaugugacacauauugauugugugccuuuuauaugcugagcacuaauaucggggcuacggcuacaacagagaacauggcagaccugcuugcugccuuuauagagacccuagucuauucugggaguaagauaaugaaaugugcauuuauagaacugugugcugagagcugagaugggagaggggagcugccagagaauauggguggguuggggaaauguugcuuaaucuguguuugugagaugaaugacuagggaaguuaugagugagaaauagccauuuucuuucuugaagauguccucuucuucaacuuauacuaaagcccucacauagggcuaagccccgucuuguaguuugguuuuccauagugcugucuuuuuuccuuucuuauugcauuuaacacauuauauugaaauguagguguaccucuguagucugcuuacacacagaaaacagauuguaucacacucaacaggucugucccuggcaucuagcacuaugcuugguacauaaugaauguucaagaaaugucuguugggugcaaaaaaaaaaaugagcuaaacaaaguggaucugaguuguguuggggaaaaugagagguuuaucagaaaggugcguugaugggggcaccuuaaggccaggguaauaaacuccaagcauuuauggaacaugacucuuuguuacagaagaggggguaaaggagccuggggacagugacaaagacugauguucugauguuguuugaagcgagauaauuucauagcuucaaauagggaagcacaugaccauuugugcuagaccagaggacaauagaccuugacucacaaccacagaggcaggggagauggaguuacuaucuucugccaagagguuacucaaaauuaaaccuuccucccaacucccaaaagccagagccauggccuugucugggauuugccuuguuuagaagaagucuguucuuuggcacauggguuuguuuuccuucuucaaaaacaaaaauagacucaguccuugaguaaacucuucucaggguaaggaaggggguuuugaagugcagucagaaaaauggauacugaaugaacagauacccuugggaacugucgcccuaggcaggggaaguggggagaagugagaguuguggugguuaucuguuaccaccaggaaugugauaacugcuaaucauuauuauuguuauuuucucacauucacugugguauaaccauaugccaggcaccaugcugggcacaugacauggacauuaucauuuguuucagaaaacaaccuccuguuguagagacuaccaguauccucauuuugcagauagguaauugaggcagggaauaauuuacugagcauuaauuugugccaaauagaauacugaguggcacauagagcucauguaauucucccaacagcuuuauaaaguagguaccuuguaauacuucuugguaagaggauaacugguauaaaguuucuguuaugccaguugucuaucagauaacugagacccuaagaugugaagucauuguucagagucacacaguaaaugguguugaaauuggaaucuguguuccaauaagcagaccuggaagcccccguaaccuuccacuccauggcacaaaucugccuccuagaccaggcaugugucuauggguaacaaggaggggguuauggggagugauugggggcacuaagagugaucaggacaccugaaguucagagaccugaacuuaaaaauaguaguaauuguuaauuuucugcuccuguguucagggacuugaucuagauuguguugaguucuagcagcccuucucuaauagggcagccauuauccccauuuuacaaccuaggaaagugagacuucagauggcuaaaucacuugcuaaauguuacuaagcuacucaguggggaagcugggcuuugaauauagguccacuaagaacuuaagccaguguggacucuucuaggagaccuucccccugguucucaagucuauacacaugaacccuacuuuaucugcuaaaacaaaauauaucugcagaacaaaauauaucugcauguuacagggcaaaagccucuaggaagaugaaauuggauucagaaaggugaaauauuuuaugauggucaaaacauaauuggugacacuaagcacauauagucaggauuacuauccagagcaucauacuugcagguuucauguggguguggcaagggcgagcacacauggccccuugcucagaagagccccaggcuugguuuaaugcucuguagucacuagcuugaaacucuuacagauuuuuaucuuugaauuugaguuuuguaaguaaagucugaugggguaaugcagcauguaagugaugagaggagauaggcacuguaucacauuucuuguuuaucacauaucguccuugccaugccccaugaggacagaauucugguggauccacaaagcccagaaguucaauggaacucacagccaguacgagauaagugugugaugaaagccgccagccauuuugacuguugguauaacguguguguauugaaagguaaaauaaacauaacugaguuuguuuugggcaguguuuuuauucuuuugguaagaacaaaauauaccugcguguauaggcuagaaaguacaaauuggguaauuuugaugauucuguauguggauucaaugcucuuauacuugcacuuaaaacuggaauuguacaauauaaagaugaaugauaaaauguaugcugaugauuuaaaauauuuauuaugccuuacuuauauuuauauuaaauaaaaaauuuaaaacagcaugacaagucaaaagagagacugacagaaaggaaauaguuuuauauuuuauuaauaguacuuugaaugauaauuucccccugcuuuuccaagaaggggacucucauuuuuaucauguugucagcucugcuuucuugugagaacagcaacuugaggcucagagaggucagugacuugucuuaggucuaggaguugacaaucauccaaguguccacagucugauuuugcuggccugcuggggauggcuggacucggaaucucugaacaguuggguggugacacuucuauuucaacacccauuuuuacagacuaguucacucauuccuauagacugguucucccuagugcuaaggagaauagaaauaguuaggaacuuggauucuucucauuuuuccuacuucuguuccuaucuguagacaaacuuaucucuagaccaacuugaaguacgaugaagaagcacuggaugaaaaaacuuagaaaauaugcauguauaaguuaguuauuguuaguuguguauucaaguugcuguucuaucccuucuagcugggagauuuuggguaucuguuaaaaaaaccucuaaacuggagccauuugucuucugauucucuaccuucacaucuucucauacugaggucaaguguaccuccucccagaauccuuaccugauucuaccugagaauacugagauggagaauuuaaguauagacuucaggucccgcagcuuaaucagggauucacaucuaucuauuauguauauuguuucacuuuccugacuauuuuauucuuuuuccugccucaggacauuugcacaugcuguuucccagaaaaaucccucaccccacaccccaccaggacuugaaggcagccuccugcugauccuucaguccucaaucucauugucccugcuggaagaaacuuuuccuauucuccuaucuggagguugcuguauuacucucucuucucuccucuggcacccuguucucuuuccuucauaaugccaccacaacuuuuaaucuuauaccaacuucuucauuuauuaguuaaugucuaugacccucuauaaacucuacaaagacagggacagugguguuuuuauaacuugaccaccauuaccugucccuuuaucauaucacagaauugugagugcacaauuaacuuuuuuaauauuuauuuuugguggggaucaggauugaacaaauuaaggagaaguuguaaguauagcgagaggaaggaggacaaccuggggaaugcaaaaaacuuacucuccccaagggaguuuggugauggaggcaagagggcaagguaccugggcacaccugugaagcuguugugugcucuguggcuuggcuauucugcagucacagguuccuaagugugcugcuguggcgaccagggggugucucucgugugggugguccucccugaaguaugcagcugcugugcaggccgaggcccagcaagagcuuguccgaggccugauagauggaacagcccacagcauuuuucuugccugguugcuggcagcucucugacuucaaagcugggacacgcugacccagaacacugugaccuuuggcacgauuuccucuauccucuccccugcucgcccagcaaggaggaaggagcccagcucccuugaacugguuuuugcugccuggagggcaaauuuuucuuugauucagagacuggagaaagggagacauaggggaggacccgaggcaguugccuucugaacauccggggagccagacuggguuccacugugcuuggaauuuggcacuuugguaaacuggguggcagccugggagauuuucucuuucucagcuugaaauggguccuguuguuagaaguaccugccuagacucuggaaaaaacagggcagggccacuucuugucuaccagcccuugccauccagccucccaagugccaucugauuagaugagucaaauugcauucugauuuagcugagaguuacuaagggcucccugaguaacucuucugucaucuuugaaauguagauaguaauaggaacuuucuagaaccagcaugaggauuggagcugugugcauaaagugccuaagcacagugccuggcacaaggcagaagggaaucaauaaguaguagcugccaucaccaucaacagcgaugccguaguuuuuucuaggcugcccuaucacacauuuuauccuuuuggauugacacaaccccuucuuugaagaggaaacugagguugggaagugaucaaaucacucucccacaguaacauugcuaauauuuguuaaaauaaaggccacaaauccaagucugucccacugcauuuugggucuuccuuccuuccuuucuuuccuuuuuuccuuccuuccuuccuuuguuucuuuccuuuuuuccuuccuuccuuccuuccuuuguuucuuuccuuuuuuccuuccuucuuuccuuccuuccuucccuccuuccuuuucuccuucucucucuuucuuucuuucucucucuuuuuuaccauuuauguauguauguauguauguauuuauuuauuuauugccuuggcuuaccuccgugagccauggaaguagaaacuaguuuauguuguuggcaucugcugaagacauaugauugucacuguaaccaucacuaucaauaacagagagcagagauagcugccaacaccagcagaggacuuaauaguuuaugagguacuuucaccuacacugccauuuuggcauccacaaucuugcguuuguagauggaaaaaucaagaaaguuuuaagacagugacuucauagaguuacuuccuucuacauaguuaaggccuuauuugccuaugccagggagugauuagcuaauuccugggauauguacuuaugugaccucuuuuaaucucaacugugccaucuaugagcuuugugaccucaaucauucugugugucuuucuucaucuauaaaaugaagauaauuauagcaauaugagacaauauauaacaacugcuuaucacaguguccagaacauacaaaagcuugauaaauaauagauacauacuacuaucagguuggaaaaaauguauucuguugcuagaauuuuuuauuucuuuugcaaugauaguagcuggguaaaauuggacuuaaaaauauuaaauuccacaaaagcaaaaacugacaaauggaaucuaauuaaacuaaagaguuucugcacugcaaaagaaacuauuaacagaauaaacaggcaaccuacagaauagaagaaaauuuuugcaaacuaugcaucagacaaaggucuaauauccagcaucuauaauacacuuaaauuuacaagaacaaaccccaagcaaccccauaaacaguuggcaaaggacauaaacagacacuauccaaaagagggcauacaugcagccaacaaucauaugaaaaaaagcucaacaucagugaucauuagagaaaugcaaaucaaaagcacagugagacacugucuaacaccagucaaaaucgcuacuauuaaaaaguaaaaaaguggcugggcacaguggcucacgccuguaauccuagcacuuugggaggcugagguggaucaccugaggucaggaguuugacaccagccugaccaacaugaagaaauccugucucuacugaaaauacaaaauuagcuuggcauaguggugcaugccuguaaucacagcuacucaggagccugaggcaggagaaucgcuugaacccaggagguggagguuguggugagccgagauggugccauuguacuccagccugggcaacaagagaaaaacuccauuucaaaaaaaaaaaaaaaaaaaaguaaaaaaguaacagaucuggcaagguuguggagaaaaagaaacacauucacuguuggugggaguguaaauuagacacuguggcaauuucucaaagacguaaggacagaaauaccauucaaucaagcaaucucuuuacaggguauauacccaaaggaauguaaauuauucuauuauaaagauacaugcacuuguauguucacugcagcacaauucacaauagcaaagacauggaaucaaccuaaauaaagacuggagaaagaaaaugugguacauauacaccacggaauacuauacaaccauaaaaaagaaugagaucauguccuuugcagggacauggauggagcuggaggccauuauucuuagcaaacuaaugcaggaacagaaaaccaaauacugcauguuuucacuuauaagugggagcuaagugaugagaacacauggacauauagagagggacaacacacacuggggccuuucagagggugaagggugagagaaaggagaggaucaggaaaaacaacuaacagguacuaggcuuaauuccugggugaugaaauaaucuguacaaaaaacacccaugacaaaaauuuaccuauguuaccugcacuuguaugcauaaacuuaaaauaaguuaaaaaauuaaguuaaagaauacuaaggaaaccucugagcacuggggggauuaggcaggaacccauugcuuuuuaacuagaaauagcaaugcucaaggguaugguuuugguucaggaccaaggacagcacgaagcuugcucccuugccccgcacuugggacuuggccuguaggaccugaguaagaagucuaccucaaggcuuccuguucuguauuugccacaugucuccugacuucucugcaccugccuguggcauuuuucccaccuaaaauccuuuuuccucucuugucaugaaauauuuucaacauagcaagaagcauagggaauauacuaaucaccuuugcaccuaccacucacauuuaacacauguugacauuugccacaguuacuucugaucuuuucucuuuuaaaaugaaacuuggcagaggccgcuguagcuuuuuuacacaccuccucgucaauauuucuccuuccucuccagaggugacugugggccuucacuaucucccucuuuucucuaccccaguuaucuugcauucaacuaaauccuccacauuugaaagagccaggucaaggccccuguccuccagcucaugaugaccuuuccugcaugacauuauugcauucgauuuuggagagcuuauugugauuuauuauuuaucauccuagucauucauucaaccugugcugaacagacccuccuuugaugcagcacucuucuacuugcugggguugcaaaaaugagucccacauggucucugcuuccaagagcucacagaacauggcaugugggugaacauuaucuugcagugagaaggaaagcuuguugggagaaggacuugucuuuagaagucugccacagcuuuuacacaggaauuugaucucacauaaacacuuguggccuugugaucauaagacuggaaauggugugagaaucagaagcaagguagaggugucugccccaugucaggccuuauguaaggcucuggaaguauauuauuucauuuaauguuccacaaaccagcaagaugaguguuauaccuuucuuuaacagauguaaagucaaggguuggaggucagaaaugcaguucacauuugaacugaagcucuuuaaugucaaugccuguauugaucugucucccucuuuaggccauaaucaacucaagauagacugaacuuaauucaucucuguuucccaggcccagcacugucucugagcagauauuugaugugugaacauauaugcugcaguagaucucuggaauuaaaaggaaacaagaacacaugggccuugcccccaaggagcuuaccauuuaggugggcgggcagacuuugguaacaggugcaagaaagcagugccuaaaugccugucacacagcaagggauuucuacucuaaaugggaggggagaugacauucucuuugcugauccaggcuuuuaauuuaaucaggccaaaucacuuggggauacagaauuuucucaggaccccuguuuuacugcaguucagguugccucuuuuuccccaaacucugacauuccuggcucuaucccugucuucucuaucugccccauugcucugucacucuucagacuuugggcucaaacuugccacacagauucucugcucucuucuuucccuuuggugucucuugcugucuggaugagaaucuacugcuccaaccucaggggagcaaccaucagcuggaccaaacuccacuucaccaccuccaacucaagaaaaugugguauuuguacaugcacgcacaugcacauacacacacacacacauauauauauauauauauauacccuuuauauaauaauaaugauauauaaucccuuuuccaagaacccaugucuucuucaaaacagagucuggggcaggggcucuucuggguggcauagaccuccuuggcagauuggugaagccuaugaucucuucucagaauaaugacuuuaaaugaauuaaauaaagauacaugggauuucaaaggaaacuaauuauagcaaaaaacuguuauggaacaguacacgcacaugcacacacacacaaaugauauuaguuauccauugcugagcaacaaaaaguguauuagagcaacaggcauuuauuaucucccagucucugcaggucaggggccugggcguggcuuaauuggguccuuuugcuugagaucucucaugaggcugcaauucaggugucugccagagcuguagucaucuugagauggccuagggaugagccugcuuccaagcucacucacaggcuugugggcagaauuugguuucucacaagaugucuaacugagggccucauuuccucacugauucuuggccagaagcugcccucaguuucuugcuaugugggccucucuguggacagcucacaacguggccucuggcucugucagagugaggagguaagagggaaagugagugugagcaagaccaaagucauaaucuuuuauaaucuccucguggaugugacaccuccucaucuuugcccuauucuauccaugagaagcaagucacuagguucagcucacucucaagggagagcugaaaaugaguugugaaagccagaagguggagucauugaaggucaucuuagaagccugaguaccacaagugcucuauaugcuauuugaaggcaucaaagaagaucuagcagaaguucaguaacuaauguaacuuugaaauagacacgagggcaauauuucaugaucucugccacagcugacauaugauaugaaauuaucugucauuucuguggaugacaaaaaucacagcuauugcuaauaaacuguguguugucuacauacacaagugauagaaauacuaaauuucaauuacaggugagugcaaaucaagcuguauuuuuuccuuuuucuucccaggccuccaggugucugcauucugauccuugaagaguucauggaccuaaguuaagaaccucuccucaagagacugaaugcaggcagagauggcuuauugguucaucacagguuaugugaacuacccacuguaagauccccagauuacuuggggcuaaaaggugucccaagaggguuuacaacauugccagaaauuaguggggucacuucuguccagauucucguuuucagccuugugugucuaaaaaauauauuuuuuauucuguauucuaaggugagcaggguuuaagauuagacucacauuaacuagauuuguaagaggcagaaguauaaugcauauuuuauucacucaaucacucauauagucaaucauucauauagucuuccauuccuucggagcacacuguuaggcacacacugauugaccacuacugugugccaggcacaaaauacaugcuaggaucaguggucucugaauaguaguugaagacauaaucccggaucucugggaacugauggugguuuacagugguccucagcuucccuuuucucccaugacacaugcaugaccaugauauuuacucuagggaaauccauuuuacuuccacccauuccugcauuagcucacuuccauauagaaauuuuaaucucagaagagcuuuggaggaagcuucuauccuagucugcucuuccccaugaaagaauggcuuucagagucacagguguucucucagcuucuaccucuucuguaaggucaguccccugggacagcccuuucccugagucagggugauaggaggggugggaaagagaaggagggaggaaacgaaagagagaagcuugaaguuuucuagcuguaacugaguaagucaucucuaucagaagaggcaggagugggaaaccuguuuuugacucauuucuaagccauguguucuaauucauauuuaccagcaugggaaaacaguucaucccuaccuaacucucaggucuguggcucauuugagggggaaaaguauaauuaucaccaaacauuuuacacuuuccuauggccauguccagguucuccauguccuuacuacaacuccacaauuuuuuuuccccaaugcaagaauggcauuauuaaguccauaauucacuuuaauggaucuuuauucaacaaaucuguauuaagcacugggcuagacgcuaaggauugaagcaggaauaacaucaaggaggaagugcugcucuccuggagcuuacauucuggaggagagacacugguuacaaacaaguaaaccaagauauggaugagauucugaaaaguucuuuagaaaaaauaggccacaggcuggagagagaauaaccagaugacauuuauguugacaagguggccagggaagucuucacugagaagaaggcauuugacuugagaccuguaggacaagaagcugggcaggugaaggcugggcagagaacauuccaagcagagaaaacugcaugaggcuugaguuucagcugaagcuuggcaugucuggagaaagaaaaaguuugcauauuuuuacuuaauuguguucaaagaaaaauacaugugauaaucuugguuugauguacaagugguaugaaugcacagauuacuccuaaaagaauuuuucuuuauguguauauauguuacuaauuuuaccuaucacacuuugggaaaacuaaucacuuuuaggcccauacuagagaacuuauggauaauucuggagacuugaauaucuaccagccucaguaacugucuuucuagaacagcacuggauaaguccugccuuagucuuccuuuuauccuagacuacaaauauucucuucauguugauccacuuuaucuucaguuugacauaccuuagacuuuuaaacaauccauucacauagcaagcuucaugcaaugucauccaaaaagauuucuaauuucuauaaaguuuuggcccuucuuccugucuuuggugagauuccuucaccccuaaggaccucugcaauguuauaaauauucaccauuuauuauauauauauuuuuucucuagcuguuuccaaguuccuacucugggagcaagccguacccagcacuuccucuucucccucccugugucccacugccacugagugaagccacacucgguccgacuggcggaucuuucuacccucccuucccucuaaauauccuuuggccucaaaugcuaauugaagagcucagaaagaggacauuaagaagggggcuuucuggugggcaacaaugaaucaccggcagaaucacuguucagacaggcggagacgggucuuucucgcccucugaugagucaccacuguggugggggggaguggacagucagccagacagauaaugugucagucucucuccucagccugacccuggacaucaaaauagacugcgguucccuccuucugggcccauugcuggcauuugaccuaaugcuauagaaauuuaaaccaacaaggaggguaguaaaguuaagcuuucuaggccauugagcugaaguuuuaauauuguaacagagauucuuaagacaggcuugucacccuggccagugacuacccaaguaaugucuugcugacccaggccauccucuccaccgauauaaaugcucugugcuucaucucaauguucucaucguugaggucucguuucauuugacagugaaaaaugcagaccagaugaaaaccacuuucuacaaggcaaacaauaacaacagcuucugugaauuaaacaucuacugugccaggcacuuggcaaacaucaucucauuuaauucucacaccuucucaaguagguauggcucacucuacgauacagaccaugaaacugaggcucagaaaguugcagccauuucccccacguguucacggguaggaaaggguaaaacugacuauagaauaaggugauuauagaacuuaucauccaaaacagggcacuuuugaaaguaaaagggagaacuaguaauaauuucacagccacagaugcaaaggggaaaugucccagcaagccagaauauaaaaaugccugaguuuugaaccagucuuuuuggcucuacagcccagcccauucacccaauugguugucaggaagguaacaggagaaauuuguaaucagcuccccucauucucuuaugauuuuuuugcuugcuguuuccuuucccucucuuuucauucugagauaggaugaagcccaaaccucugugcuuucaagcagcccuguggacgauucugaugugcugccaggcaugaguacuccugacgauaugaucuuugaggacaggcauuuguucuuauucaucauuguauccuaauaaguaacauaugggcaugcaguaagugcuuaauaaaucuucauucaaugaaugaguauguuauugaaugaaugcaaugaugugcagaagcaagcagggaggaguaucacugugugucugaggaauauaaaugaguuuggggcauccauauaaagagaaaugagaaagaggaaacaguggacacaucugccaggcugagcuucaauuucaucauuaaggcagagccaccagucucugaguaggaaagugacacagucugauuugcauuuuggaaagaacauuugugugguuguguuccagguuaagccuaugagaaauuagacacugaagguauuuaaaacauguuuucaaaagggcuacugagugccuagcauaauauaaccuuuuacauauuugaacaauuuccaagcuggggcuagcaccaccccugcugggagucagaaucuggacacucucuggaccguaauugcucaccuuguugggacaccuaagagccacucuuucgggggaauguuuucugucuguuuguuuucuggcuucuuccccaauauuagcgguucuaccaugggguggcuggguggguggaagggacccacgacauucaggaaagugaggagcaguuucugugauuauagcagacccauucacuggaauuuuuccugacaucucuccaugaccuuuaugccuccaagggccuggacacaaugcagcagcucuccagcugggacagggcacaugaggggguaucauacaugaguguucccccaaguggggcuguggccacugcagagcagcccaggggaccuugcugugcacagcccuauguccugggguuucccgcaaagcuuugcccugucuggugagacggcugccagacaguaugagaugaaagacaccguucacacuuaauggugacuggaaugugcgccauguaaaccagaugauguggagaccaauuuauaaccacuucacaguucaaugaugaauggugggucccuuguacugacucuuuaacuagcucccuucaaggaacaggcggcuuccgagauugucuuaaagcagugugggauguccaggcccugcccagguccuaucuuuucuuccagcaccauccaccucccugaaaucuucucauagcaccugguccucaccucguucuucucguugaauucuguuuccuccuuggugucuaccuugcuacauucauuccacaggcaucucuguucuauuaggcaguccuuucuguaagcauuucccauggauauuauaaccuaaccuucaagcuuugucaacacuuaucagcagaauucugcuuguaucuugggccagaaugagucacagcacaucccuggaugcagagaaggguaggaacucugauacuuggcuucucaguuuccauacaagagguagcaauggagaagaguguugggagaagauuuuaguagggaaucaacaguguuaacuccacaccuaccauugucauucuauuuuacagauuaaaaaacgaagucacauggaagauaaauaacaugcucaacaucacccagccagaagugguggagacauggccaacaucacaggggacaacuccugagccugugcuaggaacagccagucuuccugaauucaugauaaaguaagagguagaaccguggccaauugucuuugggagaaagugggaucaaggacaacuccaggauucugccugagaugggacacacuagagcauuacuugggaauguaaauaauaauaucaaauuauugaaugauuuccaugggcuacucucuucauauaccaguucuaauucugauaagcuuguaucauuaucuucuuuuuaaaaggcaugaaaacagaggcucacagagaucauauuauuuuccccaaguugcaaugaugguaaacacagaugacagcuggacaucaacuaggucuggguggcuuccaacuccagugacucaaugcugcuccacacggccuucuuacaaggaaaaaugagaacaggccgcgggccggcuucuguaaaucgcguguuguuggaauuccuguccuuccuugacccagauuuguaaacagaggcuguggaagccaagguacacaugggcagaugcaaacgagccgucugcugaggagaaagucgaaugugcucggggugggugcgcgucugccugaagcacgugucccugaggccuccugcugucuccccagccggcugacgggcccgguggucugcagauggccacgaagugucuccgggcuguccagcugcagccugggcgggcuggcgguuuuuuuuuuuuguggggggagugauucugagggugcuggguggccgcugacagagcuuccuucugcuacuuuuaggcuuguugcugagccuuuuuaaagggaagggguggaaauaagcaaagauauuugcugugaccuggaacugaaaugccucacuuuaaaaacagcuaucauuuacucacucauccaagaaauacagguugagccccuucagaacaacagguccuguccucagugcagcggaugcagcagggaugcauacagaguaccuguccucagggaacuugcaguuuauuggauggagacagacaacccauaaugauuuguauaaaugucuaauauaugcuauagaaagagaagcagcaaaguaaaggggugaaggaugaaaaggccaggggauauuuuucugaugaagugacauuugagcagauacccaaacaaagcaaagcagugggcccagcagauaucugaggccaggauggucucuggcaaagggaacagcgaauucauaagcccugagcaaggcgagccuucaaggguguaggccuucuucagauguuuaaagagcaccgugcuuggggagggucuggaagccgcagccugggaacaagugagagaacugagguguuuagggcagaaaagggaagucuugugaguagcaggcagcuuuccucauguaaaggguucaaauguggaagaaggauaagacuuuuuauuacauaaugccagaaguuguaaccaaagaccagaccagcugauggaaguugcuggaggcuguuugcaaagguauguugaauaaugcccuaagcauuggcucuaaagagaaggaacccgauauuaguguaguagggcugccauaauaaaauauuauagacuggaggccucacacaacagaaauauuuucccacaguucuggaagcuggaagucugagauaaagguguuggcaguguugguuucuucugaggccucuuuccuuggcuuguggguuaccaucuucucuguaugccuucacaugguccuuuguaggaccaucuguguccuaaucuccucuuuuuuuuuuauuuuauuuuuugaguuggagacucgcucuguugcccaggcuggagugcaauggugcaaucuccacucacugcaaccuccgccugcaggguucaagcaauucucuggccucagccucuggaguagcuggggcuacaggcaugagccacaaugccuggcuaauuuuuuguauuuuuuuaguagagaugggguuucaccaugcuggccaggcuggucucgaacuccugaccucaugauccaccuugcucgaccucccaaaguguugggauuacaggcuugagccaccgcacccggcccuaaucuccuuuucuuauaaggacaccagucauaugggauuagagcccacucacaugaccucauuuuuacguaguuaccucuuuaaaggccuuaucuccaaacagagucacauucugaaguacuggggguuagggcuucaacaucuuaauuguaaagaggggacacaguuuagcucauaacaaacuuuuccucacaauuuaaauuuauugaagaagcugaguuguuuguucugcacugaguuauucauucugucuggauuucucagauugccucucugugguucacuguuuuccugguaaaugguacuuagauccuugauugaauuuaaguuugauuuucaggcaagaauacuacaucagguggugguguauacuuccauccagaggcaaaugauaucuucuugucucucuguaauacacaaaacaauuuucaaccagaaauguagaugagugaggauucugacguaccuagaauauuuggaugacugcugcuugaauggauggccuugagacaccugaagacccugaugugccuucugaaucauaccacgauucaauuacauccaucauuuaacaacaacaacaacucuagaagguacuuauuuuguagaugucauuacauucguguacgagacuggagucuggaacagaacccccgacuaaccugucaugcagaaggacaaacauaaacaggcuucggggugugaaggaaauguuccaacagcuggguuuggcuccugacccugacccgccacauacuagaaugugauccuagccaagcgaccuaaaacuuugaguccauauuccuuauuggugaaauguguauuacacuucucucuucaaaauuugcuucuggugucaccucccccagguaaccuccuccuacucuucucccagccuugccugacagcucaucccugggaugucccucucaccgaaugcucaccuccagcaugcacauagcuucccuuuugcuauuuauccgugugucuccuccucaaacuaggaguuccuucggguucaguacuguguccucaaaaugguuuucaagacaguugcuuguucaugguagcugcucaaacaauaauuuaaugacuaaaagcguugcucccaaguaguguucuaaaucuaaaaaucccaggaagcuuauuuuuauuuuuauuuuuauuuuuugagauggagucuugcucuguuaccaggcuggaguggaguggcacgaucuuggcucacuguaaccuccgccucccggauucaagcgauucuccugccucagccuccugaguagcuggaacuacgggcgcauaccaccaccccuggcuaauuuuuuguauuuuuaguagagacgggguuucaccguguuggucaagaugucucgaucuccugaccucgugauccgccugucuuggccuuccaaagugcugggauuacaggcgugagccaccgugcccggccagcucuucagcaauuacugauaucccagggcgcaacacuagagcucuccaggugauucuaauauauagccagaguugagaaccacugugguagggcagugguucuuaaagugugguccuuagaccagugcauuggcaucuaccugggaauuuguuagaagugcaacucuugagucccacuccagaccuacccaaucagaauucugggucucgggcucagcuacaucuguuuaauaaguccuccagcugauucugaugcaggcuaauguuugagaaaccuuguucuagggcaggaaccagcaauuauuuuucuguaaagcgccagauaguaaauauuuaugcuuuguaaaucacucggucuuugugacaacuacugaaguccgcuguuacagcaggaaagcagccauagaugauauguaaauauauggauuuuuuuuuuuuguuccaauaaaacuuucuuuacaagaacagagccuaggccgggugcggugcucacgccuguaaucccagcucucagggaggcuaagaggcgggaggauagcuugagcccaggaguucgagaccugccugggcaauauagcgagaccccguucuccagaaaaaggaaaaaaaaaaaccaaaaaaaaaauaaacaaaagacaaaaaacagagccuaggcccagaccuugguuugccgaucacuguucuaggagauggaauuggucggucguuguuauguaacaagucaccauguaaguggcuuccuauccacuaauuugaaccauuuauucuuacugaaacaucugugguuagcugauguagccuagguuugccugaggggaagaaguggggaaauacgccccaccuuuagggauaacuauaagucacauggcaaagaauguaaaaaagggaaaaaugaaagaugaagaacugaaaucaauaauucauucuauaccagggaguaagugaaauaacacacuaaaagugcccagaaguaucugagcauaugauccaugccuugugaaugcuggcuauuguuauuauuauaauuauuaauuauuauucuuuauuuuguauaauucaaggcuagaaauuggaugcaacuguccauucuuuugggaaggcuguuucagacauccucagugaugagugucacuuaucauuagcacuugugacaacagguguacagaguuguccgugcuagcagccugcuguugacagaacaauuuguucucagugcugugugcuguuuauucagaggaggccccaggacaggcuugucaugucaugaucaguugcugcugagaaacaggcaaaucauuucugauagcugauguucaguagggauggggaacuuagauccugguuugaaagaagaaaugacuuguuuggagcucaaguaacuggauauucuuaauuaaggagaguauauuuuugguaugccuuagggaaaagaggcacaugaagaggaugcaaauuggccuuagagauuuauuaguaaugauuaacuuggcaauguauguccugggcucaguacaacuuccaucaucccggcuccuucacugugguucccaugugcucuguguagaccccuuguguccgaaucaccugggggauuagcaacacauacucauuucuggggucuaacucuagaguuucugacuugggagugugaggcgagaugcugguuguaaaauuuuucugugccgggcgugguggcucacgcuuguaaucccagcgcuuugggaggccgaagaggacagaucacgaggucaggaguucgagacuacccuggccaaaaaagugaaacccugucucuacuaaaaauacaaaaauuagcuggacgugguggugggugccuauaaucccagcuacuugggaggcugaggcaggagaaucacuugaacucaggaggcggagguugcagugugccgagauugaaccacugggugacagagcuagacuccaucucaaaauaaaauaaaauaaaaauaaauaaaagcuuuugguacuugugaugaaccauccuuaaggauggcacugaucuccccauuuguacacuuacauauauuuacacaauuuuacagaaacugaaauucaaacucacagcggaucagaacuagagagcucugacuuccaaacucucaaagggugagggccaugucuuauucauccuuguaucccuggcaagguauccugaaggaguaccauauugaacccaguguuuacagggccuucguuucaugggauuggaguuggaacccagaauggcaaagugauucacccacaggugugccccugaugcaacuuaggauucucugaguccucuacugucuccugccccuuggagucuggcccuuccaagcuucuccucgggaaggaaacuccuguguauaaaacccucugacauguuagaccuugugguaggugauuuaaaccugcgauuucauuuuauucuucaaaaaauaaaaucugucaaauugggauuaugaauuccacuuuaugaaagagaaaaugugcugaaagucagauggccaaugagugguggaggcugaauucaaauugagguuuguuugauguauguagugacugaaacggagcaugaggcggugcuccugggggccugguaauguccugauucuugaucuggaugugggcaccucaggagagaauuucaguguguaaaaauuuaucaccauacacuuuggcuuccugcacucgucuauggguguuucucuucagugacaagguacaaaaacaaauccaugugugucugguuugcaaaaucaugcucuccauuaucuccucuugcuuuuuaaaaauaagagcuuaguuccuucccaaccaaguuuugggacagcuccaugugaaguuacacaauguguaaaggaacagucugagcuagaacccaggucuuuuucuuccucaaccaauaucaacugauacucuuuuuuuccccacuagucaccucuggggaagccccagcagaugccucgaugugaguguuucugggauaguacagaagaccauuuuacacaagacuaagaggcuuucauuauaggccaggagcaguggcucacgucuguaaucccagcacuuugggaggcugaggcggguggaucacuugaggucuggaguucgagaccagccuggccaacauggugaaacccugucucuaguaaaaauacaaaaaauuaccugggggugguggcaugcaccugcaaucccagcuacugggaaggcugaggcaggagaaucaccugaacccgggaggcagagguuguagugagccaacaucaugccacugcacucuagccugcguggcagugcaagacccugucucaaaaaaaaaaaaaaaaaagcuuucauuauaauugacaccuauaucccuaugucuuuuaaucccaggguuuucuuaaaacaaacagcguuauuuaaguguguauauuuuauacuuaaauugaaaguguguaguuugguaaguuuugacauaugucuacauccaugaaauuaagauaaugaacaugccaaucacccccagaauuuucuuuugccccuuuauaaucucuucuuccaggcugucccuauuaaccuuccuguccccucacccccaaggcaccaauguucugcuuucugucacugugauauuagugauauuaguugucacuuccuagaauuuuauauacaaagaauuaaccaucauauacucuuuagcaugugauuucuuucacucugcguaauuauuuugcaauucauccauguuguagcauguaucaaucauucauuccuuuuuguugcucugugguauuccauuguauguauguaccaugauuugcagauccauuugucuguuguuggauauauggauuguuuccaguuuuugguuaucucaaacaaaguugcuaugagccuucuuguacaaauuuuuguuggacauaugcuuucauuugugaaaauacccuaaaguagaguggcuggaacaugugguagguggauguguaacuauuuaagaagcugccaagcuguuuuccgaagugguuguaccauuuuacauuuccacucacaguguaggagaguuacaguuucucuacacccuugccaaugcugaauaugguuagucuuucccauguuagcuauucuaauagguauguagugcagacuucugcaguucuuugggcagcucuuuucugucucguuccggggucugugagcuccagcuacauuguucuacuuggacucaccuuugucuccccaacucagccugccugcugggcucugccuagaucccacucccugugcugagaccuggaaaaauucucgagguggucaucuggggcaaucauaggacucaccugagcuagaacccccagccuuugccuuuccagucaacauucuuuauauuuccauaccaugccucagguauguguuauuguccuuuguugccugacgucaaguguuuuccaaacuauuguucauauuuuguccauuuuuuuuuuguuaggugaaaaggcagaucucaucccuguuacuccaauuuggccagaaguagaaguuuccucuacuuccaggguuuucaaaucucucaggcucucaguggagaugacuccaguuucccuacugcacaaagguauccaugacucacaaacuuuuagagcccuuuguaugcaaugagaguucaaagcuuauacuaagugauuauacucuuaggaugaaaugcaagcauccaccuguggguaugcuaauucuugcccaaucugguuuaugaaaacgaacaaauaaacaaaaaaaaacagaagcagcucaugaauuuaacaaaggcagcuaacacuaaugauuaaguaaagcuguauuggguaccacuuuuuuuucccagauguuguauuagacuaugaagaucuaaacaugaauaaugacuguauucagugagcucauauuccacuggcuauaaaaauucauggauaaguaauuacaaucuaguuuuagaaguauaaggauuugaguagguguuagggugguucuguggacuaagagcugagcaaucugcucagugcggucagucagagacccuaacugauggugcuuaugcuaucuaccucccaaagguggcucuggagaccacccugguaucuaucccagugaccuagaaggaauagaacaugaaggaggucacccaagggagguuuauaagggccaggucaggaaguggugccuaucucaucugcuccuuucccacuggguagagcccagccaugugaccacaccuaacuacaaggaagaaggggaaauguagucaaucucugugcccaggagcaagaggaaacagauuucaguaaccuguucacagagucugucagauuauggauuucucuaauguuaguuugaaaaauuuacuuuuuucuaagcuauuuguugcagugaaucuuacacagcauuugauggggggggaaccaucacugucaugugcauuugacauuggcauguggcauuucugaacucagaggugugaggaagggagcaagcggaguauaacccuguguccagcugagcugcaggaguaggaauguggggcacaccuguuucccaccuuuuacagccauccggaauuagaagcuugccacaaaggaagagugaggaccuuuagugacguggcauugaagccucaucagggcaaaguaacaaaaccagaguccagagagacagcaguccccaaaucagcccugugcuucaguauaugacagaggcaaagcaguuauauaguuaucccaaacucugacuuuaggucauuuuugggucuugucuaucuagcaugucaaacuaacauguuauagaugaacuuuggaguaagguagaccuggguuugaaauccagauccccaguugcuaaacucaggagguuacuugaccccucucuguaucuugcuguuauuauuauuauuauuuuuugagauggagucucacucugucaccccggcuggcguguaguagcgcgaucuuggcucacugcaaccucugucucccaggguucaagcgauucucccugucucagacucccgaguagcugggauuacaggcaccugccaccaagcccagcuaauuuuuguauuuuuuaguagagacggguuucaccauguuggccaggcuggucuugaacuccugaccucaggugaucugccccccuuggccucccaaaguguugggauuacaggcaugagccaacacgcccggucugaaucuugauauucuuauuuguaaaauggaacuaacaaaaugccuauucaucacacuguugcaugaaugaaauauguuuauacucagaagauacuugguauagugccuggcacaugcuaagcuuucacuccaugacagcaauuacugucaguaaauugggaauuauaauuccugucuugcagagguuuaugaggaucagugggagaaugucacagagccugaucacagagcaggcauucaauaaauaguuguaauuauuauggcaguaucacuggccacauacaccagcaaggccuaagaugccccaggggacacucggaguaggacccagagaugguguucacauaugguauguugguggcugauucguggugaggagcagagaagacaguuauuaauaucaaaaggaagaaaugaauugaagugucuuucaauggugacuaguacacagcugaggucccaggaggucuagaaugguccuagccauuuccucaaucaaaguuacucagcuuacuauauuuucagguugucuucucaaagaccagugcaguggauuuucuucuucaucuucccaucagcuuccuccaacuuguguuauucuucugggccuagcauccugucaccggcacuauugucacuggaaguaguucccugcauugucuggcucuuuauccucauaaaaauccuaugcuugucacuccauauccagcugaaaugcuacugccuuuuugaaauccuucuugguacuccugcagauacaguccauugccauaucccacggugauuuagacauagccuuguugugauacucaccaccuuauauuaaagucauuuguuuaugugccugucuccccaauaagcuaguggcccugccacuuuaacugcagaguuccucguccuagcuugaugcauucaugcauuaggugcucacucacuguguguuaaagacauuuguggaauguucccauugcaccuggagcaagagagugaacaagaguggucacgacaccauguccaggcaauaucagguccuccuauccuuaccuccaaaauauacucuacuccacucucuucuucccauauguaucacucucacucuguuucaaucaauucauucuccaucaucucacaccuccacucauucuuuucucuacagcagccagaccuucuucauaaguauacauuauguacuucuugaguuaaacccuccaauugucaacauaucauacuuggaaugacaucccaacaucuuacuguuucucauaaagcugagcacucucugacuuucugaccucuccagccacggagguuuccuuucccuucaucuaacacaccaagcucuuuccuccccuugcucuuggcaaggcuggcuccuccuugccauucaagucucagcucggauguugccuuuucagagaggcuguccuugauuaccuaaucuaaagucauaccacacuuucucaccucacccuuuuauauuuuuuucaacauuugacaauauaugacuucaucuuguucauuucccuguugacuuguuuaucaccuaucuccuccacuugaaucaaaguucauucugcaagagaccuuauuuuaaucaugguuguauugccauggugucuagaacaauguccggcacacaguauauacugaauuaguguagguacuuuuuuaaggauuuuaucauucuacauuucuuuacauuaggaucucggguagaacuguaugucuuaggggcucaaaggcugaguagaugcuaggcuuccaagccaaaaugcagaguauugaauucugcuaaugcaagaguuauuuuuugaauuaucaacagcuuuaagucccauaaaaacagugcaugaaugaacaagcaauaacuacaccagacaaauguucuaaucuuguaugaguuguguucuagcagaaaauggcuccuucaauguacugagaauacauuuuucccugagcacuggucuuuggggacaauuugcagaaggcaaacuaguaaagagacaaaaccaguguggcagcuugacucugugguuauguuucagcagagugagaagugaggcucauuggugcacugaaacugacucauugguucauaagagccuauuaugcucacaucuucccagcuccucaugucgcuaacaugaaaugaacauggugaaaguguuuauguccuggaaacuggcaguguuacaaaucagggcuuugaagaaauugugugugcgugcguauguguguguguguguuugaagugcuguuucacuaguacacaauuacaaaucuucauuguguuuugguccuggggaaugggaaagaaugagggggcaguggauggcugggcaggacucaggauuucuaggugcuguggugacugacaauauuagcuaaagugcuuuauacacacacauaagcacccaagcaccuauuaccuaagaguaauugcagcauuuuauucugaagcaaaugcuuggcugucauucugauuaagccacuaagagguuguuucugcagaggcaggcugggugacaguucuguagggcuuauaaagaaaugaagcuuagacuuuuucaaggaguugguaaucccucuggcuccaggaugauuuuuuucccccacuucagacgcagaauauagagguuugacaauuuuuaucccugugauugugacagauuguaguagaaaaagcacuggagggggagucaggcauccuacaaaacaccuggaugacauuggacaagucaguuaauuuuucuuagccucugcuuuaguaucuauaaaauagaaaacaugaucugaccugagaacucauugaauaaagaugaagauuuugcaaacaggcauggagcccauugggaugcccauaaaacauuaagauaugaaauagugaggggugugacugagacuccuggagaguauaagagagauacugagaaagucuuugaggaagcuggaacauagacagauaucaaacuggucucuauaaaucuuggugaagucucugauagaucacaggcuuaucaaacaaguuaauuccugcuauuuguugcuauaaaauaaaccaccccaaccuuagugguauaaaacaacacccauauauuaugcucacagauucuucaggauuccauggauuugaacaaagcacagcaagaauagccugucugugcugcaggcuaucuggggcuucagcuaggaagacuugaauggcuggggauuguucaaauaacugaggggugggauuucucuacuagguuaacuggaagccagaaaucaauuggaacuggcuaccaggugccuacagauggcccuuagauguagcuugagcuugcuucaagcaugguggcuucaagauggucauacuucccacauggcuguuuagagcuccaaaaugaaguguuccagcaaacaaggcagaagaacaugaccuuuuaucacccagcuuuaaaagucacacagugucauuuauguucuacucuauuagucaaagcuauccuaaaccugcccagauucgaggagagggaauauagacuccgcuucuccaugggaagacaguuuaagaauuugcagccauuguuuuaaaaucaaugagcuaaaagucuucuugaaauaauaggaguuauuaauaaaaguaaguugugugcaaaaaguaauaauaaaaauaaugacaaugauacaaugauagcucacacuguaguguuuauguaugcuaggaacuguuuuauauacuuuaauuuacccaauccucauaguaauccuaaaagauagaagcauggagaggugaagucacuuggucaaacucacacugugagugauugacagaguaggaauagcagcaacuaacguguaucaggcacuuaccacgugcaggcacucugccacacacuuuucauggauugucuuacuuaauucucaaaagaaucccauaauguagguauauuauuucuacuaccuuaugggugagaaaacugaggcccagugaguuuaaaucauacaguuaggaagaauuuaauucucaacacugccuucccccaaagccuugugcucagcauguaugcaacguaagaacccacaaaggagagcaagugaagggccugggagcaaugcugcuggggcugcugguggagcaggguuuagacagaggaguucagugcuuugauggaaaugaaggaggagaguauucugagaugagaugauaauaacucuaugucucugacuguguguugugugugugaaaaagaaaucucaacucaaucuagcacauguugaugaugcucaucugguguguccauccuuguuccagucuccaugacgaaggcagaggagcaucguccaggggauaccugaccugcaccuacucaucccuucacagggcucagcauguuuguauuucuguacauucuccuguugaaucuucuagagucucaagguuuggcuauuagcaucuucauuuuacagacaaggaaauggaagccuggagaugcaagaugagcaauaugaaguuaauaugaaguuacucaauaugaagaucagagcucaggcaagacagaccuucgucguugugccacuccaacccccucaugagauccaaagagaugagaugauuugcuccaagucagcacagacagaggcagacuaugcaccagaacccagguuucuugauuccagcuguucauucaucucacucaucauuucaaacacaucuagauugcaaccugcuuuuggaggccuucccaccccucgauagaccagagaaguuaaacauuucuauaacagggaagcaucuuccaagcucuuguuguuacucuuauuacccucuauugccauguauuucuuauuccuauguggcaaugaggacaggaguugaguaggugcaggucaggucuccucuggacgaugcuccucugccuucuucauggggacuaaaaccaggauggacacaccaggugagcaucuuaaacacuuacuggauugaguugaauuuucuuuuaaacacugcauccuaauaucuccacagaacccaagaauagaaggugcuuagcaaauauuggcuaaaugaaugauaggaugaauccauaaguaaacagacuaggguaaacaaaucuggucgaacaaaagggaacugaggggguuaucuuugaaauaugacucagagucagagaggcagagagaagagcaagaacauuccugauggggaccacuucaggagcaaaggccaaaggccacauggggcuccugauaugggcauccuagaacaaaacugcagccauuugcaucuuaguuugaaacgaggcuggagauggaagcagggagccacaacgggucucagaaaugucagauagcaugggcacuguucuacuuguaucuggggcugcugcugguuuagcuuccucuuugaucuggaagucaccaugcugaaucaugccucagucacuggcagccuggauuccccuucauaagcacugguauucuagaaccgcccccccccacccuuuaaaagcagacaccucagcugcaauucccugcuuaauuaaggagugagucagggugguggcuuaagacacaauuuccacugugcuccaugcucccuuccucuucucucccuccaauguuauuucaagcacauaaacucacaaggcuuugugaggaguggaaagaaugugggcucugagcuaccagaccuccuggaaaaucccagcucuguaguucacuagcuaugggacccugagcagagaccacaucuacucugggucucaguuuccucaacauaauguaggguuguugugagaauggaaugguguuaaacauaaaggacuuugcagaaaauuugggguacagugaugugcaguaaggacuaagagugccuuugguuugggucugugugcccucauucuuacccuucaagauguagauggcagggucauuuugauagaggucuccagcagauucugggaacgguuuucucuuuccuucuuccugguuggcuauuguggaucauuccugcaaaauuacuuucugugguucuccagggcuggagggcauagcucaauugcucuugaaacuaaacccuuucacaacuuccugggcagcugccagacccuggugcuagcaggacuacaugggccagguuucugcuuugaggauuuuacugaauuguacagacacacagucucaggucuuuuuucuuaucaacucuuuggugacaugaacaggcaccagaguaaggucucuuuacugaaugcuccugcucagaguuggugaaucuguggaauuuguuuuugcuuccugaguuuugggugggccuucagacucggcuguaggacucgccgaccagaggcccccagauucuuguguggagugccuacucuuccuuccucacuccauuccucaccuaauguaauuuccuuggauucagacaagugcuagugguuuccugccucuaguacacccagccugccccagacugggcaugcacugagugugugcacucuuuuuaugaguauccucugcucacuccauucaaaacuguccuguuuuguaccucaucugcuuggagauccucuucuagccuuggccuugcuguucuuagguguuaaugaguaaauauaugcuaucuuucucaguaggcauaaugaaccacucucccuccaccaaaauagcuauaacacagggcgcugaggcacugaacugagagucauaaaacucucauucccagccccacuacucagcaguuuuauaaucuugggcaaaucacuuauugucucugagccacaaguguucauauuuggaaggguggggcuaaugcuaauugcccuauuucuccccaccuaccuccccacaguuccauuuacugugagaaucaaauaagauaaugccugugaaaguacucuguaagccagaagcuguuauuauacagaggcuaccuauuauuauuaagaacugguuuuccugauucuuccagcuccccgauccucuccauccccugagcuggcucgaggcuggagaucuguagaagcacaccuuuggggccagagccuagaaaucauucugcuuugccuaccaaggaaucuucuuaauuccucuuauuuaaacauguggauucaaagaagaagaguugaaaaagucugacaccaaaauauuucuuuguuuggcuuuuuaaaauccuagugcaagcuaccauguuaagacccacaccaaacccagacagaaaacccuguucaugcagaugcucuagguuuacauccagaaugaaugugcuuggcugacacugcuccuaaugguuuccccaaucugaccacuuucugggucccauugccacucucuuuuugaagucacuacuauuuuccagaagccucucccuccaggcuucucucuucauccauucuuauacccauaugagcucucuaaaugcuugucucuucauauuacuucuuugcuuaagccuccacaccaugaguccacauucuccucacaguaaagugcacuugcuguaaaaggggcuccugaugagcuuuauggacuugcuccaugacuucucaccccucugugcuugauccuuaaguaauucuguucaccagacaccuuguucucuguucuaccucuucuuccuguagggcccggcuuagauaucacucacuuaugaagccuacuugaacuccccuugacaaagugaggagcccugcaaauuguuuccauagcaucccucuuuucgccuauaguacccuucucauccuugaucauugucauguguuaagaucugucuucuccaggaagcugaagcuccaugagggcagacacuauaauugucuugcccauucauuucauagucauggcaccuagcccagugcccagccaugaacaaaugaauggcacggguaagucaauguuuaagauuuuugcucuggaagccaggccacuuaaacacuucauggaaaaacacagaugaacucauuuuagagacggaugaacacauuauggaaccaaguaugcaacccuuaauuuucuucuccuaaaccucucagcacaugccaacuagcuaauguugccuaacauuuauugagugcuucacuuguacuaggcauaguaaugagcauuuuacauaagucaacuccgucaaccuucacagccauacucagaagugaguguuauuauccugcagccacugaugagacacugugguucagagagucugaaucacuugcuuaaguuugcccagacagcaagugaagguuuacuauugaccugugucuguucuccucuaaaauccaugcuuuuaaucacuggaccaaacugcaugggcuugggcaccagaaauguacagguuuaaguucccaagacuuacuagcuguguucauugaaaaaaguuagguuuccuucuugugccucauucuuuauuaagugucugugaacgaagcgaaauaauguuguagagcacucgguauuuaguaaguucccaacuuucauugcaagucaguaaguuagagauagagcuuagaugcuuaaaguucaggcaguccuaagaauuaagaccgauugcuuucuucuuuaacaucccugcacaguggggagguuagcauauaauugagcuucuugcauccuguggcauuuaucacuccuugaggcacauuaaucuguccuuugacaauugagucugugagaaaauguuuuucaucagaagucugcugccuucuuguccuacuugcucagagccuuuggagaaagucuagucacugugucaccaacaccuuccuggccaucugagggcagcugucaugccaccacuucagccuauggacucucacuuuuccagagaggaggaugccaguuuuuccacguuuuuuuuuuuucucauggaaugagucuuaaacucccaucauccacccaauuacuaguuuagaacaaacuccaauguaucuacauugucuuaaccuauaauggcuaagacaaagacuuagcaacaaggauuuucacugcaguauugauuacauugugaacaaauguccagcaacagagaacuggcugaacagauuacugcuuauccguaugaacuaauggccuucaagaaugacuaugggaaugaacauuuauugaucuaaaagaugguuacaauguaauaguaaauguaaaaaccagguuauaaaauagaauguaaugcaugaucuccaauuuugaauaauaguauucauuuauauauggaagagaaaucugaaaguguuuaaaagaguaaaaguguuuaucucagggucacgagauuaugagggauuuucuuguucuaaauuuucuauuaagggaggaaguaauaacuuggugguuaugaaaauggacuucaaaaucggacagacuugguuuuagucuauuuucugccacuuagcuucaucaccugaguuucauaauuuguaaaguaaggcauauaauagaguuugcuuuaguauuguugagagagcgauaaaacuagcuuuguuuuuggagugcuugcuaugggcuaggcacuuugugaagcaauuuacaugcaugcuuuuuaucauuauucccauucacuauaugagaaugaggcucagggaggcuaaggaacuugucccagugcuacauucaaggggauggugacuuucccucuucuuaguacuugaguuauuucaauguuguuaaaguggaaaucuguuuuccugucauccacaucucccugcugacucauucuggaaccacuuugacuaaaacccccagauauuuucauacuggccaugucuccucuauucuccgguugugcuuugucuuauuuuuuuggacuuaagugaacuuauuauugagcagacagguggaugacuaugaggaaguccgagaauaagcuuguaauuugucaguaaaaaguugcugauuaaauucuacuauaauuuggcagugaaaaguugccaaucacacuguagagccacagggguaguaaaaugcaugagcuuugcauuuuccuuuuuuuuuugcucaucuggaaagagugagugcuucugauggaagaaugaauaggggaaggugccaggauggauccagcaaggaugucauuggccagggcucccaggagaagcuggaggauggaguccuuggaacauaaugcggggcacauuuguaagagugggagccagaccccuggcagaccaggagucuaauuccugcucuuacucaccugcuauguggcccugagcaccucacuaaauucucugaacuucauuuucuuauccucaaaaugugauagggacuuggcugaguugauuucagcacauccauaugaacaaaugcuaagcagccaucaagaaugacuacaggaaugaaauucauuuacuuaaaaagaugguuaugauguacugguaaaugcaaaaagcaggcuguaaaauagaaggacauguaaagcacucauuuauagaugaaagaaaaucugaaaaucagugauaugacuuggauguucagcuuucuguagccaguagcacuuauuuugugggaauuuuaggaggaugaaaaugagauuguguaaggaaauggcucagacagugcugggaucaguuuuagucucaucucuucccugugagcccuucacucccuacugagugaccugauaaauguuaaagaacaagagaacaaauucauguaccaaggggcuccaugacaaaggugggaaaauuacagaguuagaaacauaagggagcuggcccaaacucauccuauguucucauuuuaauaaauuuauuacuauuuuuaaauuuccaaccuguccaugauacaaaaaaaucaaauuauacagcaacacuuagagaaaauaguaaaaauuccucuuuauuacucuucuaaucucuuuugucucuccaaagacaaccaagggugaagggcucucuguguaucuuucuagacauuuuauuagggauuugaaacaugcauguucaaauguacagacuuccucaccaacacuaugaaugguccaugacuugaauguucgugacacuuuugugaugaaaauaaaaugcuggcuagagagaagagucgaaugggugccacaaucuuaauuguuuuuccaugacuuuuuggccuggguuggauauuaacaaauucagaugccuacugaauuuagaaauggcaggaauccucuugacauucuaacauuuccauauggcuaaagcuuuuagcucuaguuauuauacuucugcuuuggaagacaguuccucaaaccagaucucucuccugaaggacuugucuccuuuagccagaaugauccuuccccauucaaggagaaaagggcacaggcccaggaggaaauaugugccugaaugacaaauugcaugagucaaagacauuuaugaaaaugacaaacacuauuucagaggaggaaggcaguugcuucugcuuucuuuuuucuuuugagaauggguggaaggccuucagagauggugcugaacacagcacuuugcaaugaguaacauuucagggauaauauuagcauuaaugcuccuuugauuccucaguuuuggagaauauuaguaauuggggccaauccaaagcacugaguggauuauugaggcacagcaaaagcuacaaggauuuucauugcauagauucuuuaccucccugccuuaagacauuuauugugauaugcgauucuaacaaaagucagagacacaaugccuuacaccaaauaggcaccuaauugcuauugauugauuuaccucaauugucagcauucuugcagaccauucauuuauucaucugcccauuaaucaaaauguauugagguaauacuaucugccaggcacugcguucuuuguaucagugugggcacaaaagaggaagugaacaguuauccucaaggcuguggcaaggacaggcuuucagaggagaagacaucugagaaagguuucaaaauaggaauaggaauuuguuaggcaaauguggggggauggcauuucauaaaccauaaacgggggaacagaguuaacaaauguaggaaauauaggaggaggggcaagauugugagguugaaagucauggcccugacugauugacuugaccaaauauucauuagagaaauaucaccuuuaacucaacucaaaacugaguuucauugagcugucaauuuacucaacaaacauuuauucaacaacuuuucacugugcuggaugcuagcaauauaaugcugacaaguuucuaguggcaauuuuccuaaaggcucgguagacacuauuagagcuuaaccugacagugauuaccauuauacuggacacaugucaaagcacaccccuauuuaagggaaauccacuguggggacaacauucuucuguguguccugcacaaugcaaaggaguuuuuuuguuuuuuuuuuuuugagagcgagucuugcugugucuucaguggcacgaucucagcucacugcaaucuccgccaccuggguucaagcgauucuccugccucagccuccgaaguagcugggauuacaagcacccaccaccaugccuggcaaauuuuuguauuuuuaguagagacaggguuuugccauuuggccaggcuggucuugaacuccugaccucaggugauccaccugccuuggccucccaaagugcugggauuauaggcaagagccacugcgccuggccacgaaggagaauuugacacacucuuuuacuaccuucucaaaauacaaaucuagauuucaaugugacucauuguuuuaucuauugccauauacucugauuaaacucugucuucugagagauaacuuauaaaugccuuuguaggaaucauagccauagcuuuaaguauaaucuuggguucagcucuuuugucccaugacgaagaagugacuugucugauguuacauaaugagaguuaucagauuguaaaggagaacuaaggcugcugauaucuaugacacuacauuauauugccuccaugaauaaaauguuaaugucacccaaucaguucauaaccaaaaccauagugggaucggcucugagcucacaguuacugugauucuaucuucuguuccaccuaccucuaucuccucccuaauucuagaguuuaaagggcaguaaacucaauuuugaacauccugccuuuggucucccucaguuggcugucugaucuuuugugcaccugucaguuuuccaaaaagacacacucaaccucacccuagaaucuucauuggaaagcccuuucacuugcuacucuauaugucuguuuugguagacaaaaccacaaacccagauaggcaauuagggauuaagggcaacagugguuugggauuauuucagcuaauugcuauccuaugugaaagagugcaucaucucugacagcuggcaugaguaaucgucacuguuuuagcaguaaguuuauaccuucugugugauagggacugccaaugcuguuuugacugguuuaucaucagaguggugaaugugaaaagcuauuguauguaucccauugguuguugugacaauuaaauacaacaaagccaucacauucuuacuaucugccuguuuauaauaugcauuugauuuagcuugacuguuuuuacuuuuuagacucuguguaucuccgacccuugcgaacaucgcacccugugccauuauuuucugcuguuaauggcagauuggcuacgaugccuuccuuucuucuguauugggguggaggagugaugugauuugcauauaguuacccagaaugcucugccaauggucaguucucugcuggcugggagacugagcucaggaacaagcugcaagguguaaaugggcuuuuggguaugcugauuuauguucuaauuuauacucaugugacaaggauugaacccugacuaucuuagcugggguggaaaaggucccuggacaggggcagggcggggaauuugauguccacauauauccacuuuuagaguuuuagaguucuuuggaaauagggauuuuuuuucuuuuuuuggucugucucagacugccaaguagaagcccagagaaggaggaaguuaauucacauucuuaauuuuuucuaagggcaaaaaaaaaaaaaaaaugcaccagcucauuuuccaucucugcuugggucaucagugugcauugugagccuguacaaaggccuuagacggggaaugcugccgagagcaucaccuuuuaugucuucuuuuauaugaaaugugccacuuccccacuaacccuggcucugggcucugccucugcucuccugaugguguguuuaugguggauucagcauucugggccacacaaggaagcugcaggggguguccaaguucacauguccccgcauuccaggcgaauguuucugacauugagcaaugauauggcucugccagguuuaggucugucugauuggaaugcaacccgaaaggaaagucccggaaugauucaaacacucaccuccccacaaccccuucuugguuuuuuuuuuuuuuuuaauuccuuuuuaauucuccagugacaaacucagcccagcacucucgcugaccgcauggcacuuguuggugcugauaagugcaacuucccaagagauaggaaugcaaaucguaauauuuuguugagucauguguacucugcggcuguuucccaaacauugcaucagaccuguaauuggcagcucccaguacucugcuggaugacaccaaauguccaggaaaagcucaguccauuucucgaaaaauguagucucacucucuccaucugccuaguuguaacauccuguuccuaaggaaguagaaucccuugggguagcaagggcaaaaccgguuuugcggauaaguuugaaaaauauggcuguuggccuuucccacccacucuggucucuuagcaacaagacagcugaugguauccacuagggggaaaaaaaaaacaaaaacacaaaacaaaacaaaacaaaacaaaaaucauagaacaugugggggagccugucugaauuguugccuacagccugauuuauuuaaaccuccacuacauucuuggaugugaagaccuaggagucaagucaugggagcuuucucuugcccuucucuugaccucuaugaggcagauagaggaaaaucucagaaugagaggaacuuucuuccucuucaagagucugcguuauccgagauggccauuuccuuugaccucaggaguaaccacuugaaaacuuggacacauuuauagaaaauuugggcuccugggaugcagugcugggaaaagcacagggcugaggggcuggagcuugggguaccaauggugacagucucucccucccugugggaguacuggcaggaaauccacugugcccuuguccccaccgaggguugauuuucuccacugcaaaguaaggagauugaauuagaucucagucuucucuuaagguaccuuucacacugagccuaugggaguggugguaugugcauguauguguguguguguguguguguguauauaugguguguauguauuuauguaaacuuuauaucauguuucaauccaauucucucucucucucucuccacagagcuaagugguaccacaagaauucaaaccuagaucuagccaaguuugaaauccuuguucucagcuccuacccuaugcuguuaugaucuacacagagaggcaccacauagcuaguauuuuauguuauaccuggugaacuuucuaucuaugcuuaucaauucauaggaguagaauugggaauguuggcguuuagaacaugauaccccaaaguauggcaccauggccugcuaaguacuuugagcugaaggacauagggaguucauagaagugagauccuuuugaacuucugcucccacuccucuuuuuugccuagaaccagcgacagaaacuagaaaugcuacacuaacuuucucccaccuuacuguggaggaggagcuggccaaaaaggaauucucugcccuaccuuauuggauaguaggucaucagacucucauuucggaggaauccuaccccaaaccugggaggaagaaaugccacccagagaagccgagaagaauaggaacagacagaucaugcugagauccccucuguuaccauuagaucauauccucuugccugaucacauuucuacauggcaguccauucuucauugaaucuaagcauaaaaauggauaguuuucuguagcucauugggucuucauuuugaagguucuuaugucacaccaaacuuucauuuaaaaaaauuaucaugcuuuucucuugucauccuuucuuuuguuauaagggugccauccuuacgacgaggaaggacgaggaaagauaucacacguuugugcuccuauaggaaguuauagaggaccuaggcguuaauaaagaaaccugauuucacauccuugcucugccccgaacaguuacguggccucaggauucuuuacuaugaagugugaauaacagauccucucugaucagguugcuaugagaauuaggugaaaugauguaaaauaccugacacagugccuauaaccuaguaagugcuaaauaaaaagaggagagagcuucagagagacagagagggagaugagauauugauaaaguauagguuucuugaugacaggaacuugcccuguuuauccuguaaccucagcacacuguguggcacacugaagaugauuguguuuucugagucaaacagaugucucucucucucacacacacacacgcacgcacacacacacacacgugauagagugaugaauuccacaauuuuauguugcuggaacuucuuaguagggcucugcauuuuacagcaaugcaucacaguuaaaauaaucaaugugaucuggcugugauuauuucuuucauuauuuaaaaauaucaacaauugcuuuucaaagcacuuugauuuuuuuuuuuuuuuuuuuuuuuuggccagauuuuguuaggguguuucucucuuucuaccgccacucuuuuucuugagcacuuacuauauaucaaguccugggucaggugucuuauauucauuguuuuaucauuauuccuaauauccuccuagcaacucuaucagauagguuuuguuauuuccauuucacaacugaggaucuugaagcucagaaagugugagucaucuaagaccacacaccuggucaguggcagagaaagaauuugaaccuacaucucccugcuuauuaaagcagagugugagggcagggaguaauuuauacaucuuuggucuugauaauugagcucacuccuuccaaaaaaaaaaauaacuguuuacuuccuaucaauacuagagaacuuggagcacuucauguuuucuuggcacugagcuacauucauuauacacuaucuuauuuaauccuauuaaugacccugcaugauagguaacaauuauuaggcauaaauuucagagaagguaguuauugacaagcagguuaaguaauaagccugaguaacugggauuuaaacuuagguagucugacuccagagugagcuuuccucuuaagagugauccauugauuuuauucacgcucacgagauuauguggucuucaugcacuuggggagcgugauuguggcuuaucuagaacuuaacuuccgcucuuuuuggaagugaccaucaccuccuucucugcccugggaauaaacaauagaaauugaggauacagaagcuguagaaccauaggccaauagaguuuaaaacuugaaagacuucuucaagagaucaucuagucuaauaguuuccaacuauggggcauugcuuguuuaguggcuuauaaaaucaauuuaguaguucauggcugaccuucaaaaaaugaagugaguagaauagaaaacaugagauuuuguuguacuuagggugaaguagucuugagagcaguaguuucaguuaucuauaugucagugucuccugggucacuauguaaaaugcauuucuuacugaggguuaaguuugaaaaguuugaaaaauguugauuucauccaguguuuuucaaauuuuauuccauggcaucugaggaggccucagauaucuuaugggagauaaggauggaaaaaguuaaguagaaagaauuucagaaaugucuucuuauguuuaucugccuuucauguuggacuuucauaaaauauuuuaucuuaaaaagaagaacuuuacugaaaaaaaaaaaauaauucaagaaccacugauuuaccccauuggaauuguguuguuuuggguauugauucauucuuauguaacuucgugagguaaccgaggaccagcuaugugcucagaacagugauggcugccauaggauaugcaggaagucuaaaaaaugugguuaucccuguccuuaaauuguugauagaaccaauacgauaucaauuuauuucuuacaucaacuaugauaagaaaauacaugaagaaguuauucggaauauggcaauugauuuaaacaggaaucaaaagauugcuacaagaggagauaugaagggaucaaagcuggcugaagcaauggagaugaaauugaauacgaaggguugcaauuugguucuaaucagcugcauaaauacaaguguaauaugaauuuaguugacaauaguucaucauuaaaagucuuaagguugugucugggugcgguagcucacaccuguaaucccaggauuuggggaggcugaugcaggcggaucacgaggucaggagaucgagaucauccuggccaacacggugaaaucccgacucuacuaaaauacaaaaaauuagccgggugugguggugcacaccuguacucccagcuauucaggaggcugaggcaggggaaucauuugaauccgggagguggagacugcagugagcugagaccaugccacugcacuccagccuggcaacagagcaagauucugucucaaaaaaaaaaaaagucuaagguuuuucauugacuucucugugaguuaacaguauggcaugggccaaaacccaaggcaagcugauuacauucaaugcauucaugaacauacaguauggaauacuucuguuguggaauugcagagaugaucacugcacuuuccagcuucuccuauaugagguucagucugucauuuauucugguuuggccucaugacuggcuuuggccauuagaauaugguugaagugagguugugucacuugagcccauuuuucaagcaugcagucuccauucucgaacucggggaacgcugauacagccaugugaauaaguccugguuagccuucuggaagaagacaaauaguguugagagagaucccaccuguucuagcccaggucacccuagaccagucaaucucuagcugaucugaagcugaugcagaugcaugaaauuaccaagcccaauccagaccagaagaauugccuagcugacuucuagaagugugagcuaacuuuuggaauguuuuguuaggcaucaaauccuaacagacggacccauugucuugcacuggcaaagccacucuggaagacaauacuaugaccacauuugauugcuagaaacauucauaacauuggcuacaaauguuuacaaacuaaaagauguucagaucaggguggggagaaaggcucugaaaaccaaggaguugagaaagcuuaguuugaaaaguaaagauguuuuuaggaacaugaacuccaccuucugagaucugaaauuaguaggaaaagugaguugaauaauuuguaacuucugugguugguugaauauuucgcugcaauucuugccccguugcauccauuuugucauagccuuauaacaggcagcaugcacuuuccuuccccuuuaccuugggauuagauguguggcuugcuuuggccaaugagauguagguagauguuauagagugccaguucuggccccauaaggaacaucucauguuuccacucauucuccuauacuucugcuaucacuguaauaaccuagcccacuuggcccacuggucccagauaaggugagaaacauggaacacagcuaccucccaccacccuucagcauguuccagagccuucccagcuagcccauaccuucguaagugagaaauuaaugguuauuguacaugccucugagggugugauaaugauucguacccagaaauuguuggccaacauacugcugagauuaaaauuaggauuaaagaaacauaaaauaauuaggaucaaggaauagcuacaccaauaaaguagacuucuguugcauuuaaggaggaauuucuuugccaaggaagaagaacuggugaaauuaggaauucuguauccugagggauguucaaccaucagcaagauguacaucgucuuuguagcuggaaugagaaucagaccuucauuucccggugaccaagauaucaaguaauuuaggggaugaauaguaggucauuucagcuguguuucagcagagagggaggaugagcaugggagcuuaugugugugcacagugaagguguugcuuaggagaagcagaggcugggggagguuuguaugccucaacaagaugcugaccuuugaucuaaaccugugugcauuuguuauccaaucucgaauuccucccucuuaccaacaaguucugcuccugaagauccagcuuaagucuaauuuucucugugacaauuuucucugaccuuucuagccuacagggaccaaugcauuucugaauuuuuuaucuuggcuguaauuuauaugcugucuuugcuuuuccuugacuucuuuuccaggcuguuagauguuuuccagguacucacauagcauuuccucaaauuaaaaaaccuguuacucugaucauggucuugucucuuuccuuaaaugugugaacugguagaaggccaggaguauggcuuauucacucuggugccccuguaucaaccacaaugcccagcaugccacagggcuucaggaaauaguucuuaaaugaguggacauggauuucuuuugucuuucugacucaaguauaaauuccuuaaaaggcuacugguacucacauucucauagugcuccaaggccugugcauuuauucauucaacacauauuugaugaaugauccuuacuguggcuuacgaaguccuaugucaccuggcuccuaaccaucucucugacaucaucuuguguaacucuuucucugaaucacugaccuucgcuagccacauucauuuuuucucaguuuuuuuagcucuuaaaguucuuucccaucucaggguuuuguaguuucuuuggcuacaauaucuuccccuugauuuucuguggcuuccucuuucuuaucauucagguucaguuugaacuucuccuuuuuugagaauccuguucugaauacccaauuugagguaucauccagccucucuccaucacaucuuccaaucucaguuuucugcaugauaugccucacuuucugauaauuucccuuuuuccuucuuuuauuccucucucucuugcuccuucccucccucucucccuuccuucuuuucuuccuuccauccuuucuuucuuacuucuaacuugcuuauuuauuuaauugauuggcuuucucuguuaaaaugcaagcuucauaauaacaagcaccuuuuugguuuuguccacugcugugucccuacugucuaauaaauauguuuugaaugaauaaaugaaugaauaugagucuaggagucagaugaauguugggaauagacaggaaagaauucagacaaaguuauugucuuugaguauuuuacaauuucuugcugaaugaacaaucaauguguaaaugauaaagcaaaaugaacgaaaacaaaauaaacaaacaaaaacaaccaacgaaccaaucaaacagcaaaacaaaacagacuggauugcguguagcccaucugauguacuuaagccucagcuuucugugcaaaauaggaauaauaauacauaguuugcagguuugccaugaggauuaacugaggcagugaaugggcagcagcauaucauuccuagaauaucauaccuggaauucagcaggugcugaauucccagaaugguauucuugacuccccugccucaucucccuucugauaugugaaauaaaguaauuaagaagcucauauuggucucccaucugaaccacuucagagaauugaacuccaauuccaaguaugacuccuagauuuaaaucccauuaugaaaaucucucuaucccaaguucuccagaguguuaacaguggagguggaacugaugauaguucauuuguguggcaugcacuuugauucuuucagagccuuugugugaccugugaagucuuguuaguugcuguuccaccgcaaugugguggggaacuaugugauaauuggcuaaaagccacugaaaaagcauaaagugucuggaaaugcuauagacagggcuggucuucugcagaggugcaguugacaacggcuggcguuuccugaaacaccaccauugaugagucaguccuuuagguuauaucauugcuagauaaaacaaaacaaaacacacuuuaguagugauuugcauguucauacaaguuugcuaaauagcaguguuuaguucuagaccuuuaaauagaucuuguucagcccugacauucaagacaauugaaauauucugugagcagaacugugaccacaacuauaauaagguuaagugaauccauauuuggggauaguucuuucugaggcuggcugguugugucuagugaagaggacccacaaaagcccuggagaaggggcaaguuuagccacuggaaggggcaaggucaagggcaguuacacaacagaacucccagaguuaacucauaucuuuuccuacuguuccuaaucuauuucccuccccccuccacguacacggaugugcccuuuaaauauuuauuugcccaccuuugcagugugcgguagacuuugucucacaagucagcuugaucccuuugaagguguuuacuaauuaaaucaggcugggagguuaggaaaguucagauauauuuauccuguauaaaguagucccuggacccaggaccccuaaacagcccuagggaggucagcuacaguuucccugcuuacuuucuuuguuggaggaaguccuaaucauugcccaauuaagcugaauaacgcugcuucuuuuucuaccauuggcuccuggcacaauucuaagacagacaucggaauggcuggagccagaaagcuaaaugcucuuaacaaguauguuuaugggccaguuucccacacagccguaugaaauucucacucaguaacacagcaucugagccacagacacugacucaaauacaauauuggcuuggaaggaagagugcugcuguagcacaggucauuucccucuaauauuuuaaaauaguauuuguuucagaagaaucugugcacauucauggauguaugugucugaguguauaugaguagugccuguguguauguguuuguauauaucuucagcuaagagagcuuucugaagaggcgaaacacaaagugagugggagaucucuguuguauugggucuuagggcagccucugccucaauacaacuccauuguauuaaguucaggcuuauuugauucccuucauccacuuuguucauuuucacuggucugauagagagugagaaauagcugaucaugauuacaugaaaugucugguuuuggucucagggaauccccuuagagauucuugucuuaaaggucucaucuaguuccaacagcaaggccaaccacuucccauuucuggagcaguggcaugaagcacuugggggugccugaaagcacacugagaaucaugcaguuagcacugugacaaagcugugggugcccaugggcuuuucuaggcauggccuuccucucauggacagagucuggagcauucugcuuucugcaucuaugggucaucagucacagggcugccauguccauaauccacagucucuugcuauuuuuaccaugaaacugggagcaccuuaacccuguagacucaaucccuagcucugugcccauuaacacagaauaaauagcuaguagugguguuucugguuuaaagggccugcacuuuuuaagguuuugaugaauacucccuaauuauucuacaaaaagacuuuaccaaguucaaguuucuuucccaauaaucuauggcaauaauuucaaucucccucuucccuuuuuuuuuuuaacuucuagguaaacauaagaaaggaaaacuuuuguacggugaacuugggcuaaaaagaagaaugaugucucuggaacuuuugcugcuuauaggaaugagagcaaaauccuggcaugaccaugauccuucaaugagcaccacuguguugcugcauucugucuggccaaucuagucuauaauaguuuuuuguuuuguuuugauuuuuguguguuuuuuuguuuguuuguuuguuuugauggaguuuugcucuuauugcccaggcuggagugcaauggcaugaucucagcucacugcaaccuccucaucccagguucaagcgauucuccugccucagacuccuaaauaccuaggauuacaggcaccugccaccauacccagcuaauuuuuguauuuuugauagagaugggguuucaccauguuggccaggcuugucuggaacuccugaccucaggugauccaccugccucggccucccaaagugcugggauuacaagugugagucaucacuuucggcuauaauaguuuuuaugcaucauauuaauucuggguuuuugcuuuuaaaaagaagccuuuuuuuuuuuuuuuuuuuuuuuuguagggaaguaagacuggaugguggguuagcaggggacucgagaaaaggcagucagugcuacaggcgcagggauauuaaccucaggagugaccagugggaugcaaccagccguuggggcuuaaaacucaagcacauuucucggaugauaauuucaaagaaguagcuaguuuugguugaggcugccucuggacuauccccagcuucucaguggaacucgguguuucugaaugaaucacaauaaagaagcauuacuugugggauguggccaaccuuucuguucagcuuuuauugcagagcugauggcagcagcuggacuuuacaaaggugaugguggcucaaagccuuucuguuccacugugucucauaaagcuuuuaugaagccucagucaucucuucagcagauccugugucaugaagaaggaugcagagaacacaaggagcaccccauccauggugcaucccagguuucuaaaccuuccagggaggggaaaucagcauuuuuggcucuggccaagaagccaaauugcugaagcuaugggacuuguuccaaacugcaagaucuuauuugaugggaaugauuguagcuuuagguaauucugcggcuuauuggcuugggugagagcucccuagugucugcuggaaugugauggcuguaagacgcagggaggagaaauggaaaaggagcgucuuuauugacccaacagagccuuguaaaaaagcaccaacuacauauaugcagucugugcauuucaaaaguaacaaacaaacaaaaucaguuuaccaacucuugggagagaaaauggauuaucauucacugcaaauucuccuagguaaacagaagagugcuacaccugugcagagagaaaaguuuuauauaugcucaacuauggguccucaguauaauacagucccaucauguauuuccugagacaucuacuaaggagacuuccuagaauugaaucuuucucaucuuuuuuucucuuuucuuccucaagucuucugugacaugugauaauacaaaacaaaauacaggucuuagaauaaauguaccuggaaucaagucauugugaaauguugggcuucuuugacccucaguauucccaucgcaaaccaggaauaauaagaccugcauuucuccauugaccauuaguaaauugagcuucaauuaccuaguuagagaaaaaguuaaauauugccuccaaagcuuaacaugcauuuuaauauuuuugcuuucugcuuuuaaaaauaugcuucucauuuucuuccccugacuagcucuuugacugccagagagauguauaagcaucuugagcuccacugguagaguuaugaguucuugaauuuagagguuauuagaagaauuuuuuccuacuguuuucauguaaauuaccacucaggaaaaaaugguggaauagaaucuuuuuucccuuuuauagugucuuuuucauugcuuccaaauuuuucauaacuuuucuacagcuaccaauaccaucuuauaucauccagacugccauugcaauacacucuuaacucuuuccaugcuagcacauccuauacacagcauucauucauucauucgcucacuuagcaaacauaccugguagagccugaacauucuauuaggcauuagacauauuaaugaguucaaauaucuucuucagauucccaucacuugucauauaaaugucaaggcccauugccuaugauucagaauccucugcauuuacuuauuucaaccugcuuugauaccuuuaaccuacuuuuuccuuuuuuuucuuucuuuuaagaaauagggucuugcaauguuacccaggauagauuuuaaccuguagguucaagggaucuuccugcuucagccuccugguuaguuggaacuauagguguaugcugcuggcccuggcucaacaugcuuuuuaauucuuucucucccuacaugguauuaugaacucucaacuccagguggaccaaucuccucuugugucugugccuuugcuuuggugguccucuucugggugugcccgccuaucuagauuucacuuguucaaaccuaauauucagugggaaguucagguauugcugcuuuugugaaacuccccugacaacaaagguucauaggacccuuguuguuuaauaucugaauuuauauaauuaaaacugcuaguuaucuuuuuaagcauauaggaaaacaacaagauuucaagauacuuaaaugaaaagagagaaagauacugguuuaucuguucucucaccuuccauagcaucucauacagucuuacucaacaaacacuugccuauuuauuuuuuaagccacauaauaacacauaaaaauggaaagugauucacuguugggguuauuccaguaguuuauugcuucccucuuauuuauuuauuuuuuggaugacuucagauaccaaccugguucaaacccuuaucaaaaaugaccuuuccaacuuggcuccuguggagucuucauccuucuucugucauugcuauagaaauacaggauucccuagucuagucuggagagcacaguaucagguaguggaaagagcugcagccuugcacagcaaacuagauuugaguucuaauucucccugcaaauuguuugacucuagaaauagcuugccucucugagccucaagucccucuucuguaaagcagaauuaauaaaacccauugcagggcuguugugaaaauaaaaugugauaauauaugaauauaguaccuauuuugcucacuucacaguaggugauugcuaaauuauagcuauuauuuauaucgaccaugaaugcuauaguguucugccucuucuagggcucuggaagaagcacugaacuuacagcaaugcauaccagccuacuauguagugggcucucccaaauuguaauuuugggagcuguccaacaugcagacuccuuccuuguugguacagagccucuuuuuuguaguaugguuggagaauaguggccucuacuuaucacagaugucagagacuuuaaauccucccucuuuucaucccuagguugauagaguuuagcaaauguccagagucuggcccauuauaucccucugccaccuugccucugagauuuugaauccugacugugugacucuugcuucugggauuuugaaaccugagaguaugucccaaagcuaaauacucacguaaaauuuauucacagcucaggcagcugcaguggugguauucggcuacauucuuccuucuuccuacaagaucauuguugagcuuccuccucuuuaaucacccagacugcuacaguucuuguucuucuaaguuuccuguugcugagaaccucugauaaacuuccaguaaaucacuaacccuucuuccccaauuuuucucccuauguucuugaaaccaagagcucagagugauauacuacaugucccuggugcuucauucaaugacagaggauccauggugcacuggcccacccuuugaucuuguccccaugacugaccguaaggcuuggugaagucuucugcugucaucguuuuuguaucauaguuuccagggaauccugguuuuuaaggaauccuggaauccuggagccagaaagaauguugagcugcccucuagcuaagccauuggcuuuccagucaccuccugucuauuuucacaggaugacauuucucaacuugaauuguuuccguguuccgguuuuccccuccuccuuuagaagaauggcccaaccaauaaaauucuggcaccuucucuuuucaacaucugaacauguuaucaggagacacaaauucucguguaaccuuugcugucgauagucguuguguaagccaauucaucucuuuguccuucagucuucucaccuauaaacuaggcuaaguagcagcagagggccauuuugaggggaaaauuaaaaaauugucaugguggaauauuucaaaaacaagacuggaaguaauaagcagaugaugcccugaauauuuuucacagaccaaugaucauaaaaugaaugguaacaacauuaggaaagauggagugacuuuuggguuuagcuauuagccauggagaauugugcguugaguggcagugaggggcugggggcugaaugaaagcuacuguuuuucuaaucagguagugaccucuucuggggaaagaaagagucuagcagagccucagcauuaggagacaugugcaacguuuguaccaaggcaaccaaugauagagaggaugguccccagagggagaagcucuugggguagauguuugcccugggcagccagguggaaaacaaaaauaaaugaaaugaaacuaaaaaucacuuucuggguagcuuuacccaaaagagcucucauugagagagcuaaugaaaccuuguggaccuguguaugcauuguggugagguuaccguccgcgcaagcuggccagauucaagaacccaagauugguuuuuagggcgaaugguucaaaaaagguccagaugggaaacguauuugugugcauucccaucuggaaggaaaaaggacucuuucagagggacaaaccaaaauucaaacgaauggugaggucuagaguggugagugacuuuugcccaguaguccuuuaggugguaggaaaggggcaaguuccuauugcaaucuugucaguugaacuagaguaguacaaacuguaaaaguuuuuuuuuuuuuucucccucuaccacacaccaguauauucaucugcuacuuaaaggucuuggaaggaggaagaaagaaaaucuccaggaagucuucugggugacuucagcaacaauugcauuacccuuuuccagguacccaaaggacuuaaauugugcuagagaauggaacauuaaaucagacagguucugcauugaagagugcugcaugacauuacugaagauacaagcuauugcuuucacuuagacccauggacagcaaggugcagggcugaugaaaaucauauugucuuaucuauuuuugaacgguauuagaagaaugggucucaaaaggugaagagacuugcccaaggcagacucagaaacauaugggcauaacucaaauuagagcugggguuucugaccaucuuuuuuuuguuuguuuucuguuagcagucacuccucuuccaccuuucuccagccccgcacugcauauuaaauugauuagucauauuaauauuaauaucaccuggauauuagauagauuaauaauaugguagcuacaguuuaaacaacuaccacaugcuagucucuguccauucauucauucaacaaauauuuauugcgugccuacaaugugcuaggcacuggagauacaauagcaagcaaaaaugauaaacucagccauugucaaaaaugucaucaacaaagauauaacuaaaacugugcaaucucugaaggcaagagauuugaugugguaagagguugugaugguaaggguggggcuauuaggcuagggagagcuuccugaaggaagugaaaauucuguucauguguugaucaggccuaaaaaucucagcaucauccuugacuucauucauuuucuuacacucuguauccuauccaccagcaaaucugauuggcucugcauuugaaauauguucagaauccaguugcuucuuaccaccucugcugccauccuccuuugcccaaacacuucuugucucuugucuguauuguuggaauauggugucucugcuuucacucuugucuauccaugcucaaauauauuuggacaccgcugggucaaaauuaauuuccaagucuuguacugccgcaggacuucucagaggcuuucacauacuaaccaauguacugacucuccaagaagugggugcaguauacagcauauuacacacauuugaccacagggacucuuuucuuauagugcauuucacacaacugcuguuucguggaagacaugcugaaaaacacagaaaauguuuaugaaaauauuaauacaucacauaaaggauuauuauuauuccacaggaguacaugaugggaaauggagccaccuacaacaguuucaugaacagggagucagguuuacugaguccuagcugcaguuaccuuuuucugagcuggguggcauucaacaaguuauuuaauaucucuggguuuccucaucugugaaauacagacaauaauuccuguccugucuacuuugccaggcuauuggaagaaacaaauaaaauuaaaaauguuaaagaaagaacuuccccuucccuccacuacaccaaacacgaacuaaaccugacaccauuacugugcuaguguggacacuuagaaaaucauuaguauuuucaguuacacgaucucugcacuuaaucaaugagcaacaaauuaacauuugguuuauuuauuuaagcaaccaggaguaaaacccaaagaguugcuggcuguuggcuggaaaucaaacaaaacaaagaauuaauuggagcuaaggcuguggaaagugccagucugugacaugcauggaagaaagcaaggaaagccuggagugaccuggauugcauagcagaaagaaaaaucccugcaggggcagugugaaaagacuagggagguaagagaaccugaaaauacagcacuguagguagaaggcuguaaagcuggaaugaugcuaacaaauacuguauuauuaccuuagcugauagcggugacauaguggcccacacagaaucauugaauagcaucgggugugguaauucagggagagccaguggggcaauguagaaacucuaagcuggcaaaguucugugguuuuuguaaagugccuauccagaguacaugguucauucaugccagaucagcaaaagcagcugcugaugugaugaugauuucccuuuugagcuaaaccucuacagaguuccuuuuuucucuagggcuuuuggcuaugacugaugacguagccuuaggcucaggauucuaacaccccacaaaagcaaaaauugacaaaugggaucuaauuaaacucaagaacuucugcacaguaaaauaaacuauuaacagaguaaacagacaaccuacagaacaagagaaaauauuugcaaauuguguauccaacaaaugucuaguauccaguaucuauaaagaacuuaaacaaauuuacaagaaaaaaaaacccaaacaacgccauuaaaaaugggcaaaggacaugaacagacacuucaaaagaaaacauauaugaggccaacaagcauaugaaaaaagcucuauguuacugaucauuagagaaaugcaaaucaaagccacaaugagauaccaccuuacaccagucagaauggcuauuaauaaaaauuuuaaaaaaugagagaugauggcaagguugcagagaaaagagaaaaauuauacacuguuaguggaagugugaauuagcucaaucauuguggaaagcaguguggugguuccucaaagaccaaaacacagaacuaucauuuggcucagugaucccauuacuggguauauacccaaaggaauagaaaucguucugccaugaagacacacacacacauauguucauugcagcacuauucaaaauagcaaagacauggaaucaaccuaggugaccaccaaugguagacuggauaaagaaaauauggcacauauacaccguggacuacuauguggccauaaaaagaaugagaucauguccuuugcaggaacacggaaggagguggcagccaucauccuuaacaaacuaacacaggcacagaaaaccacauacggcauguucucacucauaagugggagcuaagugaugagaacacauggacacaaaugggaacaacagacaccggggcauacuugaggguggaaggucggaggagggagaggauuagaagaaauagcuauugaguacuaugcuugguacuuagcugaugaaauaaucuguacaacaaacccccaugacaagaauuuaccuguauaacaaaccugcacauguuuccuugaaccuaaaauaaaaguuaaaagauaaaaauaaaaauaaaaggauucugaugccccagacuaacuuacacucaguaaauacauuuugauguauuugugggccaaagcuccuaauggagaugaugaugaugcugcugcugcugaugacgaugaugacuguauugauaaugguaauaaaaaacauagcuuucauauggagucagguuacaugagauacaauacucuuucagagggacaaagcaagauucagaggauggugauggugaggucuagaggagcaagagacuuuugcucaauagucauauagcagcucagaaaccacacucauggccaggcaugguggcucaugccuguaaucccagcacucugggagggcaaagcagggcagaucaugaggucaggggauugagaccauucuagcuaacauggggaagcccugucucuauuaaaaauacaaaaaauuauccaggcaugguggcacacuccuguagucccagcuacucaggagucugaggcaggaggaucgcuugauucuccugggaggcagagcuugcagugagccgagaucgcaccaccgcacuccagacugggcgacagagcgagaauccaucucaaaauaaauaaauaaauaaauaaauaaauaaauaaacaaacaaacaaauaaauaaacacacucaccucuaacccccuuaaaugauggccugaaguuggcauugaaauccccauugaauuuaaaaggggaacccaaacuccaacaauuuacuggaggucacauggcagagagagacagcacuggggcaggaagcaaaucuucuguccuuccauugucuuuguuuuauaugaugugcuucucuggccacaacccggugggaccauuaaaucuuuugggcacucagugcugggaaaaaaucucuugcuggacucuuucauauuugaaaugaaucccaauggauaagaaguuucauguuuuggggcauuuguaagugaagauauucuaggcugauggcaaaguuaaguugucauucaaccucuaaguuaaugcuuagaaguuuuacuugaugaaccaacguauggucauuaaaaacuacaaaguuuuccuccucaaauguggcacuuaagugcugugugaccugauguguccaugguucaauuuuccagcuguaaagcgggguucauaauacuucccaacuuuguaggguuguugagagaguuacacaaauauguguaagguaccuggcauuguacaaauauaugugagccacauugucaggcacacucaggcuuuacgauucuuguuuauuuuguaucuguuauuuuuguuuuccuacaauucaccauucugaauguuaauuaucuagcccuaacagacuaacaggucuuggagggcagggagcgucucauucacugcuauaucucuaguaccuggaggauaaaaagucucagaaaacaaucguugauugaaugagggaauaaauaaacauaugaauagcuguuuaauguagccaauuaaaaaauagguaaaauauuuuccauuacuuguuuucuuauuugugaagagucauaauuucuucugacacaguaaaaaaaaaaaaauuaaaaagcaagagguagauaacuucuuaaagucuugucuuuucaguacucauacauugaccaauucaaauuaaacuacugaaggugacagagccaguguuuacuggucaaauacucugccauuaauuauuucuaucguauagaauauuccuugauuggguauuaaaaaaagaagacagagccuaugcuauauucucuguuauauucugaacagcuaagaacugugccugccacccaguaagcacucaauauuuauuuaaaugaauaaagauauuacugcuaaguguucuuucauuuuguuauaagcucauuuauaagguaguuuaaauccaaaacacuuuuuccaccuaucccuggaccuuaacauugagccucuagugucacaggcaagaacccaauagaauuaaaagguuuuuguuugcacaaaguuauuugccaggauuacuaagcaaacaggagaaauggaacaaaaaugauaaaaacaauuuguggugcuuuccugugggauuuuuggagguuuuucaaagcaugacuagugaguaauguaauugacuuuuggaggagaaggggaagaaaaaugggcacaugauuauggacuuugucuccugugagcuuuguggcuguauccagccuuugcaaaacaucacuuuuuuggaauggccuguagcuagguacauaggccaauggcauucacuggaaacacagggaacuuggucuuccucagaaaugaggguucauuacauaacagaauccagguggcagcacagucaagggacagggagcaguggcugaacucaggugaucagucguggcaccuuaauugccuggaucaguaauggacacaaauauuuagguagcuguuggauuucucacaaguagaaggaccauagcucacaaaacaggcugacagcucauucaguuugaggugaacauuauuguucccauugaacagacgaggaaccugaacccuggaaauuauauugaacuugcuugagguuacuccacuaguuuacccagguccaaauuuugaguuuucaguauugugucaugagcucuuuccuuacagaaaaaaacuaaauauccucaagguuguuuagccacuagcccagauauugacaaugagucauucucuaauuacugguuuacucugaagcugguugugcagugcagccuagugaggggaugcaggauaguugaucccaggggcuuuaaaaccccuggaauuuuaacaacucacaaauauugagcacuugcuaagagcaagguagaacacugaaggcucuaugugcaggaacucccccagucauugcaauaacuuuuugagauaugcauuguuaucaucuccauuuaauguugauugagacugaggcucagagaaauugaccugcccaaguuugcucagcuagaaaguagaagagcugagcagugacuucagguagguugaccaauucauccuggcugugcaguucuuagaaugguguuaggaccagcaguaucggcaucgauggguaaauuguuacagaugcaaauucuugguuccacuccagaccuacuaaaucagaaacucuggcaguggagcccagaaaucugaguuuuaacaguuuuccuauaggucuuguugcauacucaaguuugagaacuucuggaccauauuaaaucacugugcuuucagggaagaaaggacuuacacagagcacugagcauaccagcggagcuuagagccuugggaagauguucuuccaaaagaugcuauuauuuugggcuucuggaccacaacugagggaguagaguggaagcagaaucucuuaagaaagaauaugugaugggaggagaugguagaaagaggugacaucacagccaccuucugagaauaugauguguuuauagaacagguguugauuauccacuagacucacugaggucaagugacuuggccaagguuggguaaucagugacaaaugaauggacucaaacccaguccccuggcuccucagagaguauguuaaagcuacauuuccucacuagaguagggugaggcauagagguucagugagccucugaaucaugagaaccucuccucaguaacugucacaacuucugacuagaugagcuagaaucaaaagaagaauuaaaaagauaguaauuugguggucccaggagggagggaagacuaagggaagaauucagagagaggcacuaaggaggcgaggaugucuucaagguaccacucuggaacccaugacugucuccuuaucuugaucaucauugucaccauuuauuggguugcacaugcucuaguauguuaccaaccagaaaaugcaacacaggcgaccuugaguuuaauucccaacuuugccagugaccccaagcagguuauugagcuucucugagauuauuucuucauguacaaaaugaagaucaugagaguuccaaccucaugggauuugagggaaguuuuaaaagaaagaauguauguaaaaccccuaguagauugucuagcucauaauaggugcuaaauaaacauucacuauguuguuguuauuaucuuauccaaaggcugguucacaggacaaggcagccauggacauaaaaggaugccucagugagugaggaugaugauuuagcuguuugugggcacauaagucucccacuauuuguccguucccauucuuaucuuuacucccucauccaccacuucuguccucucagacccucacucagagagaguggucuuaagaaaggaccccuuuaaucucuuguucccagagaggccaugggugcaucucaucugcuucacugugucacccaacacugugugcagcguccagggcaucagaagcucacucaccuggacaccagcugccaggagguggcagguagauggagaagaauguuuucaagggaucucaucugaacauuccuucugauugauugcuuagcagacucguggcaaaacaaaguuuucuggacccucuuaccuccuuugucuacuuaaaugacaauaauauuuauugaucaauugcaauaggccaaccauuuuaugauauuuaaaaauguuauuucauucaaauguugcaaugauauuuguaaagugaguauaauuauuuauacucuauaaaugauguaaacaguaauagauuuuggaaucaggauuuaaaucacauuucuggcuccaauuuaguuuaucaguugaugucuuaaauggcugcuuccucuuaaaaaaaaugaauaucuugauaaagaggucccuuggcaaggcacauggaggaguguuuuucagggaaggggccugauucccucuaaauuacagccaucuuucugcucaugcugguaugugauuuggcuccucuccacucccugaccauaucuuugugauuaugccuuuuuacuuagccuugaaaaugggcaauaacucuacuccgagucaaauuaaggggugggcuagacaggaaguugccagaggauugauucuauaauaggcucugagccaucacuggaaauuuaaugacauggaacacaguuuauuuauuaauauuccuuccauggagaauucugcuuggaaaaauguuugauacgacacugaagguggaaagaggugccaacagaguuaucuucuagggauaguggaucaggucagugccaggaagauaugcaagucugggucagagcugaauuguuugagaggacagaggggaggcugagguugcuaccaacaagcuauuuucucugauuuucccacacagaauagguggccaaacaguuaaacacauauuuccuugaaggagcacugaaucauuccccuguccagggugcucccaccccugcauggagcccugacgcugcucagaaugcugcauaggcccuccuacccucauauucuuuucucuuuuuccuucuuucucuccuuuucuggacauugcugugcaguguuccauucugaucuccagcucuaggucauuuuccacuacaguacagcaucugcagccuggacaagaacaacagugugugaggggcaguggugagaccugaaaggcagaaacagagggcuggguuccaggacauuucuaacauuaagaagaggaggcugggauuuggaaucucuugcucugccucugccuacaagccuugaccaagauucuugggcucauccauaaaacaauaugaaaaguaaacauugagcacuuaacuauauuccaggcacuauucucagugcuucauguguuuaugcaaauaauucucauaauaaccccacaauauaauuacugucauaauccccacuuuaaacaugagaaaauggaggcacagagagguugaguaacuuguucaaguucacacaucuagcaaauagggcucaaaugcaagcacuuuggugccagaaguuucauucuuaaccgcuuugugauacugccucucugaaagggacaaaaagcaauggugaaggugaaaugaagucauguaucuaaaaucuuuuuggaaauugaaguuguuugacugugaguauuauuauuagcccuccccaccgccuacaucucugcuauuggcagaaauaaaaaugugcaucuagagaugccuagaagggaacggaacucacccagauggugcauguagauggagaaggggcuaccccuuuugccaaagagugaagagagauucgaguguugcucacgacuguguucucuuuauuuagcccaugcccaaggcacaguagagcaucagguaauauucauuaaauaagucuagguuugaauccuugcucugucuauuaccuuuggugaguuauugaaguuuucuaagcuucacuuugcuuucauuuuggaaauaaggauuuggguaccuacuucagaggucaugaggccuaaaucuagauaaacguagauuuugaauaacugauaauugcuaauauuauuuuacuagaccaguggccaacaaucuuuuccuguaaaugaccagguauaaaaaauauuuuagacuuugcagaguagacugucccugucacagaaacucaaugcugccauuguagugugaacacagucauagacaauuaauaagcaaauagguauggcugugcugcaauaaaacuuuauuuacaaaaagagguggcagaugugaaguggcccuugguuuguaguuugcugaccucugcauucuauggucugagcagugugaaucugaaaggugcuaagccauauuaacaggcugaaaauguucuugaacuuccuaggcagaucucaucucuucauuccuuuccagcguuaaggaaugagcaauauuuuccuggcagagacagugugcuugcaggggaaucuguucucggaguuuguguuuguuuguaauauuucuuuaacaagugugaguggugagagcccuuccucccacauauuuuccuucuaacuccuuguuuccugguaacugcaccuucuccacauaccucuagagcuagucuguggugagaacacauagaauuugggaggcuggaacuuugcuugacucccaaauagaaccuuaguaagaugguauauuuaucuagaauaagugaugugcugaaaaauauauuaaaaagaugguccuuuaaaaaaaugugguggggucuuggaaaaagaacaagguaaaaauauuauauuuuauauguuaaagagaaugaaccaaaugugcuuugggguguagcggaagagagaacaucaguaguuuuuuuaguguuuacuguuucucaauuaucuaaaaggggccugagacaccacaguugaugguucauccagaaccacaugggauggguaacuguggcuccccaugggaacaucaaggggcuguuaacacaagaaggaggaaggaugauagagauguaaaaacugcauuggguuuagguaaauacgagguggcugcccaaucucacuuuuuugaacaucuguuugcucuccugugcaaaugaaaauagauaaugugaaaagcacuuggcccauugccuggcacaaaacugaucuagaauaaguggauacuauaaguuuucauuuuguucacugauauuauuaauaaaaccugacagguauuaaaucuucacaugcauuaggccucucugagcugaucacauacuugcuggauuccaaugcaugucaccuuucgaugucaucgaggaccuacauccuguauaucuuucuguucuuccauucuucaaguuucagcaauguuucuccucaugguugcaauauggcugccucacccccaagcauucuguccucucagaacaucauguccgacaagaagaaagggggagggcugacaaaaagggccucuucuccuaugcuuuucuuucuaucugggaggcaaauauuuccaagaaggccccuuucagacuuucucuuacauaccauugaccagaagugugucacauauccagcuguaaacaaauggcuggcaaaaugaguggguaaccaggguuggcugagaagacucaggauagacccaugggaccgaaacaaggaaggccacuggguaugcagggucugaugaaaaagguacuuccuuucucaucccucccuuuaccucaagaaacaaguaugcuguuuucaucaguuccuaacacagugccuggccuaaaauggcacucaguuuauauuuguuggggauaaauaaugacuaaauaaaucaugaauagaauguucuucuuuuugccuuuuuuccaucuagaauucugauuuccucuuuuccgagucugggguaggcagccauggagcuauucuuccagucugacgaugacucuuucuaaauuugguaacaugggaagaauugaauauggccugucacacuguccacauucagccuuugauaugaguuggucaguguggucaaagacagaccagcaugggugaggcugaugguaaacucaaggguugcaugcacagaaaugaccaagaccuuucuaagcaagauuggaagucaggauaagcuuguucccuuuaaucaucucuuugggcaguuuccuauggcuuuucaagcuccccuguuagaaugugaacaaaauaacagggaucugcagagaaaaaccuuaaaagaaaugauuugaaaugcacuaagcaccuuggaagcauuaguugucaagccuuuaaugagauaauuauaaauguccucuauguagcgcauagcucaaauggucuacaaugccuuuuuagguaucacuuuguugaucuaguuugaaugaagcacuggaaaauauuucuuuaaauacauggcuauucuggauuauuugugguuucagucuuguuuacccacacugauaggccaaaaugaggauuuuugugcucaaaucuggaaucccaggcgaagaagacagaauggcagagugguugucuaaucugacuugaaucugauugcugucacuuauuagugugacacacugggcaaauggcuuaaugucuccaaugucaaugucucaguuuccucaucugcaaaacugggcaauaaucgauggugguucuggcaugguguauggcacauuguaagggugaaauaaaugcuauuuuuaauggcuuuugauaacauguuacauucuucaguuugucauugaaaugcauacuuaacaacuguaguugucaucuuugaaaaauggauuaugucauguggauaucccaacuucagcccauccaacaacaauccgucaauguuauaaggagguuucuguagucuuggaaugguucuaggcaccgggauuauauugaacaacugaugaggccucaugccgcugaagacuuugaccagacaauuaaggugguuuaaaaacacccaagaaauagauauuucuuuacuaugcagaaaugaguuucuuuagguucaauggacugauuauguuacucaaaauagauacuugagguuucuugauuguguccugcaguuggugugaaacaugaagucauguaacacugcagcguggagugccuauaaaauuaggggcugggcaaugucaguuuaccauaccuguuuacuaacacauggcacuucacacaagucaucucacuguucugggacucggcucucuggucucuaaagugagcaaacacccauucaugucguucagcugguuauuccagaguaaaagacaaaaauauuuugucauagcaauuauugcaguuacugugguauuugaggaguuuuuucagaagccagaaauuucuugggcaagggguaugagaaucauuguuuuucuauuauuaauucuuuccaacucucugaagaugaguuaaaaaaaccaucuugauuaucugaaagucugaaugaacuaauguggaaguuugggcacucugagaagcacacacagaggguaggauuagcugugcaggagauuuauuagaggaaacacccaugaagaaagaggaaguagaaggcagggagaggcuucagaccugcugcaggucuuacaccugugaaaggagaggaggaggaaagaaaauugaguggcaaagagucucagauuguaguauggcucuaaauucuagaauuuggcaugaucagagggaguucuugagccugucugaacauuuucaugacuuaaaacaggggucccugaccccugggccauggaccuguacugguccauguccuguuaggaacagggcagcacagcaggaggugagugguggcccagccagcaaagccucaucuguauuuacagcugcuccccauugcuugcauuaccuccugagcuccacccucugucauaucagcaguggcauuagauucucaugggagugcgaacccuauugugaacugcgcacgugaaggaucuagguugcacacuccuuaugagaaucuaaugccuuaugaucugucccugucuccccucacucccagaugggaucaucuaguugcagaaaaacaagcucagggcucccacugauucuacauuauggugaguuauauaauaauuuuauuauauauuacaauguaguaauaguauuaguagaaauacaaugcacaauaaauguaaugcaauugaauaaucucaaaaccauccccuugaucccacaagucuggaaaaauugacuuccaugaaacuggucccuugugccaaaaaggcuggggacugcugcguuaaggaaugggcccggaccagucucuuugugguuuuuagucauuggcugggggcugccuacaggagguguggccgggacaugaacacagcagauaucagcagcuggggcauucauucagcuucucauggcaagagaucugaacaguauauuuucauggccaggcccuaaauuuccugaaguuuucuguuuggaacacagacuuauugaguuugagaaaaacccagaacaugugugaugauagagauuuuuuucacuccaaaucaguguuucauuccuuccuuugauuuucacuuccuccucuguuucagcuaggccaaccauguugaaaaccccacccagguuuguagaguuccucauuucacaauuaaaaaaaaaaucucuaugugaauaagccacuuguacuuccuuuguuuuaccugcacagggaguuaugauuacuuucuugaguuucacagguuuucucccuccacucccugguggcaaggucuuuguuuuaggaugaugacauguaauagaaaaaccauauguuuuguuccaugagcaggcacaaauaguugugugacccugggcaaauuacacaccucuaggccuagguuaacccuuuugucuaaugaagcuaauaauaguaucuaccucgcugagauguuauaaauauuaggagagauaauaaauauaaaguucucagcacagugccuggcacauuguagguguuuaauaaauguuggaugaaugaauaagcuugaauacuggaggcacauaggucuuuguuccuuuuccuaccuucuucccuaccucuauguguuccuaccucuaugcagucagaggauuuagaugagaacagguggauggauaagagacuagaaccauagcaacaaacaagccauucuugagcauuuauugugcacagccacuggguuaaaaccugcaggacaagaggagggcacugacuggggcacagucucuguccuuguagaggcugcauuuccccauggcauuaggcauucaaagauaugaugacuggggacaugggguggggaacagggugauuaaaggcauggucacaggcuaagguggcagcuugggagaugguggaaagucuaaugugaggaaacagaagauguagcuggaaaguugucuuggcaucgaaccccugagaguucuaaaagccaagcugaggaaacuggacuugauucuguagauaguagugagucaauacaggcucucaaagagagacuugaaaugguccagcucgcgaugagaaggauucacugagaaagaauauccugaaauggcaugccugaacaaccccaaggcaggaagucccccuugguggguugggucaaacaccguugucaauaaaugacgguuauaauaucuuuauuuucauuuucaauacaggcaaucuccaauaauagaccauugagagcuggcauguugcucuucccuguggggagacacacugggaguggaaguuuuaaucucuguuauaaaugagcuugcuuuaguagagaggagaagaaucacacucaccuacuaagucacauuuguucaaucagugacauuugcaccaagcuccuaccaugagucagccccuaugccaaugaucgggguguaaaagcgggcaccuugccugcccucaacgggcuuugcaugcuauugggauagcaaaacaaguaagugacugcaguaggacaagacuaagggccaaaaggaauaggacagagacagggagugauauggaaauuugcuaggagaaagagaauaauagaagauaaaauaguggagaaagacuucucagaggggacgagaccucaacucgguuuuaaauuuauuuauuuuuuauaaauaauaguuguacauauuuggggagaugugugauauuucgauacccauauacaauguguaauaaucaaaucaugguaaucaggauauccaucaccucaaaaguugaucuuuucuuugucuugggaauguuacaauucuucucuuuuagucacauuuugaaauauauaauaaauuaguguuaacuguaaguuuccuucuguacuuucaaauacuagaacuuauuucuucuagcuaacaguauuuuuuuuacucuuuaaccaauuucucuuuggggggauuugagguguaacacagaagcuuagaaauguaguauauaaagaaugagaguuuacccauuggagucugacuggguaguguagacgcugaauccacuuucuagcugugcucacuagagcauguuauccucugugccccagucuccucaccauuaaaauggaaacacuggugggaacucacauguaggguuguuaaguagacacagcacaggucagaaguucuuuucugcaaagggccagauaauaaauacguuaggcuuugcaggccauuuagucucugugucaacuucucaacucugucaccacaguggaaggcagcuguaggccacagguuaacaaauaaguggccguauuccaagaaacuuuauuuacagacaccaaaauuugauuuauaucauuuuccuuugucacaaucuauuaacuauuguuuugauuuuuuccaaucauuuaaaaauguaaaauccagcugggcacgguggcuccugccuguaauccuaacacuuugggaggccaaggugugggcaucacuugaggucaggaguuugagaccagccugaccaacauggugaaacccugucucuaguaaaaauacaaaaaaauagcuggguguggugucacaucgcuguaaucccagcuacuugggaggcugaggcaggagaaucgcuugaagccuggagguggaaguuguagugagcugagauugugccauugcacuccagucugggcaacaagagcaaaacuccaucuuaaauaauaauaauaauaauaauaauaauaauaauaauaauguaaaaaccauucuuagcucucuggccauacaaaaauaaguggcaugcuggaguugguccacaaaccauaguuuccagccccugugauagaguaacagacuccaaaggucagcucucguuauuuucaaccuuacuuuuuagacaggaaaauggagcguagagaauucauacaagacuccagaaagaaauuuuugccauguggggucucauuaaguaucuucuaucagcuauauauauauguacaagggaaaggcaaaggauucuguaaaagacugauuucuuuugcuagcauaaauaauacaucugaauucuaaagcagccucaucuuccaugcaaggcuuuauuuaacagaauauuuaaugugauacgauuaugcucuacaagacccaaaugaagaguucugcccagcuaagggggaggcacuacggcaacacagggcaccagcucugagucccuuccuguauuaaguuguucuugcauugcuguaaagaaauaucugagacuagguaauuuacaaagaaaagagauuuaauuagcucaugguucugcaaacuguauagaagcaugauacuggcaucugcuuggcuucuggggaggccucagggaacuuaaaaucauggcagaaggugaacagccaguaggcaugucacauggcaaaaguaggagcccgagagugcuaugggagaggugcuacacacuuucuuucuuucuuucuuucuuuuuuuuuuuuuuuugagacggagucuugcucugucacccaggcuggagugcaguggcgcgaucucggcucacugcaacauccgccucccugguucaagugauucuccugccucagccuccggaguagccgggacuacaagcgggagccaccaugcccagcuaauuuuuuuugguauuuuuaguagagaugggguuucaccguguuagccaggauggucucgaucuccugaccucgugauccacccgccuccgccucccaaagugcugggauuauaggggugagccaccuugcccggccggugcuacacacuuucaaaugaccagaucccacaagaacucaucacuaucacgaggacaguacaaagggugauggcgcuaaaccauucaugagaaaucugcccccaugagccaauuaccucccaccaauccucaccuucaacauuggggauuacauuucaaugugagauuggaggggcgggggggcaaacauccaaacucuuaucacuuccucaacugaaauuucuccccacugaucagcucucuuuauguaugauuucuagagcucuaaaaauggcagccacaggaaagcagaauauuccaaacagcagagaaacguagcugaaacgaaggcacauaccuucuucagcgagugguaguuauguaccugggguuuggccacaaauccaagacagaaaugaaagacauaugaguaaaacaaacucguguuucuuuuuguuuguuuugcuuguuuaaaggaguuaaacaaaacaaacaaaaaccacuuuggaauuuuuuacuuuaaaauaacacuuacguauugaaugauauguaacuuacucuuuucccccagcucagcaagcucugugcccuccuccucacuuucuggggaagaaugcauguuucagcuaaaaacaggugucaaucacugugugaagaaaaugaacaggcaggaugugccuaggaacaguacuuaauuugaagcuucauuuuucccuuagccugacggaauggguaucuuauauuuguguguugccuggauguuuggaaggcuuuuggguauaguuagcccauuuguuucucagagauuuuuuuauuugcaaaaaaagugcuugcaugccaucuaaauuuacuacuucuccuucucccaccuaggguaaaccaaaagagaugguacauucaaggaaucuaacaaacuuucccuuagcugaucucccugacccccacuuccuguccgucuuuguucacaaagcagccagggucauuuuucagagccucacuguugccuccucugcuuaccuuccuuggggggcccucaauggccaugggauaaagucccaucuucugaaacagcauguaagugugucuagcaucugaggcuguuccuauauuuccaguuacaugucuucucucacuguggacucugaauucaagucacucuaugguuuccaaaagucacagcgggcucacaucucugugccuuugcccaugcuuucccuuggaauugagugcuuuccacccaagaucagccuagcuugggugaagccuagauagaacaaaggauccaaacugaggaaguucucuagcaacuaggccucucaaaucccccucacuccuuucaaauagcagauguguccauuauuuugaagaaugagaagugcaagaguggguggaagaacccaucccugcauccgccucaaauguccugagcauccugucuguccugggugugggaauguagcaaugaauuagcccucagugaacuugcagcuagcagggaagaugagagcaguccaugaacucccaaaacaccaggcaggaacuaauaagaauauguacaaacagaaggcuccauagaaagcucagaggagggagaaacuauaugaagcuggaauaaucagaaaagacauuuuggagcauuugcccugugacuuuaaccuugaaaauaagaaauauuugaauaugcagagagggugggagaguuuugaugccagaguucagucugugcaaaggcaaggagguggaagauaagcugggcuuucagagaacagagagccucagcuuggcaagagcaagugggagcugaagaaagaaaagauagacuaaugggucagggucagacaauggaggaaccaaagguguuggcugacaacuaaccugcagauucccugcucccagccauccacagacucagaaagcuucuuuccugauucaaauuggauaagagguugcuuggcagugguaggaacccagagcuugaucaggaugcugcugguauaccuucaggccaccagcaagacagcaccaaugucuuagaguuguauuagaaccauuuuguguauuuugacuuucuacugaguuuauuaaaggcauguucccugaaaugggagauaagggucaacugcugauaagaacucauugaauugaaaagaaaaagucaggcuguaaucccaacacuuugggaggcugaggagggcagaugaugaggucaggaguucgagagcagccuggccaauauggugaaaccccaucucuacuaaaaauacaaaaaaguagccuggcgugguggcgcgcgccugcagucccagcuacucaggaggcugaggcagaagaaucgcuugaauccaggaaguggagguugcagugagcgaagauuaugccacugcacucuagccugggagacagagugagacucgucucaaaaaaaaaaaaaaaaaaaaaaaaaagaaagaaagaaagaaaaagaaaaagaaaaagaaaaagucagaggaauauaaagugaucaagugaucgugugugugugugugugugugugugugugugugcguguacucaccuucuugcagagaggucaaagagcuuuuccaacaucauuucuucuuuagggcucaaugcuuucuguggcuugguaaaggaggaaauauuugagcaguacaagauaaaucugaaugagaaugaagguaaccaaauaauuacuuuuauaucgaaguuuuccgugcaagacaguauuuaguugccuagagcugguccuugacuccugggcugauuggacucugauuagacuucuaccaccugguauauccagucaacaaacaucuucugggccccagcaaggcaucaggaacugugcuaugucuuaaaauaaggaguugaguggagacacaaagaaauaauggaaaugacccaucuucuugagaacugugcaucuaauggagugaauacauauguccagacacuuucaguucaauguauuaagggaccagaugaaaguaggcaguggaugcugugggagcccagaggggaaacaccucauccggccugagguaaggauguuggaaagggccagggaggguuaucuaaaggagcugacacaucaguacaauuagcaucuuccagugguugguccagcuuuaaaaucacagcaccucaaagcuggcuaucccugaggucaccgcaucugucaaacuuaauagucaucaccuguuuaauuaucugauguuccucucagcuucaaagaacaaagaugguuucuguuuugcuuauuauguguccccaucacauaacaguguccaacaccuaauaggcaccuuaaaaauauggguugugugucaagggauaaauauuagcacaugaauuuucaccuucuuuccaaguguuaaggggaauccuguuguaauauuuaaugacagccuacugcauucuuaacucugagccaagucuagaaggaaacaacaaaaucaagagaaacauaguagaauguuuggacacaagaaaacuuggacaucagcuguuucuauaacucauuucuaccauaaaaaacaaguucagaaaaguugccuuguaacuacuagcacaaggucauccagguaauuaguagcaagcaagucugaaauccaaguauccugaauuucaguccucaguuccuuccuuugagccauggguauuguaucaguuacagacaugugcagaggaagcacaaaggagucuggaaaggauguacuucuuuugcuggcauacagaguaugucugaauucuaaugcagccucaucuugcaaguaaggcuuuguuuaacagaauauuuuaugugauagaauuauguucuacaaaacccaaaauuuuaaaggauguuuucuuugcgcaucuguaauugcuucuggcgggugcgccuucuacuuuauaaaaaagauuccuuucccucuuucaucugucucagagaggcuccagagggaaauguaggaaacaaaugcuuguucaacccguaauguucccuugaaaagugaagcuugaaauccuguagggaucucuguguucuuucagaauugauuuugacacuguagaacuacauccuaacuagcuuucaugccaaaauauauugugacuagugauuggauagcuuaaaaacuauuaaaaaauauacuuuuucauaucaagagcgaaagauaaugacucauaucccauaacuugggaauuauucuuaaagaacauuuucuauuuuuuuaauggucauagauucaaacccaguaaagaacguuuucuaaaguagugauagaaauuguaagaaugaauuacuuggagggugugaaacacugucuuaauggaaaacauuaaaugacaaggaaaaaugcuucagguaaaaacaaaauaaauuuuuuuuguuauauuaucaauaauaaaaauucauaauuauuuuauaauuuuguuuguugguugguugguuuuguuuguuuguuuuguuuugagacagagucuugcucugucacccgggcuggagugcaguggugcaaucucagcucacugcaaccucugccucucagguucaaucgauucuccugucucagccuccugaguagcugggauuacaggcaugcaccaccaugccuggcuaauuuuuuguauuuuuaguaaaggcaggguuucaccauguuggccaggcuggucuugaacuccugaucucaaguaauccacccgccucagccccccaaacaaaguguugggauuacaggugugagccaccauguccggcaaaaacaaaacaagcaagcaaacaaacaaacaaaaaaucauaauguuuuacacugauuaagugcuuacccuguguugggcacuguuguaaacuacaggaaacaaugcaucuaaccuuuacaauaaccccauaaggaaggugcuuuaauauccucacauuccaaagugaggcacagaaaacuaauauaacuuguucaggaucauauucugggaaauguggaguuuacauucaagcauagguagccuagcucuggaaacaaugccuuuuuuuuucauuuaaaaauuuaaauaccgagguauuuaaaaguacacgaaguauacauauccugugggcaugucccuugaucccaaaauuucacuuacauaaauugacagagacacacacaaauauuucuguauaaaaauuuucaucaaaguauuuccaccaauaauggaaacuggagacaauccaaaugcugaacaguuagagcucuauuaaaugcucaacuuuaaaacgaaaaaaauaacauaaaguacaaggaaaaaauaaaaaucagucacaauuucuguauucagaaauaaccacaaggacauugcuguguauaucuuuccagcuguuuucuauuuuuuguuucugauacaaacuuggggucauacuguauauauuguuuuaugaccugacuuuucuauguagauaauguuauaaauaguuuucaagucuuuaguuuuucuuuuaccacuuauuuuaauagcuuuaugguauucuauuacuuguacaugucaugauuuauuuaacaaaccuuuaucauugaacccaugcucguuuagccauuaguucauggugccucaauugaugauaacccaucauucacaggaaguagcccagacucucuaacuuagaguucgagaccuuccaugaucugcccuuacuauuccaauuuaaucucuccguguuuuguuucccuaaccaugaauuauagccaaauaaaagcacuugcuccaacaguguaauuggacauuucuuacagcacccaugcaacucuucuuauugcaaauauuuaccuacugaucuagcuauacucuacuagauugaaaacuugcaagcagaauaucugccugaaucaauuuccuaacccaacauugaagaaucgugucuugcacuuaauauacgcucaaaaauuauuuauggaauaaaugaaggcaauguaauauuauuuuugauagugcaaaauuguaaaugauucaaauaucuaacaauagggggcaacuuaaauuaaugauaacaccuucauucugaaaaauuuugagcaauaauuaugaaaaauauaacaaauaaaaaaguuuguaaauaauguuaggugaaaagaagcagaacguguaauuaaauguauacuagaauuuuagcuauuuucaauaucuaagucugggggcaucaaaaaacagaagggagcuuuggaagagugugaggggagugauguuuaguuugaguaaacauaguggguaaauauuuuuucuuaauuucuucuaauauucuuuuaaaaagcuagugcauuaacaaacuacauauaccaauauauuuaugacuuugagauaauguuacuggagaacgggacauaaagaguaaguuuuuucuuaaguaagauguuucaaauguuuuuuauauuacuggaaguaguauaauuaucaaaaacaucuaaugaaguaaauaccagcauagccgccauuuuagaacauugaggcacagguuaugaaauagcuugcuuaaggccacacagcuaggaaaugucugaguuuggaccugagguccagucuguuggacuccuaagcucaugugauucaccaucauggaguaacaccaaauauauuaagauuggcuaggacccaacaagaaaaaaaucagcuuaucaauaaaaacaaaauaagaaccuacuuucaagagacuuaagguuuuguuuuugaaucaguaccuacauguaugaaauacuacugggaggaaaagugugauaauuucuucauagcacccucccucuuccaccuuucauuguccagugaauuucugcuuauucuguaauacucaaauguuuccuccuagaaaauaguuauccauaucccccuggcucaugcugguucuuagaguuuccuguuaaaacuuccacuauaauacuuaacauuaugcuauuguguucccuggagguaagcuucucuauguuagggaucaucuucagucucuauguuuuugugcccaccugguggcacaauggccagcacguaugcauuuacauuucuuuucagugaguucuuuuauuaccccuuuaccacaagcauucuuucgaaaaaccccaaaccccaaaauguggcauagcaauuuaucggugcuaaacaaauauguaaauacgauggcuauaauuaccuuacugcuccucagaagccuuucuuucuuaaacacaggcaaacacucugauuugucacauuucuagaacacuuaauugucacaauguccuugugccacauuugaacucaugacagcagggacaggaugcuuccuuccuaagauuuucuuuaccagggucuuuucugucuccugaaaucaccauaaaguggaauacagcauuuuguucaaauaccuucuccaggucagaugugcaaguccuguuucucugguauaaugauucucaauuuguuuucuuacaauuuugagaguacaaucccuuaccaaggucuccgucucucucccuuaucuuuuuccuauccccucuuccuugcuuccucuccuggaugaugugguccuucauuugucuucucuguaucaauuuucucuggugucuaccuuagagacugccuucugcugcuuauucaugccucaguauggucuuuagcugagucuccaaagcucuaauauuaauauccaggauuuuccaggauauggacaauuaagucuuuaugccuuuauuuaagaugucccaggaaagaaaaucuggcccauuuggggucaggugucuaucucugguaacuaagcugaugcuugcuuggagagggucgcaugggacauggcacuugaugaccucaaaaagcaggcuggaagugaccacuaaauugacagaacacuuacagcgcuuuuaaauucuuacuuccugcuccucuaguccuaucuaauauucuaaauguuucucacauccauucccauuuaccccucucuucccacugucuuggcccucauauauccuugcuuagauuacugugauagucucugacuugauuuccuugguucugaucucucccccuaagcuaauauacacuccacacaacagccuuugaaaaacauaaagugauaacaucauuucccuaauucaguauccucaaugaccucucaaugcuuacgaaauaagguucaaacucugugggaugaugcuauauaaauucuuuuaaaacuagauccuuuccuaccuccuucauccgucugcucacgauuuuuucacuuggucuuacuugugugaaugacugcuauucaugugugcacaauuuucucuucccuucucuucugggagcgucugcagcucuuuguaccacaguacauagaagaccggccaaaacacaguuggggcccaaggaaugguggcugcaugcaugaaacaugaaggacuauggggagaauacaggacucaucguuugagucuuuacaugguuguuauuauugucccaucuuagcaaguuugccugaauugugcucccugaauccccagggguucaaaaaaauugugaaaaacauaaugaaaaaacuauguuuaggcuuucuaguaguacaaagccucagccaaaacaucaacuuuuucuuugcuuuuuuuuuuuuuuuuuuuuuugagauggagucucacucugucacccaggcugaagugcgguggugccaucuccacucaccacaaucuccaccccccggguucaagugauucuccugccucagccuccuaaguaggugggauuacaggugccugcccccaugcccagcuaauuuuuguauuuuuaguagagaagggguuucgccauguuggccaggcuggaaguuuuucuaauuuugauggaaugaaaucaauuuaauguagcaacucuaccucaugcuaauuagaagccccaauugacagcuucaauuaaaaaaaaaaacaaacaaacuaggaaagaaugaaguugcuuaaaaauaguauuuucuucuuuuuagugaguacacagucuuuaacauuucaaaucuguugggauaaaaauaauugguacaaaaaacuggaaacugcccuaaaaaaucugagacuuaguuuagauaucuauaacauagaggauaauugaugucuuagguacuuuccagcucagacacuuacguccuaggaagagacuaaaauugucuugguucuuaucuuuauccuuuguuguaccacaaggauaaaguguccuaucucuuugucaauucccaauuccuaaaucagugauucgucuauauuaaaggcuaaagaaauauuuauuggcuaaauaacugaccaagcucuguacguguucugagaaaggagaaaaauaauuauaccugagaauauagaugaacaauuuagggaaugaugaugaguuagaccacaugacauuuacaaaagacaacgcugggggcacuuggaaacauacaguuggcaaauuaaauaacuguauugcuaugugggaauaaaguuagaaaggaacucaaggaaccaaguguucccuuaggaauggccauagagcagacagugaggacaaauggacagugauuuuuagaaagaagaaaaagagacauagacaauuaucucacacugaauuuaauucucccaccuuguuggucauaagucucuuucuuuaguucaugaaugaagaagcaaaaagaacaugaucuaugauaacugagaaucugacucaaaagauagaauuuauaaucaugaugaugaugcuuaucaacauuuuguaagcaucuacuauggacacuuuguguaauggaguaggacauaauggaaggugagaaaaugauagacuaagggaaacuaaaugagauugucaaguaaaggaccuuaccccaguacaaaucaaugaauauuaauccccucccuuucccuuuuagggucuaacagaccuauauuugaaugcaagugcaccaauuacugacuauaugaucuggacaaguuguucagccucucugagcuuagauuuauuaccuauaaaaugugacaaguaauacuuaguucacaauauuauugugaagauuaagugaaauauuauauacagaaguaauuuguaagcugcaaagcgcuaugcacaugggauucaaaauauuagcuauucauauuauuuaacaguuagauaaaguauauauaagccaccaugaauaugaguggauaauugccuagaggaggggcaagaagaagugugugacaagaacugaaugagugagauaagguaacagaaguaaugggagcuggaagcuggaucacagggggucuuguaggccaucgucuacaaacaacaacaacaaaaacaaaacaaaaaaaugaacaaaaaaacccuccuuugucuuuuacucugagugaaaagggaacucagggugauauuuugagcaggugaguggcauaaaauaauguauguuuuaagagauucacucuggaugcugugcuuagaauagacucuaggguguuaaggaagaaaggagaacaucaggugguuuuugcaguaauacaggcaaaagaugguggugccuugagccagaagagcaguggugugguuggugaggagcaguuggauucugauauuuuucugaaaauagagccaucagugcuuccugacaaauugaaugugggauaugagagaaagaaugacagcacagaugacuccuauuccugguuuggccugagcacaggauggaugagauuccuguccucugagaugggggagcugcugguuacacaguuuuaagagaggaccaucagggguucaguuuagggcauguuacguuugagaaguucaugaaguauccaaguggaccuaucaaguagugaguugaaauacuagucugggacuugggagaucgggcugggcagaagauguaacaucugggaguuguugacauguagauacaugguauuggaugugagggcgaucugacugcgacaucugucaccccauugaucgccagcauugauucggcuaaucuggcuggcuaagcuggugucccuuccuugcucacagcuccaagugcauuccucccaaagcugcacacuaggucgaagaggacgaccauucccugacagagaaggacuggucuucggucaaggguauaugauuagcugagcucuccugcuagaacauccagacaagcucucaagacccauuagauauaugguauuuaagaaaugcaacguagcugacaacuauuccaccacuggcuuuccuaagauuaauuucaccuuauuuuggccuaaguccaagaaguagagguuuucccuuccuuucuccucccucugcuucuuccaucucucuguccuaccccagugaguccuugcuucuguauagaaccauucaaucacaauugaacucucuugugcuuuucuaguuuauccgucugucucuacuuaguuuccccagugcaaugacugcacacuuuguugggauuuugcuucaagccacaagggaaacaauaaaacugagggauguaggaaaugaacucauggacuuggcuuugggagacugggucacacaccacugagaaaccagggacggaggauuuuugcacaacuauccacagaguuagguguuaaacaacaucacugccuucagaaaaaccaacaucauaagugcaaguuuauuuauucuguauguucucaggacuaaaugcuuguuauuuuuagagagaauacaggggaaccaggagaacugcuuuuugccuucaaguggugcacaugcuuugguaggaaaagucagugcuacucauaagaaaccguaagaaguauucaggagaaaaggaugggaaaauuaguggaugaagagguugcuaagaaaaaacuuacccucauuuagcuauuguguuucagauucaaugucacaucauuugcaaaauuuucauuguuuguccuuaaaaauaaucaauagaucccugagauaaaaaauaaucaauagauccaugagauccacaacacuucagagaauaaugacccuugucauauuacaaauaaaauguacuugauuacugggaaaauaguguaccuucuuugaaaagagagacagagagaaaauaaauauaaacacaaaaaagaaaaucuuauggcccgagaggaccaugagacucuuuuuuugauuguguuuucuauguauauauuuacuguacaaaaaaugagaucauaguguacuuguuuguagauucuuuucucauugguaauagagcugaagaauuuuccaugucacuaggcacuuuccuacuacauuguuuggguaucugcuuauuaucaauaucauagcuauauuauaauugugggauuguggcuuguuuccuuuuaugccuuuucagcaucaaggacaggaaguucuugcagucacagaauguuagagaacucaaaacucccuuagacaucaucuaguuaaccuucuguuuugcagaugggaaaguugcauuaaauggauuuacaggucagauggucagaaagcuacagaacaagaauacaaaccaaaugccuguauucugagccgaguguucuuuuacuauaacaucuggacucugagucagcccuacaucugggaaguacacaugcaguaaaagaagagggcauacuuuggcaggagaaguuuggggaggacaugacagcagaagucucuugugguucuuuuggaacuuucaguuuuacuucaaacccugugacccccgcaaguuucauagaggggcaaaguugcauugugugguguggcaagcagacaguuuuaggaaaggaacucauaagcucagguuugcaaaacccacagcuguacaaaaguucagcucuauccaacacucagaggggugcaaaaaccuucuaagagaguaccuggccaccuagagucucaauucugguuucacauuauaucugaagggcucccaucccucagcacugagcccugugaaaccuaaugacauuuugacuuugcugauugucagagaugauuuuaacuucggacgcuuacaagccacaguguucuggauguccuucaaucacucuccaugcccucuugcuguagaagaggagggucgugcuuggaacgcuucgaacaauccucaauagugaaaaaagagcagagaacgcugggaguuccagccugcuguggaaaugaggcaccacccuccaacucccuugucccagaccaaaccuggcuaugccacacugugcuuaauaccuuuccaugaccucaagauaaaguucacaucccucagca

SEQ ID NO: 17792 - RNA, 22221 nt, Homo sapiens
cagcggaaauucuagaauuggccggcaaugccgcgagggacaacaagaaggcccggauagccccgagacacaucuugcuggcaguugccaaugacgaggagcucaaccagguaugucugaagccuugagggaagccguagaauggguuugccaaacaugcuaaugugugggccuggcuggccaugagucacuccugcuacaguucccaauuacauuuauacaaaaaaaacucaggccauauaaaagaacaaauucugcuagcucuuaucauucagauucaaaauaaaauugccucuggcauagaucucauuauauauucuaggucuuaucagaccuuucuuuucucuuugaagacaaguucuguguguugcugaggaagguguggcacaaauguuauucucuucacuuucuucacccaaacuuaguugacaguuuuuucugaugaaggcagaagacucuuuauauuuuagaacugacuguuuauauucugaaacugacuccaaagucaagcgaauacccccuuuucaccuacaguauauguaaggugguagguaaauaguauaagaauuuuuauuucuguuucuuuucauuuaucuuuauuuucuaaucucacucuucucaaacuguagugaagaagccauuuuuauggccaauccaucauggacugauaauuuccagaaauguaauaaaaaucacuagaaaaauuaaaaagcaaacuacaagccauaauuuuuuguuaucagauucaacagauauacaauaacugucaguuugcugugaaaguuucuagaugcuugcuauacuucuguugucacugacggguaacuaccaguucaugggugagccauggucgcagaccaugcuugggguaguguugguuucgaaucugcagaauauauuaguggaguaguacgugucuguucuuugcagauaaauuaacuuauauugauugggaggagcauggccagacauacuuuacugauggaauguaugugcaagcuuguggagaccacugguucaucauuaacugggucuagucuuugcaaugaccuuugaacaucauuuucucaagcugcgcuccccacaugggaagcuuuuuauccuguguugugucuggaauuccagagcccugggcaacaucccugguuucaacuucugugucccuucuauuuugcuuuacuucguuuugcuuucuguacaacaucacaggaugccuuguuaaccuacggagaaaugcucuacaacugaaagugggaaaagccaauuaaaugguguauuacgcaguuucuuuaggaaagcggaggccacauuuaacaguuagaaccguauuaaguccaggccaggcacaguggcccacgccuguaaucccagcacuuugggaggccaaggcagguggaucaccugaggucagccguucgagaccagccuggccaacguggugaaacccugucucuacuaaaaauacaaaaauuagccggggugguggcaggugccuguaaucccagcugcucaggaggcugagguaagagaauugcuugaaccuggaggcggaggcugcagugagccaagaucgcgccacugcacuccagccugggugacagaguaagauucuguaucaaaaaaaaaaaaaaaaaagaacuguaugaaauugggaacuagcaggcuguuugcuacaugagcgcaugcauuucucucuucagcugcuaaaaggagugaccaucgccaguggaggcguccugcccagaauucaccccgaacugcuggccaaaaagcgagggaccaaaggcaagucggaaacgauccucuccccacccccagagaaaagaggcaggaaggccacgucaggcaagaagggggggaagaaauccaaggcugccaaaccacggacguccaaaaagguaggccgaggcugcguguccugggccaggcacucccacugcaauggucugaaugucuguguucccccacaauucauauguugaaaccuaaccccagaggcauaggauuacaaggugugggcuuugagagauaacuagaucaugagggcgaguccucacgaaugggaacaguccccuuauaaaagaggccugagggaggcagagggacccuucugccaugugaggacacagcuagaaagcgucaucuaccaggaagugagcccuugccagacacagaaccugccugcgccaaggacuuccugccuccggaacuaugagaaacaaguuucugggccaggcacaguggcucaugccuguaaucccaacacuuugggaggccgaggcaggaggauggcuugagccuaggaguuagaggcugcagugagccaugauggcaccacugcacucgagccucggugacagcgcaagacccugucucuuaaacaaacaaaaaaaaaagaaagugguuucuguuguuugugagccagccagucuauagcauuuuguuagagcagcccaggcagacacuaagacgcucacagaacaggagggaaguuuaaagaugagacaaugacuucguagcagacaccucugaaggaccgaggacucuugcagcuuggugccggaagaaaaugacaagaauguacagguaaaagaauaaagggccuuugagguuagagcugaaaugggucuucucuagguuuccaaacccuaagcagggaugguuuucagaucccuuuuacuacccccagcaaaaucugaagugagcgaugauagccaggaaccugcauuuuauuucucugcagagcucuguguugccuuccaaacagccucuagucuccugcaggcauucccugaguuccgccaguggaauuucagguguuuggcauauacuugauauacuagguguuuggguuagcuugauauacuagguagcuuagcucagagaugccacugauagaauaauguuuuccuauguugcccaguacaguaaccacuggucacauguggcuuuuuuuuuuuaagagacaggggucucacucugucacccaggcuggaguacaguaaugcaguggcgagaucauagcucacuguagccucaaacuccugggcucaagcgacccuccugccucagccucccaaagcauuggaauuauaagugugagcuaaggcacacaagccaaggcuauuuggauuugaauuaaaacuaaaucaaauuuaaaauucagcuccuugauuguaccagccacauuucaagcacucagcaacauuauugaggaucaagaugaauauuuccacgaucacagaaaguucuauuggacaacccuacuguagaaguuguggauguuucauuccacacugccucugugccccgagaaauccuggggagaaagaaggcuaagcaaugggcuaucaacggccccacccagcuccgaugcuugucgucgugagcugcaggcauugaaaugagcaaggacaaugugcuggugcacagggguaggugaggacugcagguaugugugagcccuuuaacacacuuucuauuuugcuauuuugcgguacccuuuucuuuccuuauauugcugacuuuugcuccccuccuucaagaaacagcagaacacaucaccuaaccacuuccuuucauauucaacuugguggcagccgugagaagagcuuaauaaaggcaccucaggcuuuuucuggauugguucucaucuugccuuuugauuuuuaccgacaguccaaaccaaaggacagcgauaaagaaggaacuucaaauuccaccucugaagaugggccaggggauggauucaccauucugucuucuaagagccuuguucugggacagaagguaacaaagagaauugccuugugcuauauuaaaacaccacuguauuuuuauaaccuacuguuuacaagcaaugaugccuccuuuccuccccugauaaugauuuucacugcagucuugaauuauucauuuuuaaacuaaagagcuguggcagugucagcauugugagagugagaauuguucuuuuuugcugagaauuguuaacgcuaacauuggucagacaagggugagcauggaagcucuuucuggucaguagauaggauggcauuacugguuuugcugggaauuccccacaccccaguuauuucuacaucugccaaaaaaaaaauccauagcuaacuuucucagacagcuucugagaggcccaucuuacaugguucaauguaauuuaucaaagaaagaaaauagaaauauauguuucccaaauauccuugguauuagaaaugaauuauuugccaauaauucagucugccugccuuccuaggcuuuagaaaguaaacaaacagggcuaugcauuugaacagucuucagcaacacaacagcagcccaaccagacaugcaaauaauucauuccuacaaguguaaaguuuacugagcagacaauuuaucuaccaagucaacuggggcugaaauaagacacccaaggaaagagucaguuaaucauaucucugguagcugaauguuuccaucuugacaacacaguaagccuccauucaaagaauugggaagaguauguucuaagaagagcaucgguguggcugguugcuaauucgucacugaugaaagcagggaaacaaagagguggaauuuauguccccucucuggccuguucacuguuacaugacgauuagcuuucucucacuuagcuaaggcaacauaaaggucuugcucacaugggccaacaauagagaaugcccuccauuccacucuacugugaacacauaggauagcaauucccaaugguagccccaagacuguggucuccaaagggcaagggagccagacacccccaggucagaaucccagagcccauuacuucucuccagcaagguuauuggcuucagagcccugccccacagauuuuguguucuucuagggagaaugcaggaugcugaggggagaagagagagcaagcccugggcuuccuugcaggagcuucucagaagaugcaucacugaaaacuaaggccaccaggguugggaaccaaaggcaugagcuguaagggaaagaaagaaaggagagggggccaggcgcgguggcucacgccuguaaucccagcacuuugggaggcagaggcggguggaucaagaggucgggagaucaagaucauccuggcuaacacgaugaaacuccgucucuacuaaaaauacaaaaaauuagcugggcaugguggcgggcgccuguagucccagcuacucaggaggcugaggcaggagaauggcgugaaccugggaggcagagcuugcagugagccgagaucacgccacugcacuccagccugggagacagagugagacuccgucucaaaaaaaaaaaaaaaaagagaggggaggcccuguuccuguuccagggaagaagaaauggauuuguugcaugcugccagccccagaguggaaagcaaauccacugagcucaaagagcuuauugcaagccaaacaccugggaaacuggagguugucacucucuaugcagccccuauguugacauuggguaugaauaauuaaagagaauuaaugaaugcaaguaaaauaugagauuuuucaacagaauuuuaucuuuuccacauucaccaccuuuucuuccuaaugcagcuguccuuaacccagagugacaucagccauauuggcuccaugagaguggagggcauuguccacccaaccacagccgaaauugaccucaaagaagauauagguaagguccugagacuucaguagaagugccauagaauaggccacuguucaggcaaguucuugugaagcugaucauugucaacuggcugucccuccgcuggggucccaugucaagcucugucuuuauguguaguugaacaguuucacuagagagaagcuaacuuuguuuuaauucugcauauauuuuugaaauuuuuauugggguauuguguaaaagcaaaucauuagcauagagcuugaugaauuuuucucaaagugaaccccacuuugcaaccagcaccaagauccugaagcagacccuuaccagcaccccagaagucucccucagccccacucccagucaguauuuccuccaaggguaaccacuguccuuucuuaucaaagcagagauggguuucaucugucuugaauuuuguaaaaaugaaaucuuguccucuucuggguccgacuccuuuugcucaacuuaguauugugaaaucuauccaugucguugaguaugcuuguauucauucauuuuccuugcucuguaguauuacacucuauaaauauaugacaguuuauugaucuauucuaccacugaugacauuugggguaguuuccaguuugagcuauagugaauagugcuacuauaaauauuguuguacauguuuacauauaucguaagcuuaaauauugagagugcuauugauaaaagggaaauggacaucuagaaaaaaauuagauuguccauuaagcuaugagcauugaguuauuuuugccugugguuugccaccugucccacgaguggcagagggagcuguuaauagccaggguggaggagcuugggaggguaagcuguuaugggcgcuggaaauaacagcaugcuaacaguccccaucccauccauuuuuaccaagcagaacugccuuaaacucuccacggaaaggguaaagugagcaaagaaggggcuuugucucuaggguacagggcuugccugugagggaggcaauuugagguagaugcuaguaguucagcccuggcugguagcaccaggggccccaggcagcuggacucacucagggcuuccuccuggcaucagaggccacuugcugugcugaaaaggagauaggacagcccugggaaaagucagcauuacagagaaacaggucuccuuccacucuccauggaaggacgcccucuaguagccuucaucuggagcucuuuuaauagguguccugccucucacugacacauugcaguguucauacuuuacacauuucuauaguaaugaaauuuuuauguaagaaaaauaauaugcuucuuuuuuuuaauuggcaugguggcagaguagaaagagcacuggucugggagcaaaaauucacgcucagaucccagcaguggauucuaaggccaaccgcuucagggucuugggaggagaaaugggcuaaaggcagucaggugguuaagagggcagguuccaggucggccugccuggacugucccagcuuuucugaauugcuuccuagcugaccuuuggcagguuucuaaaccucccugaaccuccguuuccuccucuguaagggaggauagcaauaguaccugucccauaggggugcugugauggggcuuagcacagugcugggcuccuaggcaguuaguaauugacagugguuuuauugcugcuguguuaggaggagucccucccauuacgauuccauuuuccaccaccaucacccaaacuaaucaucccagcagccaaggcccugucuuacucuuuucaaaacauuauguuauuaugggaaaagucaagcauacacaaaaaauaacagaaaaguauaaugaaacccuaugcaaucagaugcaauaaucaccacccauggccaccuuuguuucagcucuuacccccuccacauacuuccagacaucauuuuaucuaugaauauuucacaaugacuuguaacagauaagggcuguuuacuaacaacacagccacaauaccauuauuguacccuuaaaaagauagcaauaucaacaaauuaccaguguuccaauuccaguuacaucauaaaugucaaguuucuuaaacauuuguuuaagccaggcacaguggcacacuccuguagucccagcuacuugggaagcugaggcaggaggaucgcuugagcccaggaguuugagaccagccuggacaauauaagugggacccucaucucuuauaaaaaaggggggcccgaguacgguggcucacaccuguaaucccagcacuuugggaggcugaggugggcggaccacuugagcucagaaguuccagaccaaccugggcacauggcaaaaccccaucucuacaaaaaauacaaaaauuagccaggcuugguggcauaugccugugcucccagcuaaggugggaggcuggggugggaggaucacuuaagcccaggaguucuaggcugcagugaacugugaucauaccacuacacuccagccugggccacagagugcacagagugagaccaugucaagaaauuaagaaaggaaagaaagaaaaagagagagagagagggagggagggagggaaagaaaaagagagaaagagagaggcagagggagagagagagagaaaggaaggaagggaagguagagaaggaaggagggagggaaggagggggagggggagagagaaaggaagaaaggaaagaaagaaaauuuguuuauuugauuucggauccaaaucaguccacgcacugcaguugguugaugagucucuuauaccauagguuccuccuucaucucuuucuuauuucuuugcaauucauuuguugaggaagcugggccauuuguccuauaggguuucaugcaguccggauuuuguugauuauauccuccuggcaucauaaaacauguuucuuugcuuuuuuauaacuuggugguuggaucuagagguuucaugagguguagguucgaaaacuuugccaagacuccuuggucaguggcgagugcucgugcccgaggaggcgcgucgugccugguugucuguauuggugugaugcugguggccauugaugccucuucucuagauuccgccauucguuaggaguugcaaagcugugguauucucauucuagcauugcuccuuuccuucuugggaaugcuucuguagagagaaacuaccucucuccaggaugcuuuuuucuuaaaaggcuucagugaggaggguggauuccccuugccuucugcacauucccauuuggcccuugaccugaaugcagagggcgccaguguagaccuaguccucugcuucucaacaugaacuggcuaccagcuucaguuacccggccuucuccaggcuucuggacccaauagaucaacaguguccaggaaucugggggccagaaaggagucucagggguacuggguauaaugcacaaucaccauuucucaguugcaucauggaaacccaagaacauuaacaaagaaaaccccucugcacgcccucccccaguggacagugaccacuggaauagacacuuguccuaaaccagcugcacaguguacuguggcuguccacauauacuugaggcucgaguguggaguggggaagcaucagcacccaggcccugggaaagaccaugaacugaaccauaauaauaaugaugauucauaaagagauugcugagacuugcugcagacauccagaucaccaaguucauucgaagaugaaaacaucugaaaaaugccuccucugcugccccaaagcugccgucaucccagucuggacaaaacacccaugucaucucagagacaugagagcuggaugcgcuggugcacaccgacaggguuccuguggggucagaggugguguccugucaucucccagggguuccacuuggccuguguagaaguaagagcugagguaggaaaaaaaagaaagaguggggcauuccccuaacaucaaaggcucagggcaucucccggcaggaaaguccuuagagauuagccucucugcauuucuccauugcaaacugagcaccggguugggggaacaacaugccaggcugcccugggccucugucuguccuuugacucaagcacguacaguacguugauggcacugugaugggaccaggacuucagagcucuccacaugaguacuaaaccugugggacacaacacuagaaucacaguuuuuuguuguuuuguuuuuaaaucaucuacaagacucaagccaugagaccgcuuuauggccaaaucaccccuuaaaauauccuugguaaaagcuugccaaucuaagucugcuagacugaggcccagaguccccugccuccccugaccacuggcaaaccaggauaacaauugggaaguucaauuccuaguuucuaacagugcuuuuguuuucuccuggccuacuacaaauaugucaaacaguguaauuagauugaaagaacaaccacaguggcuucccauugcucuccuuugcagguaaagccuuggaaaaggcugggggaaaagaguucuuggaaacgguaaaggagcuucgcaaaucccaaggcccuuuggaagucgccgaagguaaguguggaacuaggcuccugucaccagcauggccucacccuccucucuggagucuccagccucacgugccucaugccuauucagcuuaugagucaaaguaugccauaacuaaucagaaagcuguuuuagcaucucagguaauuugggcaggcccauagagauccuuucagauguccuggggacuccaauauguuugaauaauucaagucaguuugcaucagaucccccaaaauggucuagagccauugggugaacuuugcaugugugugauaaaauacacacaccauaggacuuaccacuggaacuauguuuuguucuuuuuuuuuuuuuuuuugagaaagagucucacucugucgcccaggcuggaguguaguggcaugaucucagcucacugcaaccucugccucccaaguucaaacgauucuugugccuuagccucccgaguugcuggaauuacaggcgcaugccaccaugccuggcuaguguuuguauuuuuaguagagaugggguuuugccauguuggccaggcuggucucaaaguccuaaccucaagugauccacccgccuuggccucccaaagugcugggauuacagacaugagccaccacacccggccacuggaacuauuuuaaagcguauaauucaguggcauuaaguacuuuuacagugucgugcagccaucaccaccaccuaguccagagcuuugauaucaccucacacagaaacccuguuggguugaucggacucaacaccaggucaugggggugacaaaguccagcggagucaaaggaaugagaaaagauaguuugagagagaaaguggguccagggggcugucacuaauguguggcgguugugaaggccccgagcucuggaagcccaggcuauuuauuggugaucaaacaaagaaacaggugaugaggaugugggggucgaaagggcaagcgcaugaucuacagcugugacaguuuagcauuuccuuugaagcauuuggaacauauucugcuacuugagauaauggagagcagguucuuuuaacucaagauacaaucgauccugggagagcaaggagcaagaagccagcaagucuagacacauucagagccacgagcccuggauucuauccaagccacgagggguuuuaugcccugggcuuagauuauggugugucaggguggccuuccacccuuuggcacagagcuugguguuccaaaggccacaaggcguuuucgaaucuggaccccggacauguuccaagacucuuuuacauuacgucagacaugcaagcccugccucagcuucucucaacacuuagcuuuucccccaacaaacccccuaaccauuaagcagucaugcccagugccccccucaggcccuggcaagcacuaaucuacuuucugucucuacggauuugccuauucuggacauuucauauaaaugggaucaugcaauauaugacuuuucugucuggcuucucucacuuaacauuuuuuucaaaguucauccauacuguagcaugggucaguacuuauuccuuuucauggcugaauaauauuccauuuuguuuaaccguucauuuacugauggacauuugggcuguuuccgccuuuggugauugugaauagagcugcagugaacaucugugcacaaguuuuuuuuaaacaucucuuguccaggauauugggcaacuuuuugacagguggauucaaccucagauccauguucccacccacaugacucccaaucaguucacuccuuguacccucagucagugccaagugccgcagggcuucagaggaaaauaaaacccaccgcugcccucagaugcauaauuggggcacagagcaggagccacgaccucagcguaggggagcgugggaggacugcagugaggcugugagaccccuugggggugggacacagagggcaauaggagcacugcaugcaagaagacgcuugucuugcaugagcagggagucuugggucagcacgugggaggagagaaacagcagccaagaugagucugggccugugggcugugcgaaggggucuggaucugacccuacauggacaugagggcacuuggaaguuuaagcagggggcuguccagauuagacuugauuguuauaaaaguagggcccagguacuguggcucaugcguguaaucccagcacuuugggaggcugaggcaggcggaucacgaggacaggaguucaagaccgguuugaccaacauggugaaaccccgucucuacuaaaaauacaaaaauuagccaggcaugguggcgcaugccuguaaucccaagcuacucagaggcugaagcaggagaaucacuugaaccugggaaguggagguugcagugagccaagaucgugccacugcacuccagccugggcaacagagaaagauucugucucaaaaaaaaaagaaaaaagaagaaaagaaaaaaguaaugggggcuucuaguccagaaagaacaagagcccacacuuuaaaucuccacccacuacuccccacaggcaaagcaguaauagaugcagugucucuuuaaaaacccuaagagccacacucaaauauaagauaagccuccauguagacagagacaggagggcugcagcagcaccugcaggaugcugccgccccaggccucggcuccaggucuauaagaugcagagucgcuucacuuuguaucagaguauaaagagggccagagccagacucacugcccaaagcaaggggcugcaugagacucucgcggccuuuacaagaagccaaagcucucgccaccacccagggcuacaacuucuauaaaaaucugucuuucuaggguagcagaagggagaagagagccccucacccaagcccagggccacauugcccaccgacucaauguuuggcucuaccacauccccgauauaaccaugagaccaagccccaacucagucaucuaagacggcaucaggacugggggccuggguguggggaagguuccccagaaacugccugauagggugcaaaggagaggaaaaauagcugcucugcacagaaugagaagcuccaacacacuucuuuuuuaaauuauuuuuuaaauagagauggguucuugcuguguugcccaggcugaucuugaacugcugggcuuaagugauccuccugccucagccucccaaaaugcuaggauuacaggugggagccaccgugcccagcaccaacacacuucuaaacagaguuccaaaggcagaaauagaaaguagaaaagcauuauuuaaggagaucguagcugagaauuuucuaggaugaagcaugagcccuuaagcugaaaauaucaagcaaaauacaugaaaauaaauccaaaaccuggaguguugugguaaagccuuagaaauugaaaaaucaaaagaaaccuucaaaguaacccgagaggagaggcagaucauuuguaaagaaaugauggcucuucuacugacagcagacuucucaucagcaaaaaaaaagauguguggaaacaggaaagaaauaccuucaaagcacugaagggaaaaaaaaaacugucaaccaagaauuccacauuuugcuacguugucauucaagaaugaggacaaaagauguacaauuucagacgugcagaaguugagaggcagcaauccagacacuagcuggaaagaauacaaaagucugcaccaaggaaauagacaugaaccuggaaggaaggagagggcuacaggacacaauuuugagcuaagacauuggugcaaauauguuagguguaagaagccauggccuggggccagugaguguuagcacccugggaaaaauggagaaggggagaugguucgccacugucuaacaccacacugcauuucauuuaaaaacaccaucaguuguuaagauauacucuuauuguauguaacauuaagaaaaaauaaauuuccaaaauaaagugucuaauaggaggccccacauaaagcuggggcacauuaguauaacagcaagcaagacaugaacccaccacgcagaaaggaggagcaaauaucuugaccuuggcauccaguggacagagaggaaaaaaaaaaaaaaagccucacuaaagaauuuggccaggcaugguggcucacgccuguaaucgaagcacuuugagaggcagaggcggguggcucaccugaggucgggaguuugagaccagccugaccaacauggagaaacccugucuaguaaaaauacaaaaauuagcugggcgugguggugggugccuguaaucccagcuacuugggaggcugaggcaggagaaucacuugaacccagaaggcagagguugcagugagccgagaucacgcuauugcacuccagccuggguggcaagagugaaacucugugucuaaaaaacagaaaaagaauuugaaccgcaagccagugcuccugaagauuugcagccagauccagugcagcucaaaaccugaggcagagaagagagugagacauagccuuaguuugguaguguccccaggugacauagaaggaaauguaauuucuuucuggaagaacucagcuccaggcugacagcaguucuaagaugcuuccugauuucaacaauauuaaaauauuuaaacaaaaaaaaagugcaucuuaacaugguuaaaacagaccaacugcagugcaggcccacccuguggcagggggucggggaggguggaucaagaaaauauuucaggugcagagucagugagaggcagcgaugcugcauguucagggaggcagaagcuggagcuaagguaaguccaggguuuccagggcugagcaaacugaugaaaagucaggacuuucauucauuuguugaauauuggagcaccugccugccagugacuguggcaggagccaggcagcagcaaggaauacaaaagugcuucagugaagaugucagcuggggcagaaccaguucacguuaagcaucuacggugugugcugucgggcgcaggcaucaggauguggaugugauuguaggcccugaacacuccugaauuuuacaaccaggcggggaccccaggguaacacaguacaucacuuagcacagcuggcugcugaauugcauggcagaggcccggagagaaugggcgagggagucagggacaaaggaggauagccaaguguggagacagaggugcagccagacccaugugugcaggggacugagcccacuggcuggaggacgacugggcauccagaaagagcaagaaauggauagacuccaaggggagaggggccgaccaugaagggagccugggaggacugcaguaaggccagggggcaaucaggagcaguugcagauucugaguuuaaauguggaguuuaaggaccuuggcuccagcaaccguguggaggaugguuuggcagacagagggcuggggcccgaagaccaucaagaaagcuguauuggaugaggguggggguggagugggggugaaaaugaagcacaugggccugaaaugagacaaggcagaggaaacugauggugucugcagugacaaagagggaaaaaggggaaucggguuucaggagugaauggccauuuuacugggcacguguuagcccuggggccccagaaaggucaugaggugcaggucccuguugaaagcuaaggaggaaaauggcuugcagauggcugcuuaggagguggggcugcagcagagagaagagcacugggcccagacacgcaggaagaagagaggccauugugggaaacugaggugcuguuaaaagaaaacccacagugucacggaaaccaggcaucagcaguagcagccucucagcaggacaaggggccaaccuagaguccccuuuugcuguggugacucccaagaacugugauggcucaccugggggaagguucuagaagcucccagcagcagcacugccacccucagaaugcaggucuucaccaggcaacaucacauuagguaagagaaugccccuagucauuauguggauaggugcuuauaccaaauaccagggucacagcccuugcaauaacuugacccucauccuugacaacucuggagaacauuacaaagcauuauggcuacaagcuguguuauucauuuccaguugccaugaacauacuuuguuuuggacugaaaugucaucgugcacuacccugaaagucauuuuuuacuugauuggauguuugacauugccaauaggaacauauuccuuuuauuuaaaaaugacuuuuggcugggugcaguauaauccuagcacuuugggaggccgagguggguggaucacuugaggucaggaguucaagaccaaccuggccaacauggugaaaccccaucucuacuaaaaauacaaaaaauuagccgggcaugguggcgggugccuguaaucccagccacuugggaagcugaggcaggagaaucgaaucgcuugaacccgagaggcagagguugcagugagcugugaucgagccacugcacuccagccugggcaacagaggggcauccugucucaaaaaaaaaaaaaaaaaaaagacuuuacauuagaggaauaccauucugcuaguaacaugauuauacuuuuaaaauauaugaaauaaaucagccaugacuguaacaagccaaacucuguccggcauacaauagcagccaggugcucgggaagauggcaccaugcaggcaaggcccaucuccaggguccuugguucucagcagagcagccuccaguuuuaggggcaucauuguucaguccaaagagggacacucugcuucuggugcacaaauauacguggucguagagucagcacgcauggcgggccccuacccagggccucgguguauuguguggccuggguccugcacucaggcguucacgugugaugacacugagccccgucuaggcacuggaaggcagggagccuacagccuccccugauggacgaaggggucccuuggauuuggcuucuacccaugugaggaagugcagucagcacuucccugacacuguggacauugccaggaaauacuuauauaaacuaggugggcaucauagauuuccagucagucuuucaccucaaccccacacacagcucuggaauacggcggacacacguuucuguuacaagugcugccccuaguggccacggacccuugcuacgccgauuccuggguuccuggaggggcacagggcgcagacgggcagcgugggggcaagcauggcucauggcugaagcugcagcugccucaggcagauccgagggaacugcuccccuggggagucccacagggacuucccucgagcuuagcagccacggggcuuuaucaacucugucaccaaugggaaccacauuuaggggaguaaacaguaaaacaaaggaguaugacagaaauugugagacaaggcuggccuaauucaguuucacagcccgcuuuugaaaccccacucucugcagggcauguggagaucaucaaauggcagucccugucaaggaacuacacaaucaaguucagugguucucaacucauagaagguccuaaaaucacauaagcauaagccccugcaccagaccuacugagucaggaccucuggguggucaguacccugacucuguggggcccaggcacagcuauuuuuuaaaagccacaguaggccaggugugauggcucacgccuguaaucccagcacuuugggugccugaggcaagaggaucacuugagcccuggaguucaagaccagucugggcaacauagcaaaaccucaucucuauaaaaaaauuuuaaaaauuagcacaugccuguaaucccagcuacucgagaggcugaggcacuagaaucacuugaacccaggagguggagguugcagcgagcugagaucgcaccacugcacuccagccugggcgacagaaaaagacucugucucaaaaaaaaacuaaaaauaaaaaaauaaaaauaaaagccacuguauucauuuccuguggcuacuguaacaaauuaccacaaaguucguggcuucagacaacacaaauuugucuucuuacaguucuggaggccagaaguccacaaugaguuuuaagagucuaagauccagguguuggcagggcugguuccuucuggaggcucagggaaggaucccuuccuugccuuuuccagcuucuaagcugcaacauuccuuggcuccuggcugcaucguuccaaucucugucuccuucaucccacggccuucuccugccuuugaccuucuugccucccucuuaucaggucccaggcucacccagacaguccaggaucaucuccccaucucaagagccuucacuuaaucacaucugcaaaguccuuuuugccauguacgggaacacccacagguuucagggaggaggacguggauguuuugggaugccauuacuuuaccugccacagccaccagagaggaucugaugugucccuuuaacuaggaaccauugugaggagguagcccaacccagggacuacuuggcagaccauaugaaaauggcgcaucagagcagcauuaaacgcuucuacccaaagcuugugcuaacugugcaaagcaauacagcccagcucuugcucucguuaaacauaguccacaucaggagcacaggaugcugcccagccaacgucucuaucacugccuuaucuccagaucuaacagguaccugaugagguuaggcuauaaccuaggaaaccuuaggaaauaacccgcggcauuuucucuccuaugucccagccgccgucagccaauccaguggacucgcagccaaauuugucauccacugucacaucccucaguggggcuccgacaaaugugaagaacagcuugaagagaccaucaaaaacugccugucagcggcggaggacaagaagcuaaaguccgucgcguucccgccuuuccccagcggcagguaagaugcaguuccccugaguugauuccuccggcuuuuucccuggaaaucagcugcucccccacuuacaucugaucuggguguugccaagggcugccagcacagccaaguaugcugaccagaugacagggcaggaaacccgguuuucauccuucagaaaccauggggaagcgagcccacuggcuccuaggcagcaggucuuccccggcuggggccagccccagugccuccuugauguuaaagccccaggaggaaggcuagcccaggggaggagcgggaggcagaggccagcugguguguuauuuuuugagagccuuccagguucaaaguccauauucccaccagcuguccauguccaggacacaugaucagaaaacgccaggcucgaaggccuugcuacucaaagugugguccauaggcagcagugaccgaugucagaaugcagaaucucaggccccccaucuccgaccucuggcuccagaauccccagagaauuccguugcugcucugggagacugcagagccaggaguucgaggcuuugaugaauacacccagagaagugaaaaucuguccccgagugauugcugaaaaggagacugggcaaugacuggauugucacagaucccagcugggcauuguuucagauacauaaugaggauaucugcugucacauaaaacauauccuuucccuucaugccccuagccaaucuauugcuuuaauuuugaacacccucucaccuugagagcuguccuuuauaauauagcuaugguuuauagcuguguccugggaagcccaagaggaaaauaaugagaccuagguuccugcuguaaucacacaucaaccuaggcaagcagcauugagucucagcauuccaggcccagagaugcugugagaugcauucuuucgucgguggaaccacggcagugcuguucugugcuggaauacaugcgauugggaagaauuccuauuaacaggccccuccuggaccugcuccaggggucucuguggcugaccccuaacgaccauucuggcugugucccuggaagcuggugcuguggcccagccugguggauggcacuaucaguagcucccuggaaccuggggccuuuaacaaacuuucauuaaccccgccaugcccggagucacaaugcugaaauuacaugggccugugccuaugaaauauuaagugcauaaaaaaggacuuacgaagacagguuuggagcauacauuuuugcccuuuacuaagcaauuggguuaguauauaaaccaguuuggagggagcuaauaaaacuucuguuugcuuguuugaagaccagguauuuuuaaugcugaauggcuagcauuuuuaaagccaagcuugacuuggucaggugacauagaaucaaauauagggagcuggcacgguggcucacgccuguaaauccaaaagcuuuaggaggcugaggcaggaggaucauuugaggccaggaguucgagaccagccugggcaacauaacaagacccaucucuacaaaaaauuuaaaaaaaaaaauuuuuuuauaggcacacgccuuuagucccagcuacugaggaggcugaggcagaagacagauagcuugagcccagagguuugaagcugcagugagcuaugaucacaccacugcacucuagccugagugauggagcaagacuuugccucugaaaaaaaaacuaauuuaaaaaaaguauaauaaaaaauaaaauacagggcacucuucacuuggccagcccugugaccuugacuaaaaucauugugcuuggcagggcacgguggcucacaccuguaaucccagcacuuugggaggccgaggcaggcggaucaccugaggucaggaguucaagaccagccuagccaacauggugaaaccccgucucuacuaaaaauacaaaaauuagccaggcaugauggugcgcacuuguagucccagcugcuugggaugcugaggcaggagaaucgcuugaacccgggagguggagguugcagugagcugagaucgcgccacugcacuccagccugggcaacagagagagacuccaucccaaaacaaauaaauuaauuuaaucaaauuaaaucauugugccucuccgagucagugugacaccuauaaagugggggcaacaugccccaccugccacccccaggcugucccuuuggcuagggucaaaggagaucaugcauggacuagcccugcacacagcaaggccccacccaguaaaaacaaaggcacuucaugcucccaugggucccagggaccaaaaugacaucggcucuucuuuugcuuuggcacagaaacugcuuucccaaacagacugcggcccaggugacccucaaagccaucucagcccacuuugaugacucgagcgcguccucgcugaagaacguguacuuccugcucuucgacagcgagagcaucggcaucuacgugcaggagauggccaagcucgacgccaaguagccgccgcacuuuccagcagggaucggaggacgacccgagucccaagagugggguuuugcuuuuuaaaaggagagaggaggggugauggcaggggaguggaggguggccgggcagguccugccggcgcagggagcccucugcccuucacacucuccuccaaaagagccuccaucuguaaggaagcaggucuccgcgagggguuucuuuccauguguuuuccuccuguuguuuuagaacuuuuuuaaaaaaacagaccucguuuuagauuuauagcauugacuuuuacacacauucacacaagaaaaaaauccuuucaaaauucuuaaaucuucuguuccuccuuuuuccaagggaagagggcaaaaaguggccugggcucuguuggugugcguguuccguggcggagagaagaaaaugggaaagacaucucacuggugcuuuucucuuuuguuuuagugccccccgcccccaucccuauaauaucuguaacuacuccuaaaaagguuuugauucaggcuuuuuuuugguuucauuuuguuuuuuuaagaaaaagaaaaugaaaggaaaaaaauaaaagauccagugucuuucuua

SEQ ID NO: 17793 - RNA, 3778 nt, Homo sapiens
ccucuguuuccugcaggucccaguagggauggcacaaucagcgaggacaccauccgagccucucucaucucugcggucagugacaaacugagauggcggaugaaggaggaaauggaucgugcccaggcagagcucaaugccuugaaacgaacagaagaagaccugaaaaagggucaccagaaacuggaagagaugguuacccguuuagaucaagaaguaguaagugacucauuaaagacuuaaaauuuuuggauugaauuguagccauggcagaguguucuauauguucccuggauguugugggcauaguaggaguucagaaaauuauaggcaucuuuaaacauuugaauguaauuuuuuauaccuuuguuuacaguggagccuauguuuggcauuuggucuuagauugggagggguauaauauuuagaccauuuuguuugcaccuuguauuaguucguuuucacacugcugauaaagacauauccgagacuugagagaaaaagagguuuaauuggacuuacaguuccacauggcuggggagaccucagaaucauggugggaggcaaaaggcacuccuuuuuuuuuuuuuuuuuuuugagaguuucacucuugcgcucaggcuggagugaaguggugcaaucuuggcucacugcaaccuccacccuccagguucaagcgauucuccugacucagccuccugaguagcugggauuacaggugccugccaccaugcuuggcuaauuuuuguauuuuuuaguagagacgggguaucaccauguuggccaggcucgucccgaacuccugaucucaggugauccacccaccuuggccucccaaaguguugggauuacaggagugagccacugugcccagccaaaaggcacuucuuacauggugguggcaagaggaaaugaggaggaagcaaaagcuggaaccccugauaaacccaucagaucuugugagacuuacuaucacgagaauagaaagaccggcucccaugauucaauuaccaccccugcgugccaucccuccccacccccugcuacacacacacacacacgcacacaggucccuuucugugagauacaauucaaguugagauuuggguggggacacagccaaaccuuaucacaccuuugcccuaggaaauguuuuaggcaaaggauguuuuaacccaaaggaggacuguuugagugcuugauguugccaguuacuaggaaauaaguuuagagaguucuaagccaugauaaagaucugcacaucuuaggagcagacuuaaaaggacaguacuauuuuauuguuuccaaagguugugugagccauuuuuuaaaaguauguucagggaacuuucucaauaauccagagauacuugguuggcuaaagagcuacauauaaacauagcauaugcaaccuucagcucuuuaagcuuucucauaacagacagcuaugccuuggacaguccguguguaagucagcccuauggcuuugcuuaaugaugauaaaguggaagcaucagcauaauugaagugccaauuucacgcuccauuuucauccccaugagggagaauuuauuccaguaaauguguguuuuugauggaauaguaaagaauucuuagaagguugagggcuuuguggaaagugauuuguauguacccauuagccuuacaaagugguucuagauuguaaaaugagccucgaaguagccaauuuuuagaauucaggaaagugacaccaauacaacucagagccuacaaccagcaccugcgugugauacuuugugauuagaaugcagacauuugggccucuaugcauugaauccucuucauagacugaggaaaguuacucuccuauggcaggugcccauuuguugggaagaaaaaccucuuaugauuuucuauguaaaggaaccuucugcuggaaaguaucuugucugauggcuuaguuugcaguaucauuugucgcugacaggugacaagcuuguuacugucacugaaagugcugucaccucaggauaucuccaucauuacucuauuucacucagcauaguagaucacaucuuuuccucuaccuuugaccaggguguuauuugaaacauuauucucauccaugaguuguuuaaacaugguuguuagccugucuuuuccugugaaguguuguaggugucugacaaguggauaauuauguacaguuauuaaugcuuggacuguucuguuuucaggccgagguugauaaaaacauagaacuuuugaaaaagaaggaugaagaacucaguucugcucuggaaaaaauggaaaaucagucugaaaacaaugauaucgaugaaguuaucauucccacagcucccuuauacaaacagauccugaaucuguaugcagaagaaaacgcuauugaagacacuaucuuuuacuugggagaagccuugagaaggggcgugauagaccuggaugucuuccugaagguauuucuucauuuuacguuccaagauuuuuuaacuuggguuguagaggcacugaccuugcaaaccacaaaccaagagaguuucuuuguaguauggauuaagauucuuuaucuucccaaaaaacacuaaaugagauguaggguuuugcaccaucuuuuuaccuacagaguacugaggauuggucugagcaggggaagagaagugggcugguggcugcaguucucugcccacaggcagcauuaagaugaguguaacucuucugugccuggguggaucaggagguacgaucagauuuccauugguucuuugaggucauaccaccuaaauugagaucacugauugugccaccuccauuuuuuaucuguuaauuuucuuagaguuauauaacuuuagaccaguuuucccacaucaaaguaucaggcugcccuuucaagcccucuuguaugaaaguugucucaagcuuaaugcuguuguacagaggaaaaucuaguaagcgaaguuuggcuacugcugucucuugggucauggagaacaugguuuuagggauaauagcagccacccuugggauaucugauccagcuguagcuggagccuggucaggucaugugcugaucuugccuaucuccucucacugugggggaauggccaaaccaugugccucagaagugguacaaccacaugaauggcuggauauaaaccagagacccaagagaggacucuuuuucuguacaaucucuugcuugaguggcauggcuuaggaaaagaaaguguaggucaaacuccugagccagauccugcaauguaaugcuuucccuguugaguaagccuuuauaauaugcagcuuaaaagccacauauaaugagguauucauuccaaagguuggcaggucaugaguuaggguucuuagaucccaucuagguuacaaauugucuauuuuaugccugggccuaaaucaaagccauucuaaacuauucaaacuuuucuccccucccagcauguacgucuucugucccguaaacaguuccagcugagggcacuaaugcaaaaagcaagaaagacugccggucucagugaccucuacugacuucucugauaccagcuggagguugagcucuucuuaaaguauucuucucuuccuuuuaucaguaggugcccagaauaaguuauugcaguuuaucauucaaguguaaaauauuuugaaucaauaauauauuuucuguuuucuuuugguaaagacuggcuuuuauuaaugcacuuucuauccucuguaaacuuuuugugcugaauguugggacugcuaaauaaaauuuguugcauaa

SEQ ID NO: 17794 - RNA, 3778 nt, Homo sapiens
uuaugcaacaaauuuuauuuagcagucccaacauucagcacaaaaaguuuacagaggauagaaagugcauuaauaaaagccagucuuuaccaaaagaaaacagaaaauauauuauugauucaaaauauuuuacacuugaaugauaaacugcaauaacuuauucugggcaccuacugauaaaaggaagagaagaauacuuuaagaagagcucaaccuccagcugguaucagagaagucaguagaggucacugagaccggcagucuuucuugcuuuuugcauuagugcccucagcuggaacuguuuacgggacagaagacguacaugcugggaggggagaaaaguuugaauaguuuagaauggcuuugauuuaggcccaggcauaaaauagacaauuuguaaccuagaugggaucuaagaacccuaacucaugaccugccaaccuuuggaaugaauaccucauuauauguggcuuuuaagcugcauauuauaaaggcuuacucaacagggaaagcauuacauugcaggaucuggcucaggaguuugaccuacacuuucuuuuccuaagccaugccacucaagcaagagauuguacagaaaaagaguccucucuugggucucugguuuauauccagccauucaugugguuguaccacuucugaggcacaugguuuggccauucccccacagugagaggagauaggcaagaucagcacaugaccugaccaggcuccagcuacagcuggaucagauaucccaaggguggcugcuauuaucccuaaaaccauguucuccaugacccaagagacagcaguagccaaacuucgcuuacuagauuuuccucuguacaacagcauuaagcuugagacaacuuucauacaagagggcuugaaagggcagccugauacuuugaugugggaaaacuggucuaaaguuauauaacucuaagaaaauuaacagauaaaaaauggagguggcacaaucagugaucucaauuuaggugguaugaccucaaagaaccaauggaaaucugaucguaccuccugauccacccaggcacagaagaguuacacucaucuuaaugcugccugugggcagagaacugcagccaccagcccacuucucuuccccugcucagaccaauccucaguacucuguagguaaaaagauggugcaaaacccuacaucucauuuaguguuuuuugggaagauaaagaaucuuaauccauacuacaaagaaacucucuugguuugugguuugcaaggucagugccucuacaacccaaguuaaaaaaucuuggaacguaaaaugaagaaauaccuucaggaagacauccaggucuaucacgccccuucucaaggcuucucccaaguaaaagauagugucuucaauagcguuuucuucugcauacagauucaggaucuguuuguauaagggagcugugggaaugauaacuucaucgauaucauuguuuucagacugauuuuccauuuuuuccagagcagaacugaguucuucauccuucuuuuucaaaaguucuauguuuuuaucaaccucggccugaaaacagaacaguccaagcauuaauaacuguacauaauuauccacuugucagacaccuacaacacuucacaggaaaagacaggcuaacaaccauguuuaaacaacucauggaugagaauaauguuucaaauaacacccuggucaaagguagaggaaaagaugugaucuacuaugcugagugaaauagaguaaugauggagauauccugaggugacagcacuuucagugacaguaacaagcuugucaccugucagcgacaaaugauacugcaaacuaagccaucagacaagauacuuuccagcagaagguuccuuuacauagaaaaucauaagagguuuuucuucccaacaaaugggcaccugccauaggagaguaacuuuccucagucuaugaagaggauucaaugcauagaggcccaaaugucugcauucuaaucacaaaguaucacacgcaggugcugguuguaggcucugaguuguauuggugucacuuuccugaauucuaaaaauuggcuacuucgaggcucauuuuacaaucuagaaccacuuuguaaggcuaauggguacauacaaaucacuuuccacaaagcccucaaccuucuaagaauucuuuacuauuccaucaaaaacacacauuuacuggaauaaauucucccucauggggaugaaaauggagcgugaaauuggcacuucaauuaugcugaugcuuccacuuuaucaucauuaagcaaagccauagggcugacuuacacacggacuguccaaggcauagcugucuguuaugagaaagcuuaaagagcugaagguugcauaugcuauguuuauauguagcucuuuagccaaccaaguaucucuggauuauugagaaaguucccugaacauacuuuuaaaaaauggcucacacaaccuuuggaaacaauaaaauaguacuguccuuuuaagucugcuccuaagaugugcagaucuuuaucauggcuuagaacucucuaaacuuauuuccuaguaacuggcaacaucaagcacucaaacaguccuccuuuggguuaaaacauccuuugccuaaaacauuuccuagggcaaaggugugauaagguuuggcuguguccccacccaaaucucaacuugaauuguaucucacagaaagggaccugugugcguguguguguguguguagcaggggguggggagggauggcacgcaggggugguaauugaaucaugggagccggucuuucuauucucgugauaguaagucucacaagaucugauggguuuaucagggguuccagcuuuugcuuccuccucauuuccucuugccaccaccauguaagaagugccuuuuggcugggcacaguggcucacuccuguaaucccaacacuuugggaggccaagguggguggaucaccugagaucaggaguucgggacgagccuggccaacauggugauaccccgucucuacuaaaaaauacaaaaauuagccaagcaugguggcaggcaccuguaaucccagcuacucaggaggcugagucaggagaaucgcuugaaccuggaggguggagguugcagugagccaagauugcaccacuucacuccagccugagcgcaagagugaaacucucaaaaaaaaaaaaaaaaaaaaggagugccuuuugccucccaccaugauucugaggucuccccagccauguggaacuguaaguccaauuaaaccucuuuuucucucaagucucggauaugucuuuaucagcagugugaaaacgaacuaauacaaggugcaaacaaaauggucuaaauauuauaccccucccaaucuaagaccaaaugccaaacauaggcuccacuguaaacaaagguauaaaaaauuacauucaaauguuuaaagaugccuauaauuuucugaacuccuacuaugcccacaacauccagggaacauauagaacacucugccauggcuacaauucaauccaaaaauuuuaagucuuuaaugagucacuuacuacuucuugaucuaaacggguaaccaucucuuccaguuucuggugacccuuuuucaggucuucuucuguucguuucaaggcauugagcucugccugggcacgauccauuuccuccuucauccgccaucucaguuugucacugaccgcagagaugagagaggcucggaugguguccucgcugauugugccaucccuacugggaccugcaggaaacagagg

SEQ ID NO: 17795 - RNA, 2528 nt, Homo sapiens
caauaaaaacaacucucuaaaccuccuccuaaugauaaaguuuucauuaucgcccacuuaagggggcuuggaagauuauauagaucccauaccauggcaagucugauugguuguacauguauuaguuaacuaucaguauaugugaaucucucuagaguaugaauucaauauuaauuuaugcuuuuguugucuuucaaaagucucaaguuuaagucaccucagguauugugucagagucuccauggcugaacugguuugugcaggcuagagugcccacgcauccccaguuuuuaaauugucaggauugccucaagcauuguaggaguuucuugagcaugaacacuagauuuccaugauuuugaagcaggcaaggagucuggcauuacuguauuaauugugaggccucuaacaagaaaacuucuaccuucaauguuuugcacagauucacaggagagggaaaaaaaaugcuacuuccaagaauaaccacuuuaaauuaacugaugaucuagcuggagccugggugaauucuucaaauguagcccacuugggacaagagccaggguggauggcguauccccugaaguaauuguuaugcccuaguguuauuuucaaggccucacacagacuugcagauauucucaaggcacuuuugcuuuaaggcugaaaaaaaagcagaagaagaaggaacucaagguacugagauauaaacacuguagagacauaaauuaaacccugaugucgccaacaagggucuagccucuuccggagagcaaguguggggcagugcacuggacaggggucacuaggggugagacucagaagguggaaaagacucaugcaagaccccauugcuaguuagcaucaaagucuagugaggagcagcccguauuucuccacucacugcccaaugcucuuuuccaauacccagcuguaucuaacgcaucucuagagcuugcacgaggcuaauuuaaacucauuaauaaguuguucaguaaauguaauacguugugugcauagagauuuuaauguggcaaggacgaaagaacuauugaauuauguguuugcaagauuuccuauuuccucuccucauaccagauaaagggauuucuaucuuugauuucugaccaccccacccccacuccuaaugccuauauauuuuuuggucauuuaaugcaggaugaaggugaugauaggaagagaagacaggaaaagugggaugguggacuugcauaagaaauaaggacccuguguuugggaaagaaaaaaauaauggaggcagaaggaaagcaaaguaagcagaagagguaaauggaaacacagagaagagccagagagcuugauuuuaggagagcuacugagugauaaguugaaaaaugaaauauaaagagaaguuuuaagaugaugguuugugagaagugagaaacaguggagggcagaaagaauaagaaguuucuaagaaguguugacauggaucccagggaucccagcugguauucuucaggacccaaauggaaagauuggguuauuacacuguuucguuuguuuguucaaauguaaaacauugccaagacugagcccugugagcacccagcuuauauuuggguuacaguaagaagggauuuucuauacaguuuaauguaauuccaugauauuuagaagaccagagucccuugagguaguucagguagauggcaugauaauggccaaacuauggguuuugggauauuuuuugcagaagugagagauaaaaaaaagcugauacuggaauaucuggaaauaaaugaaguuuugaagcuaccaggacaaggagagagguaccauaaugaaacauaaauucuaguacuucacggugccuucuuuugcaugaauuauuuguuugcauuuuuccuucagucaagaauuucaguauuuguggggguugucccccacaaacugcucuguggcccaggcuggagugcaguggugcaaucucggcuuacugcaagcucugccuccuagguucaugccauucuccugccucagccucccgaguagcugggacuacaggcauccaccaccacgccuggcuaguuuuuuuguguuuuuaguagagacgggguuucaccauguuagccaggauggucucgaucuccugaccucgugauccgcccgccuuggccucccaaagugcugggauuacaggcgugagccaccgcgcccagccuuuuauuugucuuuuuagcuuacauaggagcucuguggcuaagagauuugccugaguucacgcagagagcaaaagugcuuggucaggcugacuccugcuguguuuuucccuugaccuuauugcaaacaucaagcuguuagcugaaagggaauaagaaaaauccuaggugcucuuugucccaaauuaaugaggacuagaugagcuacagcauuccaaagacaucugggaaucacucagauuuacaggacccuuuuguguaaugcauucacugcaaaguuacaacauagucaagcuguguacuuacugugcgagugggacacccuuu

SEQ ID NO: 17796 - RNA, 2323 nt, Homo sapiens
cuugacucgucuucuuuuuauguuuaucuagugagccuuuuuauuuuaaauacugucaaaauguuuuuaucauguuucuuaaguugcaaggagcauaaaggagcagcaagacuuccuaaguaugaagacuuucacaaugguaaaacgaaaccaaacaaaaaucucacccacaaacauacauggaaugcuugugugccaggcauugugcugagagcuuuacacucuucauucgcuuauucaucauuuauucaugcugccaacacagauugagagccugugauaugacagacacacuuccaggauucaaaacuaggaugcuuagucccugcucuuguuuaguaagauaacaguaaacaaguaaacagaauguaaaugcgaucauuuuuggcagugauaaauguaaugaaugaacaaaacaggaagagacugagggagaacagcgacuuuggaaaaggugcucagagauaaagggcaagauuguuuccugguuaguugggaugggaguaggacaggaagaauacacgugaguuugguguguugggcauggcagggcuaacacaugggcaggaggaggcuuugcagugcccagcucccauuuggagauauucugauccaagcaauucccuuuccuugggcuuuuucuccuuuccagagccugcuggacugguuacuuacuccaacucacugcugagcauuuaucuauucacggauguacagggguccuacugggcacugccacguuuccauaugcuauuuccuauaauuccucacaaaacccaucaaccagugaacagccuuuuccccugggguucuugucaugaacucuucccguuuaauauuaaguucccaugcuagagucuguuucuggacaaagaauucuguugcacugagaguuuauuuuuguaccgaucccacacuguuuuaaugauuucagucuuacaguuuaacuuccucuggaaacuccucccuucuugauuuggagaccucuuuugagguucuccccuuugauagucauucuauaggguggugguucucugacccuuccccugccccagcccauacauuccuacucccuucccuuccuucuucccuucccugucuccuaugcucuccuuggccaacuucuccaggcaaauccagagcugguguucuugcaggucugauuccucuuuucuuauacacuagggauagauccucggccuuguucacagggucuccccucaccccaugucucucaccccagcugacagacaugaggugagagagugggaaggaaaggaggccacagaugccauggggcagcaggaauggaggcuuccccgauggcggugggcauggaagaagugcaggaugcuccuguccuuugucagugucuuacaagaucuagccuuugccuguggccuacucucauuaagcucaagccacccuuccccuccgcacccgcuguucugcuguuuggagggcucucuggacauuuacauaguugcucccagcuugucauuagggucucaccucgaagcaucaccuccacaauaaggccuuccacgaccagccgguuuagagugacucccccagucacuauagcgcagcacucuaauuuguuaccacauacuauuuaccaauaucggaaauucuacuguuaaaauuugucuuuucauugucuuccaccggcuaggacggaggucuuaggagugcagagaccucauaucuucaggacagagaucacuacccuuugccagggaagcucacgagggguuacagauugguugauugaauugaaauuuggaccagagagggaaugacuggcuugggugcaagucgggagcaaagcaggaaucaaagauucugacugcauuucuucaguccuuugcccacccagacaggugaaggugcuauucaaagauugggggaggagagggccgcggcauccaccaugaaccacgaacuagagggaagagggaagagggaagagggaagagggagucacgagcuucgcuaccacagagcaggugcguucgcggugcgcccggccuugaccaacccgacaacuuggcuuuuaccucugaagccgaggagcagggguagggggugagggaaauucacaaagcugcaaccacagagccaauguuuggugggcgacaaccccccagucccuccucccuuccucuucuucccccaacugcccgccgucacgccccauccaggggaagccccaacgcccacgggagcuccaggagccgggcucugcagccgccuggcgcacugccugguugcaacgggggcggcgguagcccaggcgauccuggguccccagacaaucagc

SEQ ID NO: 17797 - RNA, 40719 nt, Homo sapiens
aggcuggagguggggacagagggaagaaagaaaaaaaaaaaagagagagaggcaggaaaaguuuuuucagaggaaaaugcaggguuuguccuucacccugacgucagaucuugcuuuaauaaaaccccccaagggcugcggaagaggcauaucuggugcuccugaugggccggccagucugggcccagcucccccgagagguggucggauccucugggcugcucggucgaugccugugccacugacguccaggcaugaggugguuccugcccuggacgcuggcagcagugacagcagcagccgccagcaccguccuggccacggugaguccugccuggaggggcucagagggagacccagcucccuucucuacuggguccugcuacaugggggcuggugggcaggaugaaaagggccaggaagguuuggggcuggaagguggccacuuacagggcaaggacagagcccagggugaggagucagcugcccagguuggcugaagcuggcagggugaggaggacggugcgacacuuggggaaacaaacugcacagguccagccugcccucucuccccaccugaaacagugcagaaagaacggggcccucagcagaacugggagucaggggcccgggcuccagacccgucuucgccuaaccuggcuguguggccucgggugggucacucacccuccaggagcagcguaaagcgacgaaguuguuaggugacuucuagagucucugaguuugaaaacuccaagacuccaagcauuggagaugcugcgaagaugggagauggaaaaagccaaaaaaaauuggaaagaaaaaugccagcuuucaacaaaagcuccuuauugagcaaacagugcucagggugaugucuaaccccaacugcugucaccuccggucugcacagcccucugcagucugcagaguguccauacuuggguccugccuaugaagccugcuguuccagggugggggugaugugggcaccccagagucucucucucuuccaccugcaccccaggguacaccaaggggaagggacaaaggucugcaccuccaaaagccaggggagucacauaugugaccguguagagccagccugcuagggccaggcauggugaggaaaaggcagaggcaggcagugcaaggagggcaggagguggguaccuggcagcuucugagccccagauuccacagcccagggcaggaccugcuccuggcagaacagccuagagacggaggggugauggcaaaagaguguuuauccccaaaugacacugauggcuuccuuggggguuaagaagcccccuucacagauaaggaaaccguguguugggguuaaaccacuugccagaaucagacucuaggucugcuucagccagaacugaggccgagagccgacagcaaacugagaccugggaaauaggaauuccucucaaugccucgguguguguaaugauggcggggagugggucuguuucaucuugguuaaauccucacgccuggcauggugccugacuauaguugguucagaaccaccuuaccagaaaguuaucagcuccauuucacaaaugaaagaaauggaaagugagagcaaguaaaggacuugcccaggagcuccucauuaauaaguggccagggcccaaacuuagaucuucugaugccaauuucuaaccauuccuacuuaggggaagcugacuguguccuacaggagugcccagaaggagcuaagucgcuguuuauuucggcucuggguauggcugcgccuuuauuuggguauagcuuugcagguugcuaugucugggagggcagggagaggauggagaaaaggugagcguuugagagaagccaaagucugagugggcagaggaggcgagagguuuaagcaugaguccaaguacucuggagccccagucagcucccagaacagccggugcugaggaggagugaaggacagagccgaggacucagccagaggagaccagcaaaggagcagagcguguggagggacccagggagcagguuggagggaaggcucccgggaccagcacaagguaccucucuucuaggcagccccugccuggggaacccagaccacccaccccaugcuuguuucaugauuuagaugcuucugggacagaggugugcacggcacuggaguucucaggauguccugaaagccccgcccccugugugggcugugagacugauagaaacgagcuggacuccauuuggaaaccagccuuguuucauagccaaauuccauacauggucauccucccgaauuaauaugcaaagggagcacauguccaaccagggucucagugagaucuuaauggaaaaaauuguuguaaauguucauauugaagaaaaugcaugugagaauugccaagaaaacuuugaggaaguagaguuacaagggggacuucucugggagauaugaaagcacucuguaaagauucugcaguggaaggaggaagauggcagcccagaaggagaucagccaaggaggaaggcacuggagugaucucaggaacagccgaguguauuugggaauuuaaucugugcuaaagguguauugcaaauaugacuuaugcuuucaucucuuuauucuuuucuucugcauuuguugagcauguccgccaugugcuaagagaaagggacuccauuuaaugugcauuagcaagcacugagccaacacauguauaagaccaaccucaguucacccaacaaacauuuauuaggcacauucuacaauucccauaacaauauuauuuagcaagugcaauuauccuccuuaacagauaugaaaacugagacucggagagguuaaguaauuugucaaaggucacacagcugguaaucagggaagcugacauuugaaccuugguccagcucuugguaauguagccuccugccucccugguccaagggcagaaaccaggggcauguagucccugcccgacagaguuuacuggcuaguggggcaggugacagggguaacgucagccagaguagaggggcuggaaucaggcucugccacuggcugugucggccgcacuaagucccguugcaccucagaccucacuuuccucguuuguuaauugggacuaacugucucaccacaccaagcucccugcugcugaacgugaaaaugugccugaggaaaaccucucagaaguguguaauucagcaaacgaaagcugagugauaaaauccugggcaagcauuaggccugugguggucuauguauaggucuacagguaaaacccacauccucccuccuguaucagugcaugugggaugugcauagcugcacuguguguguguggggugggguguguuugugagaggguguguggggguaugcguaugguguguauguggggugugucuggugugugugugugguguguguguguaugugugugccugugugguguguguggggggguggugguguguggggguguguguguggggugugugugugguguguggggguguguguggauuuguguggugugugugugguauguguguguggugugugugugguauguguguggggugugugugugugugguggggggugugguguguguggaacaugaguguggugugugugggggugugugugguguguaugugguguguguggggggguggugguauggagggguguguggggugugugggguguguguguguggguuuguguagugugugugggguguguggggugugugcgugugugcguguguggugggggauguggugugugugugguguguguguggagggugugugugguguguguggggauguguguagugugugugugguguguuugugggguaugugccuggggugugugggggggauguguggugugugugugugguguuuauuguguguggugugugugguacguguguguguggugugugguguguguguugaguguguuugugguguguuuuuguguguguaugugugugguguguguacugaguguguauaugguguguuugugugugugguguguguguggugucuguguaugugugugguguguguguugaguguguaugugguuuguguguguguuguguguguggugugugguaugcguguguaugcaugguguguaugugugugguguguauuauguauguagugugcuuguguguguguggugugcguggugcuugugcaugguguguguauggugugagcauguuugugguguguguguguugaguguguaugugguguguuuguguauguggugugugugugguguguguaugguguguguauguguguggugugugucuguugaguguauaugugguguguuuuuguagugugugggugguguguguguguugaguguguauguguuguguuugcguguguggugugugugugugugaaccuuguguuugggugugagauacaaacucauucucugcuuccagaagcaacugcagaauaaugugggucaaguguauggcaaaauauccccuuuagaaaacagagaaugugaacaauaugucuuuucacaccuccuguuuagaguuggaaucugagugaagauuucaaaccccauccaggccccacacccccaacuccccacccagagccucuuugggcucccugaagccccugcugccagcucagggccccuccagccgacagcuuaucuuggaggcuggcacgaggacggcacugaaaggcauuucccccucggcauggcauuuggagaaggagugggcacgggaacaggccuccgcccaaccagcuccuugagagacaaaacgcuaccuugugggcugagcagcacuccuggcuccacagcaagccccaccaaccacccccagguuuuagaaaaggcuccggcccugugccagcaaagcacccacaugccaggaggcugcccuuggcuuuguauaaacagcaacccagggaucuucccaggaaccucagccauccucugggcagcagggaggcaaacuccaagggaggugggcucugauauggaagcaaggguggcgaagcagccaugguccagguggguuccugggaggggcugagaagggugccaaccacaaccaggaagcaaagcgagccagcaagggucaccguggagguuucaaagcaaggcuucagcacagcuguccccucauucaaggacacuguggugggcccugcaucccugugauguggaugguggcaaggguucacacugagcaugugcccacucuacucugggcacagugcccuuuugcacacaccuaugaggcagcgguguugcuguaaucuagaccagccagucaguagccacguguggcaggaggccacucagcacuugaaaugaggcuggucccagcugagauguuccggaagcauaagauacaccauugauuccagagacaugguaugaaugugagagcgcaauauucccauuaauaauuuuuauauuaacuccauauugagaugauaauauuuugaauauacuggguuaaacacaaucuauuauuccacuaaacuucaucuguuucguauuacuuuuuaauaccgcuacuagaaaauguaaaauuucaucuauggcucuuauuguauuuuacuagauggugucggccuagaaagacacaagugugccuaaggcuaugauaacagguagggagggagaaaugccaaggguucuaaucccagugucuccacuuacaggcuuugugcccucagguaaguagcccagcuuuucugagccaggaucaucucuguauaaaggaauauauuaacauuaguacuauuggcuuguuaaggguguugaauggggaaugaagcagagacaaagcccacaaggccccagaacacccaagggaaggauucuauuguuccaauagcagggcaggggaauuccaacuugaguggaugcaccagcugcaggcaaggcccuauccaaugagcagggguuuauaaagaccucaggcucagcaccaguuggcuaggaggaggggcaggcugaggggcagacuaaugggcaggcuguccuggcucagugcugggcauguguucuaaagaucccacagauuccauagccuggccagcuuaccuggcacauuuagagggucagugaacacuuuuggguuauuguguaggagaaagaaaugaugaugaugaugaugaugguggugguggugguggugguggugccuguaggugagauguguaucuuacuaaccugagucaggaugucccucaaugccaacugugaguuucugagccuauuuccuuuuuccauggaccccaacagacccaacuauaugcccagccacuuccaguuucuagaggugugguggugaguggucucucuguguuuaaacuggaggaugguuccaguguggaacagagguuuauauuagcagagagggguauguuuaggacucagagggggaagcucggagaacaugggagauggugaaaaacauguucuggaacccugaaccagaauuccuagaaagaccucacccucacacgucugcacauuaaccagcacccugaugauucuuauguauacuugauuucaaacaccagugaccgagauagacucuagucucccccccagcucugacauuccauuaaccagucagcuccccuccuccuccuccucucuaugaaagaaggaagagagacagagucgagggagaagagacugccucgcaaaugugaacgaugggcauuccaggggaugcgauaaaaucugagcccgcccaccccaccgucuccaaucuggaggcaaguucaggcuuggggcuuugaguguggaucugcuaagucuugauuagggguaggggguagggugagagaaaaugaaagcccaggcccaaaggaaaggaagggagggguccacccugcagcucuaggaauccugcucugagucugggaguggagaaaggcaugugugcuaugagccugcccauggcugggaggggaugaaggcggguaauucuaagaguaggggaauauccugagagagcagggacucauaccccugcccucagagcagaacagcagacuccuugccuagagagcuagaagaccagggggaaauagcuccugcuguguggcuuuaggcaagccacuugccuucucuguacucacuuucucaucuugaaagugaggagauuggacuugaucccaaagcuggcuuccagcuggagcugccauauauuccaagaguccacucauucauucaucgggcagauccaucauuuaacaagcagcaggggagcucacgcugcugcuucucuagaaagggguugucggcacccaaaauguaugucccuugcucuaggugucuauuuagaugugcuuugucccucuuacaguguccaaaaauauucuccuuucagcccacgucucuuuugucaauccucaaaguguagcuguguuucuggcccacagcagccucauacaacugaaaaucacaucagcaccuggacguccgaggggucccaccaucucagugguuucccaauuaggcccucucccugcucuuccuacacaagccuguuuucccagucucuuccuuugguucuucucccauucaccuucuuuucuacuucaugagccuugcugucaaauacuccugaguuccgccucugugcacguggccaagcuguuccuuugcucugaaaugccuuccccaugcuucucugauucaugaaauugaagccaucugaacugguggccuccuccaaauggagcugcagacaucuuccagugggcacccauggguucuuguucuugcccacguggagggaaacacgucgcccagcugggacucucugcuggccuugcccuguguuugagccacccucccuccucccccuacccuccugcaaagccaagcccuuugucgcuuccugaccaccugugcccucaggccccagggccuuugcacaugcugugcccucuaccaggcuugcccauacaucuucccugcucuguugcucugucacugucuaugccugcauauugcaggugcucacaguguacuuccugauaggaugaauuaaagcaagaaccagaccuggcauaggcuggggagaauauguguauaggagaugggggaggcugggagggaacaccacugauuuuuuuugaaguagaagcuucaugcuggggaggaaaaggagggaauuuggcaagagggccuggacucaacugcuaagaggacugaguggcaagcggcagcuuacgggcuugguucuggagcaaggacagaacgaggagucaggagacuggggucucugcaggcucugccugcaucucugagccucaaugucuuuaugugaaaaaggaaacaagaagaaugccccucugcucaggcuugugcucuaggcaggguagugcgguggugaagaggaggcgggcagcacacagccugggucaagagccagcuccaccacaucccagccccaagcccuuaaauuuccugggucucaguuucucaucuguaaaauggauguaaaugcccgugucacagagaccuuaggacuaagaaagaggacuuagaaagagguuggguguggagcaugugucgagaaggggcuuggaggagccauaauuagacagggaauaucaagcugcuuugagauuagacaguguugucucaugguccuuuugggagcucauggauaacagagcuggcaggcgcgcguggagugagauugcagccaccugucuucccagccaugcuauuuguauuuaaaucugucgccuacauacacaugcacacacgcacacacaggcacgcaugccaguugacuuccuugacagcuguuucuggccuugugcuccagugccaaguccugaugcuugcaaacuuuggcucuuagaugaucaaagagccagcccuuguugggcccuuagugugagccaaggcccacggcgagccccuucccacaggucucaucugauguucacgagagcccuauguggcaggagcuccuaucagccucauuuuaaagaggagaaaacugaggcgccgagaguuuuacgcacuuccauggcaugcaagguucagaacaccaccgugugccccaagcaggcugccuagaccagcuccuagggguauccuugugugucagucccuuaggccaguucuguuucucccuaucugagccagggauccagugcaggaggagggaagggagauggagucacgcucugggcgguggagggaggacagauagacuuuauccccugcuuuauuucccugauccacgaaccauugccagauguggaaggcccacagugaucccuucaucccagccugcucuuguuacagagaaagugacuuguccaaggccaccagcuucagcauggggacuggagcccagggccucuccccuccagggaaggagcucaggagacuggaagacgauccccacuaccccaucggguagaugcccacucugcccuuguagguggaacaagcccgagcucaaugacagcaaagagcuucauucuuccacccgugucuguguucgcuguggcuccagggguggcccccuccguggucuccccauagccaccgccaagcccaggccugggacaugaaaggcccucgguuacauaugguuauuugaaugaacuggacagugggcaagaacaaggugccuuagagguagcuggaggaggauaggaccuggagucaaaacagcugacugugucauuuucuuguugugucucaaccuuuuugggucucaguuucccaucugucaaauuggggccaucaaugcugaccucaugggauuguuuugaugaucaggaaacugacuucaggaaagaccacugccuuccccaggggagggagcacgcauccucugucccgggccccugacugccaucuccguguccuugaacauuaagcccuagcaacauggcccacuggucaucacgugucaugccacguuguuucugccugcacaccccugcucaugucauccccagcuucagggcccucucugcccucccucucaucaauuuccacucauccuuuaggauucagugcaaaugucugcuccucuagggagcacucugugguccuauucccaaccccaugcccuuuccccucuucaucucauccucguagcccuuacuuagacuaugcuaaguuaccuuacaguguggcccuuaggugugaagccuuaagaaacggaugcuuugagucccagggcugagguucaaaccucaacguugccauuugcuaguggcuuuggaaaaauuaucugaccuuuaccuuuuugugacucaguuugcucaucuaacaaaugaggaagcuaauaauaacagcagccugccucuuaggauaaucacaaggauuaaauuacuuacuuaaaauguagaugaucuugauucaaagaaaccaucuguuaaaaaaaauuauuugggagagugcaaucugaauguggacuggguauuaacuagagaaaguuacaaaauuguaacuaauuuauuggugugauaauugcauggggguuacauuuuuccuaaaaauuccucauaauuuagagacacacuggagaauuucagguaaaaucucaggcugucuaggauucgcuagauuuuuaagaauaaaaaagcauacagccaggugugguagcucaugcuuguaaucccagcacuuugggaggcugaaguggguggaucacuugaggucaagaguuugagaccagcuuggccaacauggugaaaccccaucucuacuaagaaaugcaaaaauuagcagggccuggugggaggcaucuguaaucccagcuacucgggaggcugagggacaagaaucacuugaacucuggaggcagauguugcagugagccgagaucacgccacugcacuccagccuagacgauacacucagauucagucucaaaaaagaaaagaaaagaaaagaaaagaaaaaaacccauacauguguggggaaaauggaaggaacaagaccaacuaaguguugauaauuaucaaagcugccgaugcguauguaggguucguuauauuauucucucaacgugggugaauauuuaaauaugucucuagcaaagaacacaguuuaaauuuguguacaguauucaguguuuuuuguugugguuuucucacuacucucuaaaacugugagaacauucagcauucuuuccccugcucaguaagcaggucuugugcaguuaaaugaaaaugauguauuuuacccuugauguuuuguuaaaaugacugaaaaugggagaaaaccaaaaggaguagcucccgaugaaaagacccuuaaguucuucaccuccuuggacaaacaggguuaucauauagugggcaggcccuuauaaaaaugucaugagccaucuauggcucuugggcuguaguuuuugaccuuuauaaugcgguugccuguuuuacguuccugucuccuuggaggcuggacguucucagaggcuuugucucugacacuggccacugcaugugggacuuaguagaugcuuuauauacagauugacaaaugagugaaugcaugagugaacacauggacuagggcucguuaucuggaaaaaaaaccuggcuucuugccccuuguacccucaucauguaaaguugacuuuccccgccugcauguuuauaaaaccaauuaguagaaaaucucgaaaaccuucuacaucccauaacaugcagccuggccaacaacuuucuggaaaccacccuugggaguuucugggcagugcggugggggaaggaggaggauguaccuggcucauacaccuuucacggguuuggagcuaagagcuuucaaaggugaucuacccaggaccacugucccaggccccacuugaaggggagcccccaccagggcccgggauacaggugccuaggggugcaagugccggagguguugggaaaagagguguuuguuaccuguggcugacucagaggcacccgaugcgcuuugaaacaagcguggggaagacaugggcaccggccaggccuguauucucucacgguccccagggcuucucuuuucagcaaagcagugaacagaagcugcuuccagcaggacaacccuguccugaaagcucccgggcccagcuagggccggcuccggccauuccugccucaacccugcccccugguggaguaucuaggugcggccuccgaaacagggcaagccaaggccuccgaccguccacacugcucacggagcacuugcccagggugugccaggcgcagugccgggcacccaggaggcgggaaagggcaacccgucccugagaauccccacaagggcuccucacuccucuucugggggcccuuggcaaccugggcucaauuccauugcuaucuucccagggggugaggacccugccuuguucaucugaacagcaggcacauaguagacgcuugguacaugugugugaugggcggguggagggaagaacaaaugaaugagggagccgugcagcaaggugauuacaaguaaggguucugcagggacacucugggucaauagaccaccuuccagcugcgagaucuugagcaagauucuugagcucuuggagccucauuuuccucaucugugaacuagggaugacacuaauaacugcucauuaaggcugcuggaggauguugacaucaccaucauuuuacaaaugaugaaacaagcucagagcaggugagcacggcuccagaucccaaagcugggaguggcaggagguuggggaauugucaaaugggguccccucauugcagaugacgugcccuuucugcaaauuccaugcccuguucacaauaaacugcacacacucuuagaagagaaagggaucuaucuccuucaucaaacgggacgcuucagauauccugggcaguccaccccaccgcugcuagccucccacguucugcuccuaugccuauugcuaagcauuuuuguaaaaaugaauacugauaugcaaacgucaaauuauagacuuaccucuucccaaguccacuuucaaagagcugaaauacaccauaauaaucaguuaccacucaccuuuaaauauuaucucaaaaauacaugugaaacauuuccuccagggcuuuauuuuuuuuccuucccaauuuuaaucagcuuaaguuuguccaauaaguaugauugaagggaucacuucaucacuguucaccuaccuacugauaacccuguuuguccagugggguuaaggacuuaggggucuuaucaucgggagauacuccuuuugguugucucccauuuuucagucauuuuaaaauaucaaggauaaaauacaucauuuucacuuaacugcacaagaccugcuuacagagcaguugugucacccugaugaaucacagaaugcgguauguucugcaggucugcgugaacugcugugugaaagcagcuuagcagugucgguggguaaugaacauggguguggguuguacaaaagucagauguuaaaaaaggaagauggucuaaaaucuccacacuuuucucuuaucccugcccaauguucuaaggcagugguuccuauuucuauaaaaauucccaaggguugcuggucaaacugcuacggauuccaggcuucagccuagagaaacuuaaggcgaauauucaaagagggaucuaggaaucugguuuuuaucacucugucacccaggcuggaaugcaguggugcaaucuuugcucacuacagccucugacucccagguucgagcaauucuccugccucagccuccugagcagcuggaacuauaggcaugugccacuacauccagcuaauguuuguauuuuuaguagagacaggguuuugccauguuggccaggcuggucucgaccuccuugaccucgagugauccaccugccucagccucccaaacagcugggauuacaggugugaaccacaugccuggcugaggaaucuguauuuuaacaaguuucacaggccagugauucugaaacuuuggggcauucagaaccaccuggaaaaaaucccaaugcccaggcuccucccaggccccuuagguugggaucucugaguagaguguccauuaaagccccaggguaguuguacuuugcaguaaaguuuggaaaucaucaucauaguaccuggguagcuaggagggguugcugaggagggagggguauggcaggaggagucucagugggguagguggggcccggugggcucagaggcugcagcaggcagaagugagcaggaccaggcugugccugggcaagcccugggcaucuugccagcagaagcaccgcagaguggccaccaccucugucuuccccauaaacauaguguuaucugcagagucuauuuccagaaguacaucaugaaagagacuuuuaugugaacaucugcaauuuggaaaucccaaggcuguuuugguuuguuguuguucuuguuuguuuguuuuugucuuugucuuuuuuuucccccuccucuggccuucccuagacaacacucuccuugacuuacgaucuuuucuccuuuuugccuucuuggcuucuguuguuggacagaaugaugcaggcuccauaugacaguguguuugcaaagaucauuuucuccaucugcagaacaggcccaggcaccccagcucagguagcucaugguggguaagaagauagccgucagggcucucuggggacucuacaggauaggauauggggcaggcuccugccuguggcuggggaaaacaggaauagcuuccaauccccaaggaaaaugaaagccugguagaaaccucagagggucccaggggcccaagcaagcauccugggguuugaggaugagccccagcccccagaaggaaagcacuauuuuugagauccuacagaagccucuggaaaaugugcaggccuuuuuuuguauuguuuagcugcaaaaagauuccucuaaauguucauauucuacuaauuaccucucucucccaaacccaggcaagccaagcaaauagguauuuguuuugcacaaauacccauugcuuacacagaaauggguuuaucguuuuuauuuugacaaaggccauacucucauuguccacuaaagauaagggccagguguggcuuaggggcccgagcucccgggcuucuucacugcacagcaccacaggugcggcaugggagucccaccagcagccaaaccaggguacuagaggcugggaugauacagcugguuuaccuauggagccacagcucugacccagaggcgccacacauuuccuucaggauguguugauguucuggaccaacagagacacccccagaaaggccccagaccaaccacucaaggucaacacacauacgugccccagauauucccccagugacuccccaucaugacagaccugggugcacugaggagguccccagacagcaggaaaggguggggcuggugguaccugggcccuuggaugacuccgcaagcggaugugcaaggaaugaggaguugagagcccacauaggaugcacagacagaagguggugugggaaacucucaucucccuucucuggcugagaugcuucccccacuccuuuuuuugggggguggaaaaagagaaccauucagugaaaagagcugugaaccaaagcaaaggacagguagagaugucaugccauccuggauguugaaggaggcugauggugugugcgcauguguguguguaugacagagacagagagagagacccuacacuggccuuccaagcagcugaagccccagugaguagccuucgagggaugcucaggggaugagcugccucagccugccuggggccgagggaggcugccaguggaugggcacaaggugccagggaucacacuggaauuaaggucccagaacuaacugggagguucuaagaugugacuucgccaccccuacacuccaagccacugccaggggguucuuggacaggcuuuuucauuagaagcugguaucauucacuguauaugccaccggcccaggaggagugaaagccgccauggcaccaugcaccuccaguugaucagggccccagagcagcuuuggaguggagcaggaaggcgggggggaaacuauggcuucacucagggagagguggagaguguaagcacaggcuuagagucaagcacuucagacuagaguccuucugccguucccugcucaugcagggacagauuggguaaaggaguucuaagaugacucacagcguuaagacucaccggcucuccaggagaaguucuggccaugaggccccucccaacccucacucuucagcaaugagcaucauuuguugucucuggaagcugagugcucaugcacuagaccacccgaauggcagcuuaggcuggacuucaggggagaagcagggcagugggccguuaucagcucauuuuuggcagcaacaagaacccugaagggacagguacccccacauggggauccagcuaugucccaggaucccaaagccucuccuugagcucccagcccccaugaaauauuuguuuugcucaagaucugaugggagcauguccccaaaauucacaugugcacgguguucccugugcagugaucagaggcagaagaguuaguggcucgaaaacucuggacaaggcagaccuugguuccaucccugacuaccugaccuguguggccuugcacaagacauuaaccucucugugccucuguguucucacugcucaggggaacauuagcagaccugccuugugauuuguuaggggauuauaugagauagugcaaacagaguucuccauauagaaugagcccucacucagaucuuagguauguugauuauaagggccugugaguuugugcaugcaggggaacagaugggcggcaugugguuucugccuucaaaggauggcagauugguuggggaaaugaacauucacucauguauucacccuaucaacagaugcuuauugacaccuacuaugugucaggcuuugugaggcuugaugucccucuacaacugccagcccaaauaauugucuagcugcuucuugauuacuuccacugauggugcacucacuaccuuucagcuguuuuuuuuuuuuuucaucagaaaauucucccucauguacaguagugggaaaaacauuaacugaaacaguuccagauucaaauccaaguucugucauuuacuagguguugggcauaagcaagccacuuuacugaucuguuaaaugggaauaauaauaccagucacugugcagaagacaaaugagaucagccagagucacugagggcuagggcaagacaguccccaaguggucaucagagugaugguuugcaauggauguaccagcaggaggaauuccagcugugaccucauaugaugcucacuuccagucacuugcgagcuaagcgaugguagcaaugccguuuuacagaggagaagacaggcucagaaagugaacucccagaguaacaugaacagugacaaagccuggacuggauacagugugguguuucuaaaacacaaaucuaacccugccauccuccugcuaaaauccuucaauaaaccauucuuccagaccucagcccaaaccaaggcauucaaggucuuccuugauguaugcugugccuugaacccauccucauccguccuagccuucgccuccuccugccuccacccugcacccuacaccaggcucugcaggccccaggcccuggcacauguugccagcucagugccugugcacuugaggguccuugcgcauuggguacccucuccugcuuccucacugaucuauucccacccccucuucaaaacccguucccagugccuccugucuugggaagcccucuucagccccagcacacacacagcccagccacuccccugucaucccacaggcaggucugcuuggcucucacacugcauccccagcaccuagugcugcaccuggcacaaaauaaaagcugacuacagguguguugaauaaauaaaugaaagggagaaugaauaaaugaguggaugccauuguuauagcauugauugcacugaauugcaaucauuauuuaugugucuguuggccucacuagguggggagccagucaggggcucugucuuaggcaccuucgucuccucccagccuggcacaaauccugugcauaguagggauucaauaauccucggucccuagaaugacucagucaucgugcacauccccagcuaaacugucagugcuggagggcggaaaccgcccuugcgccagucaucugcuuucccucgugcucacacagagaggugaggauugaucgauuaucacgagucaggacucacuuguggccugcagacccaaauccuagguaagcgucuaugcuggacauacccuagguaugugucagugcuggacaaggcagcuggcacucagaggcucacacaccaaacccagcaguccucaugcccugggguccagaggguuuuccccugcacagaucuuguccagcaccuucuccugagucugggagauuuucuaccacuagauggugccaauugcaaaggcuggcucagccgacugcccacagcccuucccuccucugcccagggaugccauaaaugguuccccuguccaagggaggacuucucugcagcuuccccucaccagcugugugcccuggcaccuccaggcacuuagaaaggaagcuuccuucugggcaucuuuaacuugggauggagacaggaggauggauagugaucccaggagugggauacccacccgguuccaacccauuccagcucagcucaaaguguccagauccccaacucuguucugggcacaguggggucagggaggacacacaaccaaauggguguaagaggagacaggcuucugugugccaugugacaugugccaggcccuaccuagugcugccacauccacaaugccccuucacccuuccaacugcccccaaagggaggugagugugauugugcccauaucacagaugggaaugcugaggcucagaaagaugaagaugcuguuccaaggccacacggaaagaacguacgucggacugucucagguugcauguucuuuucuugacacucaaacuuagggcccagaggagagguuccaguacaugaugccuuaaauaucauagauauccaagccuuuuuagccgacaaucccccauccauccauuucaccagucaacacauaugaagcccuacugugugcucugugcuguguuucaggcgcacagagagaugcaaggcccgggcccugcccuuuccaaguucacauuccagugagcgagguaagggcagggaagccuuccuggaggagagggcaucuuuauuuccucugccaagagcacguccugagugugguggcucugagagauggucugcuagugcucaugaggcucugaggcuucuagaaucauggccuaacaaggaaaugucucuccccaaagucaaaaagagggguguguguguguguguguguguguguguguguguguuuacugauucggauauguaggguuuucuugcauccuguuguguuuuugaggaaauaugaacaagggcaggcuaacuagugccuccucggugaaccacccagaacugccaaccccaagagcucucuguucccuaccagcaaggccuuccaaggccacaucgcccacagagccuuccucccugcagggggcugcaggcaagauuuuuuuuggccauucuggugucugucugggccauaacagagaagucacccauauguccccagugaagacuggcaaugugcaggcacucugugggggccugccccauccugcccucaccccauggaguucaccggcauuaaccuccaaacacacacaaaugucuaauuucugagccugccuaguggcuuaagggaaagccagacacacgcaggucagcgagucaggagaguccgcccagagaaaggggccccaggugaaaaagauaggaagggccucucagccacagggaacugcaucgcagcggccuugagguagggaaaggguggauuugaccaaguucugaaaucaagccuaugggagaugaaagcuucaagucggguuuugucuguugacuugcaagggcuuuauuuauugcaucaauauuuacuacauuuauugugcgccagguucagagccuagucagacuaauucagaaauucaucugaaccacuuuccucaucccugguccuucaaggugcaagaguggaccccacucuccugggcagagcaguuacugcccugguguucagagagcuuccaugccuccuuggaaugcccagcacuuugcguaguaaaucccucgaguugcaguaaaucccucgaguuguaguaaaucaccucuaauacuugccucucccauaagcuguggguuccccaaucauagggacuuuuaacgcuuaucuucaaauaucuaaaacuuaagagagacuaugagcuaacucugcaaaugucuguugagugaaugaaagaacccagaagaggcaaaaguagaagcuguuguaaugagaguuaggagauuaauuugcaucuuggccuugcugugaacugugucauccugggaguguccaucugucucuucgggucuugccuuccuccccuguaaaggaggaaagaauuugucugaguagcucagcaccggagccugguguuccgaguggaaagcagaucugugaucccacaaagcaggcuccucugcuuccagauggagggagcagcccagagcccagccagcccccugucccagccccacagaagcccuggauucuccucugcuuacuucagaacucagccgucaaggacgagaagugcugggcaggaugauccauggcuugcccaggagagggaggacugacucaaagccuggcucccguccccgcuccuguguccucaggcgauucucuuccucuugcaggcccaggucucuuucgagauagagcaaagggcacagaugggauucaggggggcaaccagaugggacagcaggugacugggugcuggagauacaggcagcuugaagcuccugcacucagacacccaggcaucuccaucugccgcuccucaggccugggcagcucuuagggccuugguuucccuucccagcuggccucuuguguccaucauauuugccaaaauaaagaugaagcuguugacugggggaugggaauggggaugcuggggaggagugcggguugguagaguggaguguguauguguuggguggggggucucauugcccugacagcaaaauaaaagggcuccuccauguagggcuugugcuggcaaaggaagcgccaacucacuccccaagggcuggggcccauguagcugccaggagcuauaaaguugaauaccugccgcugcaccacgccagcccuuuccggaugcucagaggggaaaaaaauaauaauaggucagcgggccgaaaccgguauuaaguaggaguccucugacucagagaggccuuaagaacucucggugagugaaggaacuggcccugcaggucgucacagaagagccaugggauccgagccccgcgcagccacaugacucacagccagcuuccaccugcucagggccucggcuuucucccuguaaagugaggccaccucccuuaccucggggcugcagcgacaaucacucaagaaaggaaaggagcagggucugagguggaauuugggccccaccgcugaccagcggaaggauucgggcaauugguuuaacuucgcugcauguugggcuccucuguucuauuuguuuuacugagaauaaaggagauguuuggcuaucaaaagcgugauagaaaaaauaauuuuaugaaaaccuuuugaacagcaugaggacaggaaugcaauggcagggcccuuugggcguugaaaccccugucucagcagccccccuuucccucugcccuccccccgcaggcccucucuccagccccuacgaccauggacuuuaccccagcuccacuggaggacaccuccucacgcccccaauucugcaaguggccaugugagugcccgccauccccaccccgcugcccgcugggggucagccucaucacagauggcugugagugcuguaagaugugcgcucagcagcuuggggacaacugcacggaggcugccaucugugacccccaccggggccucuacugugacuacagcggggaccgcccgagguacgcaauaggagugugugcacguaagugaguccuccauaccuucugaccagccccugagcacccccaguucuggccccaaaccccucucccuuggcacccccacagccuuucaccuggccaggcuuccguucagcaggagauacaccccaugaucagaggccagaggcuggguccuuccugggaaggggaggcaaggaugccugcacucuucucgccuccagaacuuugcuucuugcuuuauucucaguccuggaggcacauucauggcuguccccagggaagagggagacgccaugaaauaccuaagccugguuuuguucucuuagugguaggaucuuuuaacaaauguccauggccuacuaggacacaccagcauacugcagaacuccagauauuuugguaauauuguaaauuaaaaaauaugguuuuaaaaauccaguagccuugaaagaaugaaaaucagcagccugcagucaucccuucccaccagcuaccuacauuucucaguuacuucagucacuuaaauuuucuaguuauuucuucugaaauauaauauaguauauuauagaaauauacuauauauucuauauaguauagaaauauaauauaaagauaauauauacacuauaaauauuaucuuucuaaugaacuugaagaacaguuuucacagggggaaauauacuacauauacacuauauauaguaguuaaauauacuauauauacacuauauauaguaguuaaauauacuauacacuauauauaguaguuaaauauacuauacacuauauauaguaguuauauauacuauauauacacuauauauaguaguuauauauacuauauauacacuauauauaguaguuauauauacuauauauacacuauauauaguaguuauacauacuauauauacacuauauauaguaguuauacauacuauauauacacuauauauaguaguuauauaaacuauauauaguauauauaguaguuauauauaacuacuauauaacaguaguuauauauaacuacuauauauauauaauugcuacuauaaaauguauguguucugcuauauauuaauugccuugauauaucaauuuuuggauaauauauuaauauucuaagauagcugaugauuuagcuccucaauaaccaccugauauaaccccuaccuuccaaaugacauugccauaauuuuugauuauacaaucaucaguacuuauaauauuaugaccagguaaauauuguucacugcaguaugagaucaggaacuggcuuuaauucacuuccuuaugaugcuuuuguuuuuccuggacuuucuaauggccuuugcuuuuucuuuauucuugguguauucugauauccuccuguuuggaggugguuguuguuguuguuguuguuguuaguuguuguuuucuuuggucuucaagugcuccaucacggguauucuauccuuuuuuguuccaagacaccuccuuuaugaaacuuucugacccccugcuucuguccggacuuguauucccuugaauuguguaagcauuacccaaaauauaugacucaucagauuaagagagcuaccuagguauuaugaugcagcagccuaacuucugaaaacuuccacaaagucucauaaacccaaaaacucccuucuucccuuagugcugaaucaagccuuccccuuaacuaugacuccauauacaccccgucacauagucacacacaacguagucucucauccucagcuaaccauuauauuuuuugagguggauuguccaugaggguuauguacaucauuugcagucagacaauuuuauuuuaucugaaccacaugguuaauuuaugacaguuucuucucuuuuaucauugguucaugcuucaacuuucacacgaauccuugugucuuuggcuuucugugaauaaccaucccacuucucccaucuuucuaauuuuucuucuuuuacugaaacucauuagcagccacauaaaugguauguucaaagagaacuugcagcauccgcugcacagaaucaucugauauguugauuauaaauguuauucuugagccccaccccagacuuguugaaucagagucucuggaagugggaaugaggaucuaguccuuuaacaagacucccaggugauucucaugcaugcuaaaguucaagaauugcugcuaauauacucagucaucuguucccuccccauaacccagguagggaaaccuggccuggacuucuuacacuagaaccaccuccaguuauaugagcuugucucauaauuuauucuuccaguaaaaacuguucuucaaggucauuaaaaagauacuucuuuucacuaccauugcauuaaucucuaaagcuguauugagaucuugucaucugccaggcaccacucauuuauagauguucugucauggauccaaagauugugugaacccagaaacugccuguccugccugccuuccccaccgguggccuggaaaacccccuucccuguccuccucacccccuaucucugcaucuuagguccugccuugacccaguacagccacuuaacuucccaacaccaugggcuucuguguacuuccuuuccuuuuauuugaaaaaaacaaaaacuguaggcuaaaggagauuguaauagauuuuacgccuaccagugguucccuggucaugaaguuuuacaagcauugagauaaauaaagcuaaccaggagcuauagaaauucucagaggcuucaaauuuucauguccauugccaaauuccaaaagagagguaucauaagcuucauaauaaauuuuuuagauguauuuaauacuaaauuuuuucagucagauaguuccuuacccacccauuacacuacacacacacacacacacacacaaacacacaguuauacauauacacaucacacacauaugugcccacacaugcacaaacacaacucacuagugcucuauugaacauguucccggaagugcuaccauagugucugaauucaugagacccuaaugcaggaaagaagagaguguggggucugcaaaagaauacaccucugggccagaggguaaacagaacaaacgguuccucuaagaaacaaucuuuccacaaauggucagcuaagcaaauggacaguuccuaggacaggcuaaaucuguccuuaaagauuugcauguaauuagaccagaacaaggcagguaauaaaaaugagccauugcaacccuggcuuauauaacucaaacagaguaugauggggacaauggcaaucuggugugugcaagcccuggcuuucagagaugacccuacugggcccagccacucuggccaagcagaaaaaagcuaggucuuguucagcaugcuuaguuuucaagagaauccagguacauagauuuguguaugauuuguaaacauuggcaauacauucaaaaauauuuuuaaaaccacucugugggccaaacuaaauacaucugugggcagagggugaccucugaguuacaucauuuggcuauuucaguugcacaaacacuacucuacguuuaaaugaagcugggucaggccugaggucagugugguuugguggaaggauuaugauauuuacaagcugacagacuugaguuuuagauccuggcucugccacuugcuagcuacgugaccaugugcacaucacuuaaggagugucauaaaaccaaccucacaugcuuguugcaaaauaaauaaggaaaugucaaaaaauaaaaauaaaaguaauuggcugcucuuggcuugccuugcaaggaaaguuaccucagucuuauucacggccaccuuuagaggagggagcaggucuagcuccuggccuagaucccccauacugaagagugagggaguaguaaauucaugcaugcucuuuggaccuagacaacccagcuggaaucccagcaucaucacucacuauuacuaugacuuuaggcgaacuacuuagccuuuuaagucucaguuucuucuucaaggaaaaugugacaaagaaaguuuauaucucugggugguuagaaugucaagugccugcuacauggcaggagcugaauaaagaguacagcucaccccaguucccauccauccaucccuccauugauucuucacacaauaaacauaagugaggcagcaaaaacaaacagagcuacaacaaggcauggcccacugucccugcugacagcgugagcugacaguccaugggaggugugaagggagggaaggccccgauggcagagcaaguugacuugaauuccugaaagugcuucaguaagaggaaagcuaacucgaucacaccugcacuugcagaucugagauuagauaggagguagugaaggaaacccaacugucuucaccaucucgccuuugauuaguuagaaacuuaaugagucagcugaagggaccaucugcagccgucaugcaucccacuagccuguggugggcaggcuggucagagccaguagcagcaucucacuuccccacccaaagccccaaggagagagacuggcgcgccuucuaguugcacugguuuucaaccuuagcugcaaacaggauucaccuggggaacuuuuaaaauacggagaucaacaaaagaagaauacugacacccagguucacccccauauucugaggccuggcaugagcaucacaauuuuuaaaagcuccccagguuccccugggguuccccugugcagcugguagggaaagccacugugcuggggacuccgggcaucuagcacugaccucucccuccaaagucuccacaugcagggacagaguuccgggcuuagcccacucccuucuccacacacacacacacacacacacacucuuccuggagagacagcgugcaggcagaggcagggugacucagaaugcaaagaugagugauucacccagcgcuuccucugcuuuuuuugccuuccucuguccccuccuucacuggugucugguggcaggaaaugggcuguggagucaggucuccuggguuugagucccagcuguaucauucaacaguuucgugaccuugaacaaacgaaucauuuaaccucucugagagcuuuccuguccaucaaaggagaaaaauaaaacucuucaugaagucauugggagaacugaaugagauaauguaucagaugauaccuggcacuagaucagagggucaguugauguuagcaucuuuccuuucugcaccuccugcacggauaaccgcaccccaaaaaaaacaauagccgcagcaagguucacacaaaccgggauucugcuucccgcuguggucaccuuggacgcuaugugucuucaccuugcugagacuuuguuuugcuauauauaaagacaaagaugauaaugugauaguguuucuguacagaauaaaauaaguaaugcaaugcacaauacagaggagacccaguauccaauaacagagacaguacuucgaaaaccuucaugccugcuagacauuaggauuacugcuauuauuaacagccaccuucgggcaaacccugaaggacagaacuguuggcccacugcagauuccaaacugcuucuccuuggguggccacucaugauguccggggcucuuuaccugcauuuccagaagcuguccuccagagagagcaugguaucaagggugauaucugguccagaaguccccaacucucccugacuccaaacuggcuuaacuaacuccacauggccacuugguugucaaccagccaucucacgcauaauggagaacacuugaguccacccaacccaaacccugcuuguccaaagaggacagagcaucuuccuccuucucgacuccucuccuuucccccgcacagccccucugucaguaaguccuggcagcucuccuuccaaaucugucuggaagccgagcucuucucuuucuggcuucagaccgcucucucccaccugggucucaggguggucccccaugcuaccuuugcccucugacucagcaccgugaguguucucauguccucaacucagcaccaugaguguucuugcaaagcauacuuuucaucauucauucagcaguugcuuacugagcaccuacuaugugcuaggcucuaacagcuuugcacuuccucugagccuacaaggaagccuucucggaccuccucuccuucccuuuuccuucuugucuccccuccucagaccucucccacagcccaggcuugcucccaccuguggucuuuuuacuuaagugggccccucccuaccuggaaagcuccucccccaaccccugggcgggcuuccuuccucaccuccuucaggcuuugcugagcgucaucacccagugaggccuuccccauccaccugauuuaacccuauucccaguugcgcugagaauacucaccagcagcacuagaggcugcagcauuuaccccaaaauaauuuugccacaaaauaucucacuuuuguuacucuauucacaucauucuagaauaccaacuuugaaaaacaaaagauaucauucuauuuacagcauuguguuuuuuuaggagugguauuuccauuuacaaaauauaguaauucucgaucacugaaaaugucaaauccuagaaaacccagcauuccuaugcauaauuguucuucaacaguuggcugggauucacuugaugaaucugauuuuucugaaauagauuauucugaugauucagacaauucugauguuaguucuguuuagaaagaacuccaagaaacaguuuuuauauuuuauuuuuacauggaaaaucagucagauuugcuuuaaccucaaaaaguguguuuauguaaaauuaaaugagcucuggcagcuagcugaacauuuuuuucuaaacagggaaaggguuauuaauaaauuugcaacugucuccccccgcccaacucccccucccugcuccacuuuucucccagacacuuguaacugccaacauuccauaugaccuuuccacagcauaagcucuuugagggcaugucuuuugucuguuuuguccacuauugaguccccagcacauagaaggcuccaugaauguguauggaaugaauggaacacguguuucgaaguguucuggcuuuuuuuuuacaagucggucaccuucagaaccaugagcccuaauggcaggucuuugucaguaccaggcuuugugccuggugcuggggacccugcagggagcaaaccagccaagucccucgggaggcugcguccuuccacucccugggugcuggcugaagcuauaaaggaacuccugcacucccuuugcugaaguuccaccaaacacucagcccugcccugugcacucucacaccucccugccuuugccuuugugccucuguuccuccuccaugcugggagccauccccgggauuggggcaugguccacauggagccccuauaaaggcagcugggccagccaggggcaccaaggccacugggccugaccggccaccuguguuugcagagguggucggugugggcugcguccuggauggggugcgcuacaacaacggccaguccuuccagccuaacugcaaguacaacugcacgugcaucgacggcgcggugggcugcacaccacugugccuccgagugcgccccccgcgucucuggugcccccacccgcggcgcgugagcauaccuggccacugcugugagcaguggguaugugaggacgacgccaagaggccacgcaagaccgcaccccgugacacaggagccuucggugggugugggcccgagugggcugggggugggacccuacaaauggguuguggacccuccuggaacucugaccaccauagaaugacucauuccccaguccacuaccuacuagcuuugugaccuugagaaagucauaccuccccugagacccuauuuccccaucuguaaaacagaaauaaucccaucugucuagucuguccugugggauccucccagcauaaaaugaggagugcuuuguaaagaacaaagcccuaaaagugcaauccauuauuauccuacuaaagaguuagggaugggugguggaagaaggguagguauguggguaccugaggagaggagguaugagcaagaggagaugggucuaguagaagcuucaugaugauuuggggcuucccccuugcuaugaagaugggugggcaggugagauuucagccagguaaaccagauaagaggaagcccuggaaaagaagaguggggacaggcccaauuguuucacugcugcuuacuggaaucuagcccagugccauacacuuagcagguauccaauuaauguuugucauacugaugggugggcagauggauggaugaagaauagauagaugggcggguggauggauggauggauggauuggugaagagauggauggauaaauagaugaauguauaaauagaugaguggauggauagaugacggaugaauagguggaugauggauggauggaaggaugaugaaugaauggguggauuaauagauggauggauaaauggauguaugaauagauggguggauugaugaguggauagaugaauugauggauagguguauaaauagauagaugggugaguagauggguggauagaugaauagacagaugaauguaugaauggauggauggauggauauauguauaaauaacuagaugaguggacagguggauggaugaauggauggauggaugaauugauaaauggacagauggaugaauagauagauggauuuauaaaaaauuggaugauuggauggauagaugauggacaaauaggugaaugauggaugggucaauuaauggauggauggaggauggauggauggauggauggauagauguauaaauaaguagacgaggggacagauggauggaugaauggauggauggauggaugaauggaugaacugaauggauggguggaugaauagguagauagauguauaaauaaauggaugauuggauggauagaugacggacaaauaggugaaugauggauggaucaauuaauggauggauggauggaggauggauggauggaugaauggguggguagguggauagauggaugggcuaaugaggaucugaacuagggcagugggaguagaggcagugaagaaggaacagacacaagaggcauugcuugaguaagacugaaggucuuaaugucaaucuaaugcauggggugaagaagaaagagggacagaggcugacucccagggcuugucauugccuaggaucaaauacaagagaaggagcacauuugggccaagggagaucuacucuguuugaaacagacugaguuuaaggcagagugcccugcccacgggaucuuaagagaagcuuccaguuucucuuuauggggaggaaggagacgaaauaggagagcucugaagucaucugcuuggagcugcugguggugauggcugggauggccugaggguaacauccacagugagacagagggggccugaggcagaggucugggaaugcugacaugugaagggugagcagaauaagaggaggcauggggaaacagagaggaggguugggauguaugaagaaaaccaggagcaucugaugccauggcaggcagcagaugaggacauuucuagaggaaagugcuuacgaggcaagcaguagagagcaguagaaaaauggcaauagagugggaguucuaagaguauugguaguuuuuuuaaaaaaaauuauauaugcuaaagauugcucagggacgguguggggcagguuucucaagcucggcacugucaacaucuuggaugaaggaauucuuuguggugggguugucaugugcacuggaggauguuuaguagcaaucuaaugcaugacuacuaaaucccagcaaucuaaucccuggccucuacccacuagaugccagaagcgcccgcucccucagagaugugacaaccaaaaucaucuccagaccuuuccaaauacacccuaggagacaaaauugcucgguggagaagcaguccugugaggauaggaggaggcguggaggaaagcuuuguccccagcagccccagggcagcaaggcagcucucccaccaccaccuccccaggagggccacacgagggucacggggggagcagggaggcagaagcugucugccauugugucuggcccagugacccuguucugaccgagcacaagcggagccccugccuagccgaggugacccaaaaaccaaagccucuuuauccuccugggcaauucccuccccaccaccucccaagaugcuugcagcuccagcuccugucagcccugccccuccuguccuuggaugccucccauuucaggucuuucccucucucacucagugauuccugcauucauucaucaauguucccagcacaccuauaagcuuagaggaacugacuuaccuuuccucuuuauccuucuaauccuaguuagauuucucuucuuuucuguguuuaucuuuuugccucucuuucccucccuucauucuuuuuauuacuuuuauuaccuuccuccuguuucuuucucucucucacacacacacacgcuuuuucucucuccuccucuccuucuuucucucucuuuucucugagcuuccaucugucuuuccaucccuucccugucugccuguucccuccucuccucaugcacauguguguuuggaugggacaggccuccucuccacugcaucuuguuccaucuuucugugggcaguucugucuuaacagcuuuuaaccugcuuuggucucgagcucaccaccauuuuccguuuuucagauaguuagagagcacuuacuaucuucuagaugcgggagauacaugcaucaauaggaacauccaagaguggguaguugaguuggcugacagucaaaugaccacacagacucacauuaacuaagggcuuuagcuuacuaaaggccagggacagccugggugcuuucauaggcgugaagucaucuuuucuaucauggcacuagaaagagaugguauagccaaccccaugugcagguggggauccugaggcaaggaggugugagcuagcuuauuggaaguuacauagccagcaaguagcagugcugccaguugaacccuggugauuugaauuugaagcccguaaguccuuuuuuuuuuuuuuuuuuuuuuuuuuuuugagacagaauccugcuuuuuagaccaggcuggagugcacgggcacgaucuuggcucacugcaaccucuaccucccagaucaagcaauucuugugacuaaaccuccugaguagcugggauuacagcacaugccaccaugcccgguuaauuuguguauuuuuuaguagagaugggguuucaacauguuagcuaggcuagucucaaacuccugaccucaagugauccaccugcuuuggccucccaaagaagccugugugcccucuuacccacuaugcccucggcaucacugcgacaaaauguuaggugcuggcauguagcuacuugccuuugaacuucccccaaauaaacuuucucucugcagaggcaggagaaugucuuuuaaaacucuuauuccuggucaggcgugguggcuuaugccuguaaucccaacacuuuggaaggcugaggcggguggaucaccugaggucaggaguuugagaccagccugaccaacauggugaaaccucaucucuacuaaaaauacaaaauuagccgggcaugguggcccaugccuguaaucucagcuacuugggaggcugaggcaggagaauaacuuaaaacccaggaggcggagguugcagugagcugagauugugccauugcacuccagccuaggcaacaagagugaaacucugucucaaaaaaaaaaaaaaaagucccauucccagcaccuagcaagaugauugaugcauacucaguaaaaaucuaggccuuauuauuguguugccagccgcacaggcagguguuauuguucuaauagggagacaggcccaggguggguuaucuaagaucacacagcuuguaggugguagagcagaauuugaacugggauccaccugucucuaaagauggguuuccucccaugcuuccacacugccucucuugaucagaaacauacaaggagcugagaacauguccuccacucccuggguaccuuugcugguuagaagccaacuugcuguccuguggggagguacagccaauuucuguguuccucugaguucuggggaccgcagaccuuaguguggugaaagugaggguugggggcuggugggagcuguagauucaugcagauucuguuccccacacacagaugcugugggugagguggaggcauggcacaggaacugcauagccuacacaagccccuggagcccuugcuccaccagcugcggccugggggucuccacucggaucuccaauguuaacgcccagugcuggccugagcaagagagccgccucugcaacuugcggccaugcgauguggacauccauacacucauuaagguggguccagagcagguguggaugucuagacuucacaagcagacaaauauggguuugagccuggcuccugaacuuccucguggggagcauuuguaaagugggaauaguuaagcucaccugguaggucugguguaacagcuauuucggauaaugcaggucaccagauuggugcauugugaauuucagucaauggaagcuuugguagguaucauauuauuagaaucaggaucacuccagagaaaccucagagacccucaggaguggucuucuauaaugauucugagggauccuuaccaauuuccauccucccuucacuccugugccagcccacccccacacagcagccacacugggugauauagagagcacuaaaugaggcucaggaccccuagagucaaaugucugcuugcauuaauugcaugugacuguggccaaucucugcucaucacugagcccccauucccucaucauuaacauauuggaguugaucucugaaaucccuuucagcuuuaagaguccaagauaauuaaaauaaagcaucaaagaaaauugggccacauuaguuugagccccagucucagaguuaaaaguggaucugauuuaucuaauucaaguccuccucacucaugccuuaggaguggucagccuuuugucacaggaaaaacaaagcaaaacaaaaaauucaacaguuauuccauuuuuggaaugcugaugguuucuuagggauguugaggacaggguugccucccauguagaaaagacagcacagcuuccugugauccucuucagacauccaacaucacuccucauccccuagacaccuucuccagucaucuauauauugaucaacuggauccauuuuucuucuuccuucuccuucuucucuucuuucuucuuccucucugauuauuuuucccuguaauacuagcuuuuguauuuucugcgcuugguauacaguaagcauuccauagacaucucuuaacugaaaacguacauggaaaagguaccagcugcagaggaaugacagcagaggucguuagcugagugagauggcucuaccauuacuggaccacguaaugcaaguccaagccaauuuugauuuccaaccaauuuuuuuccagaauuaugugcccucagaggguuucccaaauugggcaagcuucaugccgccauacagccuagaucuagcauacuauuuacacaguagacccugagaacccucaauccaauggguuuaguaagugccuacucuguacuaggcauggaauuauaccacagaaacacagaaagaacaguaaaucucaaguggcccauagcccaguggaagguagcguuaccuuuaaugucaaccauuugaauacguugaauacuaaagguaugugugaaaggccacgagaggcaaaggcaggaggggcgguuagggcaaagcguguccccugaguguggagucccgaugccaguucugccacuagcuagccaggggaacuugcuuggaugaaggagcuacauaggcuccccauguuggugaaaccaugaugaaugacuggccauaggcaagacaaaaaugcaggacaaaagagaaacugcaggcugugagauacaacccaaacaaaacauuuuucucugugguccuccauuuaccccugugcgguaugcuggaucucacuguguuugcuguugucccuccuugcuugaggaugcugugaagcugaaaguaagguggaaugcucccacauagugagaagggaaaaacugggggcucaggggaagaaggugguuguccauucucugagcacucccacugaaagcuccuuuccuuuccuucaggcagggaagaagugucuggcuguguaccagccagaggcauccaugaacuucacacuugcgggcugcaucagcacacgcuccuaucaacccaaguacuguggaguuugcauggacaauaggugcugcauccccuacaagucuaagacuaucgacguguccuuccaguguccugaugggcuuggcuucucccgccagguccuauggauuaaugccugcuucuguaaccugagcuguaggaaucccaaugacaucuuugcugacuuggaauccuacccugacuucucagaaauugccaacuaggcaggcacaaaucuugggucuuggggacuaacccaaugccugugaagcagucagcccuuauggccaauaacuuuucaccaaugagccuuaguuacccugaucuggacccuuggccuccauuucugucucuaaccauucaaaugacgccugauggugcugcucaggcccaugcuaugaguuuucuccuugauaucauucagcaucuacucuaaagaaaaaugccugucucuagcuguucuggacuacacccaagccugauccagccuuuccaagucacuagaaguccugcuggaucuugccuaaaucccaagaaauggaaucagguagacuuuuaauaucacuaauuucuucuuuagaugccaaaccacaagacucuuuggguccauucagaugaauagauggaauuuggaacaauagaauaaucuauuauuuggagccugccaagagguacuguaauggguaauucugacgucagcgcaccaaaacuauccugauuccaaauauguaugcaccucaaggucaucaaacauuugccaagugaguugaauaguugcuuaauuuugauuuuuaauggaaaguuguauccauuaaccugggcauuguugagguuaaguuucucuucaccccuacacugugaaggguacagauuagguuugucccagucagaaauaaaauuugauaaacauuccuguugaugggaaaagcccccaguuaauacuccagagacagggaaaggucagcccguuucagaaggaccaauugacucucacacugaaucagcugcugacuggcagggcuuugggcaguuggccaggcucuuccuugaaucuucucccuuguccugcuugggguucauaggaauugguaaggccucuggacuggccugucuggccccugagaguggugcccuggaacacuccucuacucuuacagagccuugagagacccagcugcagaccaugccagacccacugaaaugaccaagacagguucagguaggggugugggucaaaccaagaagugggugcccuugguagcagccuggggugaccucuagagcuggaggcugugggacuccaggggcccccguguucaggacacaucuauugcagagacucauuucacagccuuucguucugcugaccaaauggccaguuuucugguaggaagauggagguuuaccgguuguuuagaaacagaaauagacuuaauaaagguuuaaagcugaagagguugaagcuaaaaggaaaagguuguuguuaaugaauaucaggcuauuauuuauuguauuaggaaaauauaauauuuacuguuagaauucuuuuauuuagggccuuuucugugccagacauugcucucagugcuuugcauguauuagcucacugaaucuucacgacaauguugagaaguucccauuauuauuucuguucuuacaaaugugaaacggaagcucauagaggugagaaaacucaaccagagucacccaguuggugacugggaaaguuaggauucagaucgaaauuggacugucuuuauaacccauauuuucccccuguuuuuagagcuuccaaaugugucagaauaggaaaacauugcaauaaauggcuugauuuuuuaaugucauuuuucccucuuauagucuuucuagcuccuuuucaaaagacgagaauaucugauuuucugauaauuuaggugcuuaagcauccaaaauacaugggacacacaaaaauccaggaauccccuguagcuuauucccucuuucccaucggaaccagcucucaucacacauuuaaaagaugauucuguuuacccaaugcugcauauugaauguuguguaguuauucacagggaauucugugcagugugcagagagauuccuaaacgggaaaaggacugggaauacauccuccuuacugugaccuccccaaaaccuaguccagugcaagguauacaguggugcucauuaaauacuugaugaauacaggaagcugugcauguguuccuacuuuuauucgaagcucucuucuuccaaagcuacaugaaaauagaauuuuaacagucaaaauuuuauauuaagugccuuagcaaaagagacauuuaauauuucaaagaaaugcauauguauguauacauauauuuguguaugcguaugcaagaauucuuguauaaagagaauucacuccaugaaugaucucuucuguaagucagugugaaucauguuagauuuucugagagugaaaacaccugccaucuacaaauuacaaggcuggauaacagcucacuccauuugaaauucaguggaaacccaagagcuagguucuuacugaauuugcaucucaauuugggaaacugaacuuagcuuucaaagaucauaggaagucugguuggagaaacuagggauuauucuggcaaugggugcaggaagguggucagaauaacccagucgccauugguuuugagaaacggaacuaucuuaugcagagcccggagggcaagucucagacccauggguugaagccauggagaaggaaauuuggauccaauguaaugaagcgcuuucuaagucagaauuucccugcaaugguguggccugauucaauaaaaauuaagaauaauaaauauaauggaaaaaaaucuccacugauugaguguuuacuuggugccaagcacuaugcuaaguuguucauuauuuuauuuaauuguuacagcaauuuugaguaugcaucuuucacuauuuuauaaguggaaaagagaagugcccccaaaaaguuagagcucaaacagcagcuuauucuaccagccccugcucuugcggaggccucuggaaaagaccugaaugacaccuauuggagaauuacaucuacaaggggcuucaaacagaccaaauagaucaucaccucuguggucccuuguuaacuauauguucugagacaaaggaaagcuacccuaaggguuaguuaaccuuugcugaggaaauuuacauucauacuuagagugaauuacucaggugugcuuaggugugcaaaagggaaggagaccugaauucaccaaguuaaaucuugcuaaaccuuaucauaagcauuuuuugagcgcuuagcauacaccaagccuuguggaaggugcuuuccugccauaucucauuuaauccucacagcaaaccuauagaauauggcauuaucaucugagucucacagaaguuuagucguguacucaaggucuuaccagcuagugaacagcagaccaagacuggaaacccaggauagucugauaccugagccaucucuucuugugcuacgccuaguuauucugucccccaaaucaaaaggcaugaccuuuauaagaggcgcuuuacugacaauagcugcaauuuuaacuuugaaaaugauucagaauuaucaaagauaguagauucgaaugacaugauugucuauaaucucgcuagccuuguacugugugugcauagcaauuacagggaaguaaucuagcuccugacuauuauguugaacuaugucgcugcuuuuuacaaacuugucuugauccaaagcagucacaaugauaacccugcauaucugggaaucauaagucaacuauguaucccuguguguguauauauauguauguauguaucuauuuucaaacugugauuuaauauuuaaauauuccuacugccauuuuugugacugaaaaacuacacaugaggaaacgucuuagaauuuuccaauagaggaaaaauaacacuugggcaaucugucauguuucacaacaguucucauuuuucucaugauuuguguagcguggaauguguuugcucaaugugaaggguuuucauugcucaauuucucuguguaagucuuuuccuuaagguaauaaaccaucagcaaagucacauacuggaguug

SEQ ID NO: 17798 - RNA, 60092 nt, Homo sapiens
gacguaaacaaaccucgccuggcucccagcuggugcugaagcucgucaguucaccauccgcccucggcuuccgcggggcgcugggccgccagccucggcaccguccuuuccuuucucccucgcguuagguaagcccgcgcccucuucucccaggcgcgacgcggagcagaaaggggccgcccgugcggugccgcuggagcgccaggaccgcccuuuguagccccgcguacuccaggaguaagcgccccggagcugcaagugcgcggucaccccggggcgcgggcgcgagggggcuuugggugcagacaccgcugaagugggggguucaauuacggaaagggaggaaaaaaagacagggucccauucaucuccccccuagcuggggauugggguucuggaggucgggaagggggcgaugagacgguccgaaaaaauaccaggauagcguuuccuggcgucgucuccgaaucccagcuggcgccgcuggcaggggugcgcgcuggacgugggugcagaagggacuaggugagugugugugugugugugugugugugugugugugugugucugugucugggaacggagagauugcgcgcgaguguguagaugagggguugguagaggugaguggcgcuggcaaggaggcuggagaggggggcgugggugugucuggcuugcagacugggucgggaacggguguggauccgagaggcugguggcgcuucagucccguagcacacacagggcggugugcaugugugaguguaagcguguguguggggggaggguccagggugugucacagugcaacacgcgagccggagcaagugucugcgagcgccacugggcagggugcgcccccggaggaacccgggauuggcgcaucggcggcgugggagaagugaccugggcgagaggggucucgcggacauuuggcggccccuugagcuggcuggagcuaggaguggcgucauuuucgccuccgcccacccucccccgcuuuccuccccuccccugccucuggugcuggccgcuccugcccuccacgggggaaaacagcuggaauuacuucgacguuccugggggauccgccgcggucucugauucagccucgggaggagauuucgggcugggcuuggggaaugcggcugguucugggggaaacacgcugucacgccucugucaaauuaguagcuggagcugggauuuagugggucgguuccuuacccaccccucccccauaucccccgccuguugucccugcugucccuggggguccugaacagcacgccucuguggcuuggaagugggagaugccuggcagugggugggggaggcagggcccuugguuaucuuaugcccauccaagaacaccccuuccucacggacgcugggggcacuucaguuuguuugguuucuuuaagcuacugggaaauaucuaauauucagaagucagccaguggccaggcaggagggcgguagacauccuuauaauacccaucagcugcacgggaccuucuccuaagcugccucaaaagaacauaucuaaauacaaacccccuguucuugcugcagaaauguaguuucaaggcgaauuuuucagucuagacucuuccuguugagaaauucuggcguucuuauugaguuucacaaaugugauugaaauaagcaagguacagagggggcaaaccccagcgccuuucuuggaagggcugccuucugguggggaagacacacggcuggagacgcagaccgguucugugugguguguguggcggcagagccagccccaggcugggguggcacagugucggggaugaaggaagguguaagggagagagaggguuuugguguggauggaaaacuggguguuccccugaccugugacuucuuagcuuugugggaccgugucucccacugcaucugggcaaggaggaggauuugccugcccugcccuguaaccuggccccuggcccagcgccuggcaggugggaggaguugaaauaugcacaugggaugaaguggauggcucugggucuucugccccauucuccugugaaccagcagguugaguuucgggcgagguaauagacugugcauggguggagguguuggcuuuugcuuuugagggauccuggagugucuguuugggucucuugugaggaaguucuuuuggagcaacaaaguuugaucauuuggaauggaauaaaaaacucacacaggaccuaccuaguccaacuucuuuccauuuuacagauggaaaaugaggcacagggauggggagggaugugcccaggccgaacugagcuggagcucagcuuugugagaggcuccugggugggacugaaggcaguggaaaggguuccuggcaggauuuugccugccugcuauggaggggcgaaaggaaauugcaucuucauugaauuucuggugaggaaacuuuugaggccaaaggggcagagcggaaugauuuuuuuuaaguguaaaucagguguucuugagagauuagcaaagccagccugaagggcaggggcuuagaggcugcagcccccugaguuggccuuugacugaauggggcugccccccccccaugacagaagacagaucucaacugagcugagggccccccuggguuacguugaaauccgcuggccugaacuugccuccucauggaccugaaagaaagauagcauuguguuuuucggguggcccaaagcugcaguucuuccuugggacccaaccccagagaaucccauuccagaugugacucagaggccuuguccugggagagaaagcgugaugacucagcaucugagacucaagcaggguucagguuugacucagccuggaaggaaggccagggagggacacgacaucucucucccuccagagcagccacugucucccuccaucugccuucauccucgcaagaacguugccuggaucguauugcuccauugaauggaugaggcaacugaggccaggagaguuucaggauuugccuguugccauauggcucaggugggagagccagacuuugaacccggacaguuggacuucagagccuuuguuuuuuuuccaugacaacauguuggggcgccugaagaaaucaggcucaaaugaaaaggcagucaggagcuccaugccucaguuugcuuuucuguaaaaugagaguaacagacaugaugccaucagaauguguaaauauuaaucuguguaaccugagaacagcacugagcauguggaaaacagcguguagguguuugccgucaguagcacccgcagaagacauucucaaggcaucuucuuggcaggcagagucugggacccuuuguccuaaaccuacccaaggcugugaaagugccugcaaaugcuugaccuagguauugcuuuuugcuaagcuuauguagguugcauaauagugucaugaaaaucuugucugaaaugcacauuuccaggcccggucuccugcgauucucucuccaucaggggauaugcuguuguuucaaagcuccuuuggcuggguugggaaugggguauccugcaggcagacagaguugagaaccucugcucuggaaugacaggggagagaagaaggaagguguagucauacaugccgcuguaccuucaggccacccuguguccacagugccagggaauuagugagugcucaguaaauagcucuuguuugcuauagugccuuggagguucaaugcaucacaucagcuaacugagguagaagacauucuuuccaccucucaggucagaaaauugaggcucaggcuggugacucuucuguccagaguccagugagugggguucugcccaaggugagccuccugagcccuuuccacccuccaacauugcgcuuggaggccacccacacccucugggcccaccuuuugagaaggagcuuguuuccuggauccaccccaggcuguuguuccugccucccuugauggcugugugauggaaguaccgcguguccacuugcuuuuuaucuuucaacuuggagauagaggcaggcuagauagcggucuuggcugagaacuuagcccaggcagguaggcagaagggcuggggacacugaggccccacaggaaggcggcugcagagguagagggccaugaguaggugccaaccuggagccguguucucggggugggggccaugugaaaagaaaccugggcucccucggguggggcguaagccccagcacuacagaaugggaauggauuacacaaucggggccauaagcaggucucuuugacccagaucuuugacuuucccaccuaacauuguuugcagaccugccuaugcccuaccugccugggcuccaucucugaccuuuugaguccagcggguuuucuugcaacugagcugguagaaagugaggcuccuuaacagucugggggccuugagugcccuccccagcaguuuaaucuuuccuuucuuuaaaucuguggggagacuuucugcagcuauacauuuuaaaucugcauagaguucuguuugaagagaggugggugggggcccaggucuccaccuuguucuccugccuucacccucugccccacccccacggaaccuaagaagauuccaaguaacccucuucaaauauggaugugagagggccauuuaagaggugggucuauggccucucucagcugggaaugcuuaccaucucuccuuccuccuuuuuaaucauggaacucuccuccuuucuccagaaaggccuccuuggcuguccucugcuggaggggaggcuggguuggguccuuccugggaccuguccaugucucccaugaaaccugagagccuguccuuaguagguguuguguuaguggugguggaaaggacaucuccacugauuaaggaaguaacuuggaccaucuugcauagacaagaucggaggcccauuccggaggguggaaacugcaagaccauucuggggaaggauccuguuagcguggcuagcaucccaucucgggacaaaggguucuguaugaggaagccauuuccucguccucugcuaacacuggcuccguuugugugauuuccacaaauuaucucagaccauccagcgcagcucaugccugucuugcaauuucacaaaauaauccucuaaggagaccaguguccuccuuuggacuuccaguuauucaccucguccccucagacggucgucuucugucugccaaacaaauuacucgugcugccaaaacuccacugagaaucuccaggaagaucucgguuguauugcagaaaagaggugggcccugacgagauuccugacaccucccucuuccugcuguuguguuugggacacucuugcugaccucccuggugcugugcucaaguugaacacacagcaguucaguuucagcuccagccccucuggacccacacccagggagugaaugcggcuuuggcuuguuugagagggagacagugggguucaccuucuuagugaucccuuuuucauuccuugaauaucaaacaucacugaugccuccuggguuucaggcuccacugcaaaguacaggggcccucgaggaguuccuacugugguuuuguucucugacauuuguacuguuuccuugauucugauugcucugauacaguucccuaaccucuaaacuagggaacuuucuugaagguccagugaauccacccauauuguuugcugaguugauuaguuaagaaagacaguucgugaagacugccaacuuccucacccuccccagggccuugaguuucagaagggccagaaaacaccaagagagcccaugaacugcuuuguagcuugacuucaaaaucucuuugggcaaagaaaugacaaaggauuguauccacaguaaggcagggcuauccagggccuaucucaaggugguuuuccuugagguucaggcagaaauggugcuguucucggcaauuuucuggggaaguugcuacagcaaacagccacagcacauguugauuuuuucccuccuuuuaaaaaucuguucuauaaagagcacaaugugcuggagagaacacuggcuuucauguggccuuaaaaccaggcauguuacagaggguggaaucugggccaguugcuguuggugacaaucgaugcuacccuugucagcaauucccgccugcucucccuuuaucugcuucacugaaggccuccaggggacuguuguccgcccucccccgagggaaugagugccacaccugcacccacaacaaaccagugaguuuuucaccuuucccucaguagggaggaaucuagacauguggccuuuggaagucaagugggccuuuguguuuguuuuugagccucagguuacccauuugugaacuggguauaauacccagccucucccggggcaaccuccuugaggagcaagugaaacagugugcugagugaaugcuuuuccaaagcauugaguuggccgucuuaggaagguacuaugggggagcugaaaacagagaaccuucuggguguugugaagggagaaaaguucaagaugcugguuuugccaaaagcucaagccugcucaugauggcucaguggugacugcaggguggaggagaggcaugugacugucccagcugaccuccacacgcugaaagccucauggucacgugcagcccaccuuacaacguuguaucugggccacgggugguggugaggacuguggauauauuuagggcaaugugagaucauugucaacauucccuuuaagguugcuuuaaccuuaaagcagccagcuugaugcuugcugacuuggggcacacaucuuaaccucuugaugccucaguuuccccgucuguuaaauggugacaugcuggcaccucccuccuaggguuucugugaggcuuaaaggaaguaccggguuuagaguccaguuagugccacagauacuguuccuggugcuguuuuuguggugugucuguguaggguuacauuguugccuuccuguggcugcucuuccuggugggcggaaccuggaacuucuagaacagaucauggauguuucucugcuggauaccccuucagccucacccugugggaguuguggcggggcccaggagaguuugcucaagagggugugcagguggguggcagagcuggagcaaggcacuagucuuaacagacaggagucugaggcuggcagaagugggggccuugguccaaggugcggggcuaaucuggccagagcugagccuggcagggccuugguaagacccuguggcccuuuugucuuggugaagcaccuuccugccuggguuuccauuugccuguaaguuuguuguggacagcgugaucuccauagacguacacugugccuacuuuacagauggagaaaccaaggcccagagaggaagugacuugcucagagucauggaauaggaaaguggcaggguccccaugcccugauuccuaggccagcguuccugcugccccacugagguuuuugggaaucacaggcucugugugucccccucagucccccaggggcuguugaacaguucucaaguggugucggauuacugaagaugccucugcccacugcccucccaggucccagggucacgggucacguucuuuucuuccucgggcagauccuggccuuggcuuugccuggcaccugugauccagcucuccucugacucuccugggucugcuggacuggaaggguauuuguguagccccucuugggcccucauuacucauugacagacagugcugguggagagaagggccccaguggugacgcacugggccugauaaucagaaaccuugguggcauuugcugagcauuuuccaugugucccucuccucgcugggacucuaggacugaaacccaggccacauccucacagauguccuggcaucuccaaggcaacccugaaaggaaaguauguugaugaauuaagcaacuguuugcuuaauucuccaugccauucuugaauuuaagccccacugcugaucauugggagcaggaguuagcaugcccauugacagacaagcaaacugaggcaaagagguuagauagccaggcaugguggcauaugccuguaaucucagcuacucaggaggccggaguaggaggaucacuugaacccaggaguuugagaccagucugggcaacauagcaagacccugucucucuaaaaaacaagaugaauaauacauuuuuaaaaagagauucgauaaauuaugcaggaucacagagcuaauaaauggugacaccauggccugcaagccuucccccagcuccuggcuaccuuucgcuucucuggcauuggucuucucggaauuccucccaggcagguggaugggaaaagaagugaagauacaggcuggcagcuggugcugugaccuggagcccuguuuuuggugcuaagcuggguuuuagcugaaggagaccugcuggagggguuucuucugugcuucuuggggagcaaagauggccuuggagauggagacacgguuugucagucccaagccacuccaaagguggggcuggugggcuaggagucagcccugguucccccgccaugcuguguguggcccugccuugccaccccaccugcuggaggaccucuuugaugcuuucuagugggucccaacauucugugauuaggacuuugcaugaggcagagggagggcaggagcuggaguccagcaaggaccucaagcccagggacaggcuccaccugccacacuugcuaagccgugagggccucaggugcccgggaggagggagcaggaguggaagcaccagcucgagccgccaaaccaggucacguaucaccugccauuuccugcuggcagaaggagaucacagacaccagaagacagcagcuucugccagaacuggguccuuccaugauucucagguggugacuuugaaucccagaaaaaguguuuuggggagaguggagugaaggaagagugugaacauuggaucugacuccacuccagccccugugcugcagccagcagggugagcucaggacagcuggcagccgcuugggcccagcccccuccuccgugaaugaaggugguggggagugcacgugugcgugugagugcgugugaguauaaaugacuguggaugugagaguccaugaaagugagaauguaucaguguguaagaaagugugaguaugugagaaugaguguguuugugagaauguauguaugugugaguauaagugugugaaugugagaaugucugagugugagaaugaaaguuugcaagugugucagugugagggaaugugugagugcauuugagagugugugugugugugugugcgugugugcacgcaugcacuagauuaaauaagaaugcauccaacugacauuuucuggauacuguuaccuacuaggaauuacuaaaaucagcuauuccagaggaggguggaugucgcaccaggggacauuuggcaacguuugcagauucuuuugcuggucgcagcgugggguguaugcugugggcauguggugggcagaggccagggaugcugcugagccuccucccgugcucagggcagccccuaaggcagaggcugcuuguggggcccaaaugucagcagugcugagcugaggaucucuguccaggaggcacagacgcuguccuggaugcuguccagacagcaucugcucugcccuccagggggacagacagacaguggacacagcccagaugcagccugaugagugagcccaagggagugccuguccccucgggacugugagcuccgugggggcaggaacugggucuguuugcucaugauccccagaugagucccauagccagucucaucaccauagcugguguuauuuuuguucugagcucuguguugggcacauagaaccuaguggguagaaaccucugaauaaauccugaguuuuccauccugcuuccgugaacucagauguucuuugagggccagccugguggcgugggggcugggagugggcagauuguagggagccaaguccugggguggagugggguucaggccccuuucccuggcuugagccgaagcaccuuggcuuuuuaaauuuuaaaauuuuuauuuuuuaacauuuuuauauguugaacuuccuuacaugauuuccuuuggauaaaagcuccugcaaaaaaaguuugaaaaguuuuuugguugaggcaucagggacaagguaagggcugcuugaugggcccaacucgggagaacugaggugagggagccgcucuccucccacccuacaggcuggccagaugguggaccgccagcagcuggcugggucaaccugcagagagcaccuucugcaguccuugguucaugcggccuuaguauugcaggacgcgaccaacaugcaggcuaccccgaggccugcagcccccacaguccccccagacuagugcaaagcuuuauccagucucccggcagacuucagagucuaggacacuuccuaaaugguucaaaaucaauggaaucauuugggggacaauaaauaaugucacuagacauugccaaauguccccugggagagaaaauccccccuaguuuagauauaccccgugaucauccucagcaguuuuaucucuggacuucccaaaggccuuuagcagugagggggcugggucagagaaggccccaccagcucccaaaagcagaugcucaagaacuugauauuucuaggacacacagcgauuuuuuuaacccauugccucauguggucugggaagcuaagcuguaggaauaaaaaaggugccggguaggguaaagagguuucaccagauagaggaaacggggaagguggacauuucugucuuuucuguucuggagaacgagagagcugguggagacugacagacacuauguccuaaugugaucacgguuucuggaagccaaagagaacugaccaaacugggcugaaccacagcauuucucgaguccuuuuaaauguagaauuuguuuuccagacauugcacucuugggguuuagcaaugauuuaaaagugaauuuuacugaaagcaugcuguugagcuacauugcucauuuauucagagagggaguugcagccugacuuucugccuaggagagucucucgugcugggagcuagagguagagaaaagaacaagcuaccugcuugaugaagcucacagauaggacugcuugaacccaccuggugggacagugagagcccccugacuucacccuggcgcgcuuugcugagcaggguaugcuaagaagcuccugugaaaugagaaguccuuucacucccagaaugagggguggcguuggcagggcccuggguuucuggaaggcucccuaggccauguaggcgaggugucccacaggccagggucuugggaccacgaaccugcugaauuagcaaggcuaacagacgcgggccuuucaugccuccugccuccaagcuggcagcugcccaggaaugcucacaaauauaaaaccgacuuuguuuucagaauguucuggagcauagacuccaaagucuguauaaagccauucuuguggggcugguuaucuacuggggaaaaucaugcuggggccccagaccagagcaccccaguggagagcaggaucugcccacggaaugccauguguuggcacaagggauggacccgggguggauucgggguggcccgcacuugccggcugaccucuaagagguguuucaccagguucuugggaguuccugggucuucagaggagcccuaggcaggaauuucagaggcuugcauucucucgaccauugcauccgaggggccuugggcagugcggggcccagguucccacucugaagcuggcugugugagggcuuuggucaggcguuuuccauucagaaagucuggaucugugaacuggguggguggccugggcucuucccucuugucacuuacuucuucuccgccgguccucugcugcugucuguaagacuugaccuuauucugcauuuuuuaugcuucaccccagggauugaugggcauuuaguuuuucuaacuugacuacugaucuagaagaauacaugcuuauacuucugguuucuagauucagcucuuggaggcaugcuuaauagauagcaccaccugcccaagccuugcaccccagggagucaguggcagcauuccaagucuuccugggcugugcuucagucugguuuugcagcccacacuucugcaccugcccuguguuagagcacagguaaccccucugguccauccccugcuuugauccaggaagugcuuucugccuuggaggucuuuuuucuuacaaaauuguacugugcguucaaaugccugccaaacuccuugacuuaagguuuuccucugccccucuucccuuuuagcaggcagccgagaguccugcaccgugggguguguauguguguucacgcgcaugcgugugccugugugucugugcgucugcaucaccaaccuucuguuagggcuaacugugaggcugaagcuugcacuaugccuauacgugguaagcaucgugugagcuuguguuccccuuucauugucacacgggggcugccugacuuugggaucagcaaugcagguccccuucuagaaugcagugagcugcauccuggguauggugggugggccugaacuugguauggggaccuguuugugaggcugaucuauccauuucauugggaggguggugucugugagccucaguauccucucccaggaaauccacugcgcuggccccaaugggaagacuggguuggguccaugggcuguguguacaagggaccuccucauccccugcagugcaucacgagggaggugaagcugcugggcagagcgcaggccuggccuucuugccauuggucuuggauuugcuuccuuuaggaaaccucucagcaggaaguguugaccuuuuggccuuugucuccuugcaggcaggugacagcagggacaugucucgggagaugcaggauguagaccucgcugaggugaagccuuugguggagaaaggggaggugaguggagaucuuccuggcuaccccaucacaggcacaugugcacauagacacacacaggcacaccggagcucacacuuguacuuaugggcaugcaaacacugcacaaauacacauguauacagcauacacacggcauacaaacaugcugcacacacauguacauagcauacagacacacaugcguacacacauaacacauuuguccacugcuuccuugaaaugcaaaguugugagaggcucugguucaagucccauaggaucgagggcugggccccuugcccacuucucugggccuuucugcucucauuuguaaagugaagacaucgaaccagagguucucucagcuuucccgucucuaacauucugugguuauagaacaugcaacauggggcccaguugcccauagggacugccugccucagcucucauuaaagccacauacucuggggccgcacugucugggcuuaaaucccagcugugacacuuugcagcuugguguccacuugcuaaccucucaguaucuucauauucuaguucuucaucuguaaaauggugacauuaggacuuaccucauggggccaagugaggauggagugaccuaauucauagggaacaguuagaacuuugccauagaggagaugggcaaugcauagucacuuuuucacuugcuauuauuaucuuuuugggcaaaccucuucugucaacagagcucuuccuguuggaaacagaagccccugucuauaggcugggcuggcagggcccagccugggcugauuguucugaagaugaaugaaccuuuacauuugcacaguugacaccguagcuucaaagcauguuuacaucccaauucucacuuagccucauaacugccucugauaugucuuuuuaaaaauguggaagcuuugguccaaaagugaaguuagucuaaagccaacuaaaugcuuuuaaaagugauaauuaccaugcacuaaccacauccugcaugccugcuucuccgccgaccguauuucaacuuugguucaugcaggucccagguucugugaucguacucauuuuguagaggaggaaguugggucuuagggagguuaauuugucuucuuugcauaguuacaaagugugggacauggaaucaaacccaggccagcggacguuggugaauagacuguucauuuaauuuccuuaugacucuacauguggcugcucuguuuuagguucauaauuucauagacuuuucuuuacaaaugugugaggcaaccaucucuuuuccccuuuugcagauuuaaaaauaaaaacaaacugguccuagacaggaaggggauuggucaaguucauccagauagcugguacaacuagaguuagaaaccaagccuggggaggcuacagaugcuugcuuaucauuccacacuaaggucugcaaaccuuuucugcaaagggucaaauaguaaauaucuuaggcauugaaggccacaugaccucuguugcaacugcucaacuuugccauuauagcaagaaagcaaccauagacaguauacaagugaauguacuuaauguguuccaacaaaaauuuaaaauguggugaggcggauugcagugugccaaccccuacuguauacuaugcaauuucuaaaucuguguccucuaaacucugggucugugacauagucuucugaaauagucaaacagaaacuucuagauagaacaaauacauaucaccauauucuuauuucucccuuuuaaaaaacccugugaaaauaguaucccacacuuugcuuuauucacuugacauuucugggagaucuuuucaacaucaguccauaauccacuugcuuuucucuuuuuagguacauaguauuccacuacauguauuugcccagugcccaguauaugaacacaugugucuuuccagccuuuugcuauuacagacagcacugcaagaaauuugcacccuuguaucuuucaugugugucauuacauacaugugcagguacagcccuagaaaaaaguucucagaaguggcaucgcuggguccaaggguaaaugcauuuaaaacaacauuuuuuauuuauuucgggcagccuacuggaauccuuagaacauuuuauguaugaaacacaugucuaagagcuugcccauucaggguuacaugccagugcaucucucagugaauauuuacccuuucuuucaagguuuagacggaaauaaauuucuuucaauuccuuagauugacucagcaaaguauuuagaguuaggcuugacuauugggaaguucuuccuugugucuguccucaaucuagauugccacuauacucugaugacguuuugaagguugguguuugcuguacagaauggcuuuccccauucuuucccaccaguacacacucacaugcacauauacacacacagggcaaugguauaggugccagccacguuuguuuccacuugaauuuacccaaagucccugauguucuugcccacagcucaggggauguggggcuauuugaauccccagcacgagggccuguguugucaucuagucuuccaaucccugccaucuaaugggagcuccauuccaucauccuguuccccucaucgcuucugcauuucgcucugcugagccgucuuguuuucuggggguuuguggugggugaggcuggggcucaguuuucacaguguugggacuccaucucugggucaguaggaaaacaugccagcaacaucucuuagaaauguuggccagccaagacuccaguugguccuccgagucacacuuucaccaggccagaggggacacaagacuuuucucugucuuccugggccuguccugccauggacagcucugguaaaagauagaauuugggcugaaacucagauuuuuuuuuuuuuuuuuugagacggaguuucacucuuguugcccaggcuggagugccauggugugaucuaggcucacugcaaccucugucuccuggguucaaggaauucuccugccuuagccucccgaguagcugggauuacaggcaugcgccaucaugccuggcuaauuuuguauuuuuaguagagacgggguuucuccaugcuggucaagcuggucuugaacuccugaccucaggugaucccgccugccucagccucccaaagugcugagauuacaggcgugagccacagcacccagccugaaacucagaauuuuuagauugagggaaaugcuuagaggucuccacugccucuucuacucacaagagacugaaauuuaauccagguccagaugacagcagccauggaaaaaauguaaggaggaccaugauguggucagguuugaguuuuaaaaguauagcacauggguggagccggggagaccaguuaauagucagauaucacauuucuguaucucucaagcuugugaucagcuuagaccuucagcuuuuuaucuaucaaggcuauugucagaaaggaguccaguuaaugugucugcuuuucugcuggacuucuauuuugagaugaaaaggaaagucucggcugggcacaguggcucacaccuguaauccccagcacuuugggaggccgaggcagguggaucaugaggucaggaaaucgagaccauccuggcuaacauggugaaaucccgucucuacuaaaaauacaaaaaauaaaaauaaaaauaacugggcgugguggcgggcaccuguagucccagcuacucaggaggcugaggcaggagaauggcgugacccugggaggcggagcuugcagugagcugcgaucacaccacuguacucuaaccugggcgacagagcaagacuccgucucaaaaaaaaaaaaaaaagagaaaaggaaagccugccuuugugaggaauuaaggagaccccacaaaggaggaaguguagguacagauucaggucauagaaaggcccauaugucccaauauuauuucucuuacagagaaaacagaugaaauugacaauuuuuuuugucuuuucacagaccaucaccggccuccugcaagaguuugauguccaggcaaguagaggauguggcuuuccuuccccuuccucaucccgucuucucuuuuuccuuuuucuuuccauugguuuaaguagaucauugugcaaacauugcgggcaaggggagagaaggcaguggucucagcuagguccucacccucagcugcugcucccagacagaagcugacuugagugcuggccaaagaaucaggaaccagucacuucccacgaaagcaggacagagacaccgccuguuucagucccaaagagcuggccagaacgguggggcguguguggggaaaauggugugaugcugggcuggcuugggacccugugaggggagggaacggaagcaaaagcuugauguucuuggcuccacuugggaaacugaaaccagccuucucugugguuuacuggcccagaacugaaguaucuccauucccacucaggauugcagggugggccagggggugcaccucagcuguguccaagaauaggcucucaggagaacgggcugggcucucucagccgagggcugggucagaacuucaggaaaucuaaguccuggacucguuagccccaagcuggggugggucccaugcugugcuggccucuggaggguggggcagaaagccugagcauauggcgagcuuguggucuccuugaaggaggagaggcgcacuccuggaccagccagagagccagagguggcugagguguucucaccugaaccgcuacccauguguugcacagguguccccaguuugggacccauucugcacucugcaucucacuccucuauucuaccuccuuaccucaaaacaacuccgcuuuuccucuugaaucucugauuucaugaaugcucccccauccaucccgaggcgaggaaucuugcacugucuuuggaaggaaaggaaaggaugggagaggggcuggaagcauuggcuaguagaugaucgaggcuuucuauaccaccaccaagguguguauuuucucaucauccugguugugucaggcugucccuagagaucacccugaccucaguguuuaagaagaagggccagaugcaguggcucaugccuguaauccuagcacuuuggaaggccgaggcaggcagaucaccugaggucaggagcucgaggccagccuggccaacaaggagaaacccugucucuacuaaaaauacaaaaauuagccaggcauggugguaagcaccuauaaccccagcuacuugggggcugagacaggagaauugcuugaaccugggaggcagagguugcagugagcugagaccacgucguugcacuccagccugggcaacaagagugaaacucugucucaaaaaaaaaaaaaaaaaaaagaagaagagagacagcacugggaagugacuugccuggggucacucagcagugauuggggaaguggugccagacucugggccucaccucuuccagcccugagugcuccccuugcugcuuguguagguuuuaaugauguuggugagggcuucuuaccugccaggugcugugcugagagcuugccagccaauaucucauguaaugccucaauaucucaugauaacaggagaggcaccauuagcuuuauuuuucagauggguauacugaggccagaguggagggacugggagccacaccuagcucugccugaccaggaaggaagcccauguucuucccgcaccacucaugugcugagguccaggcuucucccaugcccuggccagagcuccaucccguuccucucuauguugcaggacgcugggcaugcgaaggugcuccaggagggugggaggugaauguacuaucuugagguuuaucaaguccaagccuucauuuuacagcuggggaaccugagggacagagaaagggggaagucacucauugaggguggcaugguggggcagcuaagaguuaugguagcaauccucuuuuucacccuccugagaaugggaaaaaaugcacccagggaagucagagcugcaauagaugcaguggcuguggcaccagcaccauggccuugguuauuugacugguucucugagcugagaacagcuggaaguuagccccaggggucaucugcucauucagggaugggccgggccaccccagccucccucagccugaucgaagcugcccuugccaaccuucccuguggcugaaaugucagcuccuuguguuccccaggggagcggcuugcuggcacugagguuguaucuuccugcaguggggaugugauuguccauccuccucaggugaaggccccauuccagagccaggaagagugaagcgcaagccccaugggugcccuuuccuggugauugacccuuagcacaagaugcuucaccucuguuuccccaccugugaaauggagacagugcuccaggcuuguuaaguggugguggagagaggacacugacaagggccaaugauguggugcuucccgcaucagugccgggccaaacaucacacacccuauccacuaacuaucauggaguguuuucccgaauuauuuuugcuguuguggaaacauacacguaacauccaauuuaccaacuuaacuacuuuuaaauguacaguuccgucauauuaaguacauucauauuccugugcaaccaucacuaucguccauuuucagaacuguauuuauuuauuuuuauuucuguuuagacagagucuugcucugucauccaggcuggaguguaguggugcgaucuuggcucacugcaaccuuucuuuaccuccuggguucaagcaauucucaugccccagccuccugaguggcugggauuacaggugcccgccaccacaccgggcuaauuuuuguauuuuuaguagagauggguuuuuccauguuggccagucuggucucgaacuccugacuucaagugaucuaccugccucagccucccaaagugcuggaauuacaggcuugagccacuguaccccuggaacuuuaaaaccugcagaacugaaacucugucccauuaaacaacuccucauucuagcuuuaggcagucauccuucuauuuucugucucugugauuuugauuacucuagauuuugauuccucuaaguaccucauacaagugcagucauacacuauauuauuauuauaaaacuguauuaauuugcauugauuuguucuuugccagugucuggcugguauaaguuagcaucguguccucaggguucaucccuguuguagcaggugucagcauuuccuuccuuuuuaaggcugaaucauauucuguuguauguaugccccacauuuugcuuauccauuuguccguugguggacacuuugggcacuuugggcuauugugaauacugcugcugugaacauguguacagauaucucuuugagauccugcuuucaguuuugggggacauauacccagaaguggaauugcuagagguaucaguccauucucaagcugcuauaaggacauaucagaaacuggguaauuuauaaagaaaaagagguuuaauggacucacaguuucacauggcuggggaggccucacauucauggcagaaggugaaggaggaaccaaggcacgccuuacauggcggcaggcaagagugugugugugcaggggaacugccguuuauaaaaccaugagaucucuugcucuuuauaaaaccaugagaucucuugagacucauucacuaucacgagaacagcacaggcaaaaccugaccccaugauucaauuaccucccacugguucccucccacgacacguggggauuaugggagcuacaauucaagaugagauuuggguggggacacagccaaacccuaucacuggaucauaugguuauuuuggauuuuaaaaucuugguuaccaauucugagaaaccuagaaagcauaguuuaucugcucccugcgaagauaauuccucacauuuuuguuucucuggaaagucugcaaaacacuuuuacauucucccaucucaggacacaggcaacugaccuacucccagggaaggucaaccuauguggcucaggcuggggucggcuaaggcgcugccccuuaggacaucauuaaagugggggccacacagagaagccuuuggaaggauagagcagaggucaggauaagauuucccagcauugugcaccagccugggcugagccgucugaguuaauuccccaagcuguccuaugaggucggagcauuuucccuauugugccuuccuuuauuucuuuaacaaaugcccacuuugugccuggcauuaguuuaggugcuggggaugcagugaugagcaugacaggcagugaccuguguuuucaggaaccuaaauucuggaauaauagcucagcacugccgagcacagaaugugucuggcagcaugccaaaugugccccacgugugcuuacggcgauccuguccccauccuacggagagagaggaccugaagcacagagagguuagggaacuugccugagaucgcagagcuggaaaggggaccucaagccauuugcuuccagggcacauauuugaaaccaaucccgauuccucagaagaaagagucaaacaaacauacaaacaagcaaaugugagcauuccagcuucuguaggugcuuugaagauaacagugaagggugauauggagccaggugaugggauagggcauggcuggggugcugucuuagguugaggcuuuuuuuuaaguggugacauugcacugaagucuaaaagauagauagagccagucacgugacaaagagacuggggauagaucauuccaggcagagguaacagcacaagcaaaggccuuucugaucugaauucugaaauuuccaagggcaaaaauguguuauuccuguaagcuguuaacaggcucaguguucccaguaagucacaauauuugagcugaaaucugaguguugaaugacacuuuucaagguuguuaccaaaagaaaaucuuugucuaaaacuguauucauuuagauuuggcuucuuagauuggaagguguuagggacucaagagauugaugaaagcgucccccagauuuucagcagucuccaaaaucuuggguguaggguugcuguagaauuuccuucagaagaugcagugcagugugacgacggaagcucucuggggccugauggguuccagggccaggaacugagaaggacagagcuuuggucaagggggccuacagggcguaucagcccggggacuggucagcauaaucugaccucagauucacaugggaguugcagcaaagcgacaggacagcaccugucugccaugcacuucaguguccucugaugagccaggccagcacugagggccucccacgcccucuugcugaaucuuuggggaccuguaccaucauccuuccuuuacagauaaggaaacugaggcuuucccaggggcggcagcugugaagugagccacauugagcccagggcugucugacguagacaguucucucaaccgugaugcuugaguauagcccuguuccuggaaaggcugaucaagcccuuauggacuagauugugguucaccuuugacacgucugcuugucaaaaaaucuagccaagcagauaaucuaagcaacacuucauugggcuuauguucagccuacugacaaugaguuguuguaggacucaagaguugcugugccuuaauggcaaaugaauuuuaucuauucauuuaguugguuucuuaccugcuuguuaaaauagggcucccuccugggcaguucuugcccugggcauagcuucccuccugguccagucuaaggagucugagucgcuuuauuuuguguaucugaaagcagccgaugucauuccuugaaaaauaauuacugcuucagcacuuugacuaacucaggcagauuccuacuuccuuuaccaauguagucaauaauuuaggcuuuuauuguuuuuguuuuuuaaaugaaucaaaacacacacacugagcccagagcucggcacugaggagcugcuggcggagucugcauugagcugcuggguggccugucucuggagacagcucgccugccagagcagauggcaucaggccuuaucucuccaucacuggcaucgccuuuaggcggucucuuuguuuuguccugggugauguucgggcaaagugauuggugauuugcauaugagguucugccagcgcugucaggcccccaccuggcucugguuccugaaaagauuccagaacccucagggcacggggugggcgggcugcuggccuagguguccggguugcaggaaggacacggucugaucuggcucggcugagaggccuccagcaucagguuuuaggcaauuguguuugcagauuugaugaguagggagggggggaguauuuuggguuccagcuuauuuucuuuggcuagaauucuagaguccaagacuucugcuccaguuggagagcuuuguggaaggccaccugggggagggaagaggaggaagaaugaauauuugcauacucauugucucagggcuucccugcuaaggugagggguguuggccucuuuugcagaugagagacccauuugaagauguuagggaacuugccaaaggguacuguagagauaguccuagacuuagauccaucugcuuccgaaaaauguuauagucauggaagucguaauggcuggccucucuugagcucugcuguacgucagaaaccgugcugggcuauuuuccugcauccgcucaugugauccucaugaaaccuuguugagggagguauccuugccaucuauccuugccauccuuguuuuauguugaagauacgaggcccagaaaaucuggagggauuugcccagugucacgccauggugagauagauggugaaagcugauucaauccacacgucuggagccaaaguucauuuaacgaguuuuggggaagggacagcagaguugacuucaucaccgauaaauuguaccucgugggccgagugacuuucuguggcuucaaauugcuuuuucuguuggauuugcugcuucuaauucccuccaccuggaucuugaguuauucagaugguuagauuugauuugguuuccaugggaaucuguguuugugugcucaccagggcucugugggaaaugagcugaugugacccacagggccuccguguggagugguggagggggcuggggcagcaccagggccgggcagggcucuggaggucuggcucccguucugcugcaaggccucuuguucagcagagcugagcuggucuuagggauguacaaucccauucggugggggggcuguuuucccuccuuuucuuggaagcggaccagcucacagggaaaauggaaauggugaccuuuugcuaauuucucucuuuccacacaguugcuucuuguuuucaugccccaugacugaaggugggcagaacucagacagaagccuggaaauccuaaacucaccauuucccauucucgcccucccccagcccuacuuccuagcaaagccauugggacuuagagcaaacccuuagagugacagauggcaggaacgcucaucuggaucagcacaaaaugagacuuuggaaaauaaacacagcauacuucugcaauucugcuguggguuuccuaggagcacccuccaauggaacaggagagguggggcucauacccaggccuccgagguguguccaggccaggcucugccaggcugaccucacucaucuccuggugucccagaaagggugcagugagcggcagcgagugcagacccagcccugucauuugcuacucgcguguccuuggccacucgcuugaccucccuggggcuuaguuucguaaucugugaaacaguggggagcaucgcugucccugagcacauugcaaacacugaaugcacacagcagcgggcucagcucacaggucuuugucgcccuccccugcuccauggaugauggggucugcuccaucucuucacccuaauccaaacaaagauguucuuccuaauucuuguuuccuuggagaacugaggucuucagcguggguuccaguugcaugcuguauucccaggcugacaccuucugcccacugcagccuguucccugacccucuguaacuuuguuuaauucucuugaccugaugucaacauaaaagaagacuggggaaugaagcgagaagugacaggcccagcuugaccucuugaaggucuuccauugugugaggcuugcaggggagucuuggcuuuggaagcccaaggaccuaucuaucuugaaucuuaauucuguuaucucauugggcaccuauacuucagccccaaaggcuguucaauggcugucaugauauagcacaggagacaaagcuggcuuuaucagacuugcucaguaaguggguggcugucuuuuuaucguguuccuccuggcuacacacacaccuccccugguuaucucugguacuuuauguguucuuuacuccuuuuuuuuuuuuuuuuuuuuuuuuuuuuagacagggucucccuuuguugcccaugcuggaguguaguagugugaucucggcucacugcaacugugaccuccugggcucaagugauccuccuaccucagccucccuaguaguugggacuauaggcgugagccaccaugccuggcuaauuuuauuuuuuguagaaaggaggucucauuauguugcagaugcuggucucaaacucaaaguuacaggugugagccaucacaccuagccuauguuuguuacuuaauggaauggaucauuaagaugaauggcacugcugugucuccaccuccuccuccaugggcauaggcgaugaaccaggaaaauauagggggaggaguguaucauuuuaugaaaagaugguggggagggggcaggccccugacauucucucuugagccucuguucccaugauuugccuuucuugcugccaugggccuugacuuuaugcugaugagccauagucagcuuccuggacagcuguuccagagggcaccguaacugcucuggccaugcuuggaccccacuugcuagacugagggagggucaccaagcccaccaacugacuuagauccuggguaugcggugauccucuuagagccuagaacggucggcaucugcccagggccugcugggaaggaggggauuaccaggggcagcggggagacagucacagcuggccuccagagccccuccggaucauccagagaguugacuuaagccaguggggcuggcccugggagcuucacacuaaucaucucuggagcgguuguccauaacaacugacauggagggaaaugcugcagcuugcaaaacacauucaggucuguaccaugguuuuagucuugggagcaucuuaauggagcaggaggccuugucauugaccucagcuuacaacugauggcagggauugucagagaaggcugauaacuuggccaagggcacguggugguuauaucauuaggauaaguauugcucaaaaaacagugcugugccaaggaaauguuugcuauucucaccaaccuagaaagcuaacaccccagcuaugaaugucacccagcccagcuggaguuaguccuuacagcuuccuacugucaccugagcaugcggcuuugguccucagauugguaggauagccaccgaacccccaagcaucucauccauguuccaaguaggaugcaggcaggagggugaaaggacaagaaucaaaaggucaaguuugacccuuuuuaaaaaacucuccuugaagcuacaggaauuuucugcuggcauuucauuggccagaacugaaccuccugaccaucuuugguuacaagggaggugaguaaggaaggggaccacuuuaucaggcacuuugcugcuuaguacaucaguuggaauucuauccucaaaaagaagggaacaacagauguuugggaugccaaccaacagagucugccauaguuuuaaagcucccaagccaggguugacagccaaagagaugaaaucuuuaaggcaugcuugguguuagguccuguuuccccacuugacagcuuccaggcgguguagaccauagugguacgugccaugguugcuacuugccagcauauaggcaguguagacuguaaaucucuaaguguacccuccgggccagacucugucaauuggagagccagccuuucccucugggaauuggcggccuggcuggggaggcagcuguuacacauauauuuguaauuguggucgugcugcaaagaagagaacaggguuugcauggcauguguaugguggguagcaggaaggaggaggugacgucucaugucugugcugagguguuuccaguguuggcacacuuccucacaaagacacacaugcgugcaguuugggggcaggugccuguuuuaggaggaugggagcagcagauauuauuucucgauucuguuugguaguggaacagccugugcugcauggauggccaguccuuggagacgcuggggagguacgaguguuuugcagucaaauaagugugggaaaucugacuugcugcauccccuuuagggagucacagugcacguugcagagaaagguuuccuuccccucuucugcccggcacagaaugugaaacaggauguuaaagagaacaggcuuuggaugcagacauucgaauccaagcuugguucagauccugccccauuauuccagcuguguggccuuggaugaaguccuuaaucucucucagccucagcuuucucaucucugcaaugguuguuccguguauuuaaugagaaaacacgugugagaaacucaaagcaggcaugggguaagaugcaguggcuguuuauuacugcccccaucccugccaucaccucuagacuugaaagagcagcuuucuagacucuuccagagcaggugagaggaaagugugugcagccagguuuuugucuuuucauccucuugucuggaucaggcccugugagcagggucuucuguggccugguccugaacuguggaagagcuggguguggggcucuggaugguggaggaguuguguuuguguugccagccuugucccagccagaaguuggggggucccucaugagcuucgagacaggcaauuugcucucucaggcaagaggacgaacagugcaccuugcaguucugauguucuggguuccuugugcuuucucuuugggaaaacauagaagacacgggauggguuccucucuccagaacacugagugauugauccccgcagggacagaaggacagaacauuccuuugggacugaauaggacaaaggccuguguuugugaguguuguaauucucccauucaaucucagacagucuucuugacuggcuuagaaccgcgugcgugcacguguguuuguugguggguguguuuguugugugugugugugugugugugugugacuuaggggaugggacuuggguacagggaagaugacaacacuugcuuuuuuccuccuccuccugugugugcuggggggccaggaacugaguggaggaccgaugggggccagcagacccuggcacaaaggagcaagggcccagcggagagaguucgaauccuaguucuaccaccacaaaccuaugaccuugggagagucccuucaacuucuuuaccuauaaaaugggauugaugggccucccgguggcauggaggucugauacccugccuuacucuucguaggcgcuuagcaaauguucucccucaccucugcucaccuaugccugggaagcagcccugccccugugugaccuucaccacuucacuuccauguucucagacggggucuuuguccuucccaccaaggcuagcaaugucgaaagccucuuuuuugaguccugcucaggcugagguuuggggcagugaugaggcagcagccaggguccugacacucaugagcuggggugaaguguuagugcucugugaggcucucaccaacccugggggucuuaucaggagggagcugagcaucucauggccaauccaagagcagaguggggaagaucccaacauggaucgaugcccuuaggagagaaaguuccuuucuaggguguaaugcucaccaucaucugucgggaucagaucucuuauccagcagauaccgggugcccacugagagcaggcagcuaugcagaggccuguggacagaaagugagugagaccuaggcagccuuuccuucuuggacugaggaauagauccuccaguuuaguucugguuccauggcuguauaauuuuaagaccuucaaagagaugagucaaaaaucugcuacccacucgcaacuccgggggcugccagggacauucuugaugccagcugggguggcgugucccauaccugcugccacauuaguacccucugcugccugcaccgggaguccccauccugccuggugcugugcucugggcuccgugcaggugacuccucuccugcuauggagucuggggugcaggcggcccucccagcucaggggugaggaccuggaggcucggagguuggggagugguaggacuuggauuugaacuccgauguccguggcgguggggacaccgccugcccuggccugucuuuuagagggagccaugugggucagcuggggagacaaugaagaaugugcccccacaaacaaauggaccuuuguucccacaguggcuucagggcugggcugggcccagcagaugaucuccggcccccuggaagcugggccacugcucccucaucuauggauuuuuccagugccuguuaugggcaggaaagaaguguugggcccugaggggcagagaggggagaagggagauggggcugagcucugugugccaggggacuuaacgguguugggggcuaaugcaggugccaggaugaccccgugcugggcgggcccgggugcucccagggggcugggccuggcccuguacagugccucuuuaugugucaccacccucaccugguaaccacugcugcgucccugugccauucaggaacagggaacuuuuagguaaccuugaggagggcggaaacccagggcaggcgagugaaguggcaauugagaaagagucacgaccacccucugcaggaguuuagaugaacauggcaggugagagauugguccaugagugagcuggggugcuugucuccuuucugcagaagcacgaugguggccuggggcuggcuggcuucgggguucuccaagugagugucgggaaccccugcacuccuccgcuggggagggggagguggugaguucuuguuggaaacucaguacggagcuuucauacgcugcgggggaaccugggaauuggaugccauuuuucuuuauuuuugaacuuguuccucagguugagaaucguuggucuuaagggauucaggaggcuuuccuggucccauucccagcaaccccccaguggguuaaauccucuuucuccuuucucagaggacccagaggaacugcagccccccggggccauuuccacugcccccacuagcuugugaguugucacccacucgucccugcggggacaaaggggaccuggcauacaauaggugccuaaugaauguuucucagaugaaauugaacugccuuaaguaucagggguaagaaguagcagagguggaauccgaucaccagcggguguggauggcguggggguggcugccucguaccacuucacggggggucacucacagauggagcagccuacauucucugggccuucagcaccucuaggagguaggaagggccaggcuguuccuguuuuaaagauucaagcuggggaggaggugacuugcccccacagggugccuaaguggugaucugucccaucccuucuucucaagcgugaguuugugaacgcugaccuuccucucugcugccacacggcagugaucuguaugggucgcauuucugccagcuucuagaagcagguucaacagcauuuagaguguucuguguuccacuucacugccucauuuaaucuuuggaaaaucaaugcagcgugcugagcugagguggccucgugaggccugagugugcgccgcuugcgggcgggucaagugcugagaagccuggggccccgcggaggcugauugucugggggaccugccucugugcugccugcccgugugacucugggauacugacuucacuuccucagccagcugggucacauggcucuggcagggcuccugugagggugaggacauggagggacaugguucagcacugccuugacaccuggcaggucucagcagccugauggccuugccuccugcuccccaacugcccugugggagcagagcccagaguggggcacuucaaaggggaggucacugcucucagauguggaaauugcucaagggagaugagugacugggguccucgggaacuucugguugaccuugaggagggcggaagcccaggguaggcauggggugaagggugaguggaagugacaauugagaaagagucacgaccacccucugcaggaguuuagaugaacauggcaggugacagauugguccaugagugagcuggggugcuuggaaccaaggcagggugccuuuuuuuuuuguuuuccagaggaagaaaggugagcaggucuucagcuguuaggaagguuuggugcggagaggugcagggaugacugggaguaagcuggcugggggucacuggccgagcuggagaguuggccuugacccagagaaccaucuggcucaacaagaaggaagggcaggagggaggaugggcaugguaucauucagaaucuuuuggucaacucaacauggcuuacaugggauuggaaguuggugggccguguaacugaaaaucccaggugguggaugccauccccaaaccgucuuucacucuuuuccaucccugggcuggccauacuuucaggcaggcccuugccucacggugacaauguggcugcuacagauccagcccucccaaccuugcuccaucaaguccgauccaguuccccaauuacuagaaauaagugcagcuggcuuuaguuggccugagccaacccauguguucuuuccugauccaguccuugcaacugggagguggagugcaugaauuggccuugacuugugaaacguggggaggggggucacugucaacagaacacuuaggacugagggugaggguuggguggguuccugaaggaaacugagggcuguucuuggaaguggggagugaauucuguguagccccaagccagcagauguuagucacagguacaguaaccuguggggccaguggggccugagggcaaggaagcaaggaagcgcaggcuugauggccuguuuuccagauggagcaaacaguccggggcagagaugguggcgggcaagcccuuuccccagcauuuggugcauuuaacagcgcagucugagccaggccucuguccccugccuccugggaguccccuccuagcccugguccuuggaguggcuucuggccagagagagcugcugcccgaagccggggcucuuauggccagaugagaagagagcuuccucaaaacacaguuggaaacaggcuggcugucuucagccacgcggaugccaugaaccccacaugaccagcccacugucugcugugucuccucaggagcaggacaucgagacuuuacauggcucuguucacgucacgcugugugggacucccaagggaaaccggccugucauccucaccuaccaugacaucggcaugaaccguaaguucugaggagcucugauucccugucagccgguucccaagagaguggcggaaaaaggcagccgagaagggcugauggccgggagcuggugguuucuuuuugccugggacuuccuggggcuguucugggaagaacucuugccacagccuggaaaagccagaaaugcgcugcaugugggcacggaguugucugugugcccggaggcgcugggaacacaggaagcuguuugcuaucuguggcagugacuucuauauuaaugcacgcauaugguuuucagucuuuucacagaauugugcaacgaucagcacaauuuuggaacauuuucauccuuccaaaaaauccuguaccuuuuaucugucaccccacccucagaugacugacccuucauugacuuuccuuuucugugaauuugccuguucuggaauuuuguauacauugaaucaaauaauaugugauuuuuuuuugguaacuggcuucuuucuuagugcuuucaagguuuauccaggccaugcauuaauauuuguauuuccuuuauuccuuuauugaauaauaauauuccauuguauggauuuaccacacuuuauucguucuuuuuucuuuuucuuucuuucuuuuuuuuuuuuuuucugagacagaaucucgcucuguugcccaggcuggagugcaguggugcgaucguggcucacugcaaucuccaccuacuggguucaagcaauucuuuugccucagccucccaaguaccugggauuacgggcacccaccaccacgccugacuaauuuuuguauuuuuaguagagacgggguuucacuguguuggccaggcugaccucgaacuccugaccucaggugauccacccaccuccaccucccaaagugcugggauuacaggcaugagccauugggcccggccaucuauucuucaguugaugggcauuuggggcauuuucacuuuuuggcugugugaguaacucugcuacgaauguuuagacugugaauuccaagauuaccaggaggguuuucuuagguggguuccccauuuuucauagaugagaauggaauggaagcuacugaauguugaaauuucauggaauagaggugaauucuucugugaggaaucagaagacacagguuucacuggucccguaauuuuuaugaacuugaguauugcaagcuugcuugauuuuugacgauggacugccugauuuucauuuguuucuauaaagcuuauuaauaccuuauuaauaccuugaggcuggggauggugucacugaaauccacugaaaacacuuuuucacuucauucucaccuucuuuuaucucacuucuuccccugucuguuucccuuauauccauuuuguaccagguccaugcuagguauuuugauuuacacuaucucauuuuauugacucugacaaggaacuggaauugcauauggcagcgucucuccccauucggagaggcucauuguugguuuauaauaggcuuaccacuguaacaaaagaugccaagcccucuguggcuuaacacaguauauguuuuauuucucgcucauguaacaguuuaguggguguuuagugggacauguucuauuuggcaauucaaggacccaggcuccuucuagcuuguggguuugccauccccuggggcugcagagccuucugcuggaaacugugcuucuggcagguagaugagagaagagagaaacuuagaggaucuuagagaaucuggguggcagguauggugaggaaauggugacggucacaggcuaucggccagaaacagaucacauggcugccucucauugcaagggagcuugggauauaccgucuagcugagugcccaggaggaaaagggacaggagguagggugagcagcccgacuuccuuaggcuucagcagugaggagacucauccaggccacaugaaaggaggaggcacgccucaccucccaugcuccuccucguuugaaaauuauguguguccuggaccaguaccccagaugggaggguauaguggacccagauggaaagagaggaucaggagggcaaagccaucucaugccagggccauccugacccuggcugacuggaggagcuacaggagccagccugggaaccccuuccagcaccaacugcaagacucaucugccagcuaccacucccuugccccaugaaacuuacucuugcuuuuuaucagcagaggaaagugggcauggggacaaaaccaaaaaacaaaaaacgccaacaucuguguucuucuaaguucacuuccuacuucugaauaggaaugaaacaaaaugaaugugcuuugccaccgagacaccuaauuuuuuucucaucuuacuuuuuucucuucucucccucacugcuguucuucagacaaaaccugcuacaacccccucuucaacuacgaggacaugcaggagaucacccagcacuuugccgucugccacguggacgccccuggccagcaggacggcgcagccuccuuccccgcagggugagaggccucuugcccuaugagcucuacaggguggaaacugggugucggggagggguucaggugcuuugcucuuuuaaauacuuuuuaacugugguaaaauauaaaacguaucaucuuaagcacuuuuuaaauugugggaaaagauacauaacauaaaaguuagcacuuucacuauuuuuaaguauauaguucaguggcauuaaggacaugcagacauuguugugcagccgucaccaccauccaucuccaggacuuuuucaucuucccaaacugaaacaacauacuuaucagauacuaucuccccauucccccagccuuccugcaaggcuggcguuacgauaggugugcucagccuggacaggacuucaguggaggaggacuugacaccaccaaauagugugaagaaaaaccuagaagucuggggagaaacagagagggagagaaguaacauugauggagcccuuccugugggcuaggcuucaucauuugugucuaacacugggcuuaauccuuacagcuagcucuguguggcugcuguuguuagcuccauuuuccagacaaacauauugaggcauggaggcauuaacuaccuugcugaagguugcacagcugaggccgggcauggugguucaugccuguaaucucagcacuuugggaggccaaggugggcggaccaccgagguugggaguuugagaccagccuggccaacauggugaaacccugucuccggccaacgugaugaaacccugucuccacuaaaaauacaaaaaugagcugggcgugguggcggguggcuauaaucccugcuacucgggaggcuuaggccagauaaucccuugaaccugggaggcagagguuacagugagccaagaucgcaccacugcacuccagccugggugacagagcaagacucugucuccaaaaaagaaaaaaagguugcacagcugaugacuggggaguuggcuuugauccuaucuacugagacguguauccucuuuggaacaucaggcugccuuaguugagaguauuugcacugccuggcccuugucagcucgugaucuguaugggcauggccuuucaauuuccccuugugcaauuauggucaagcuuguuggaucccccaaucagcaucauguggggguggcagaccucagagauaaccccucuugucccugcaccugaccuguguuuaaacuagggcaggagcagguucuugggcuuaaagucuuccagaaggggccuucuuggcauuuauaaauagauauccuuuuuuauuaguguucagaauuauccuuaauaauuaaccuuuaucagagaggaagggaagggacagccaaccguauggggccaggaccaaaaauuaaaaguguauuaaaacagugggacgugguuaauuguuaaccagcagauaaagccagagguguguccguaaaucuuugguuggaccaguugugugaaagacuugggggaaagcagagacucuuaguucccccuggugaaguuuuacaaauauucugaggccugagccccacccccaggaauuuuuauuccguuggucuggguauuacagcgcauuuucccccuaguuuacuaugugguuuucgugugcaucuggugggacccacugucagagugggaccugacuuguuucuuccuccuggaguagggcagaggagaguguggggcuugggaggggugagggagcaucucccaggcccuuuaagggugagcccccuguauucugaagccgagacagcagagcaggguaggggaucccuggcugggcuccuccuggccccgguguccaccaccuacacaggagggaccuuggaaguagaauucugcugcuuccucgccucacaccagcccuggggaacagggaagaaacagagggcccugcaauuaaguggcuucuccagugucacaccuuaggagcugcuggcuccaaauugagccauggccauuucagaggagcuucaugucuuugccgcacuucugcccugcggcuucucagcucaguggcucuguugauguggagccacaccauacgggcucuuucuggcucuucccagggcguccgcauacacugcuucccugcccacacgcuuuacucaucagguucccaugaccccuucagcgucacuucuuccaagaagcccucccugaucaucugagcacggcaggucucuguuucgauaggcuuuguuaugaguaacacccccuguuucuguugacucgagggcuggcuccuguccugguuugcaucugcuuugcucacagaccccugccauugccucaccaagagcccggcaugugugaggaucaaucacugcuuugcggauggaacucauucaugccuguuuuaauuccuucucccugacauuggaauugugaaaugccuucuagucaguuucugcaacacccuagacccaaaaccagacaaacacagugaggacauguuucuggcuaaccaucuacugcucuugugaggccaagugucucaucucucagccucagugauguuuauaaucuugcuaugaggggaaauccuagcagccuccuagaguuauugugaaaauugaaugagcuaauucccagaauguguccaugggaccuggagcguaggaagcaauugauagagugugcugcaggggucuuggaaggaggaugcgaagggacuagacuugggggugggggggucugggugcauggggcaggcugcugcaugguccccacccuucaagcgugucccuguuuggauuacccguuucuguccgggcgcucacuaauggcuucucugugucauccccagguacauguaccccuccauggaucagcuggcugaaaugcuuccuggaguccuucaacaguuuggguaagagcgaaggaucagcuccuucucugucugcagagaagccugguuucuagcaucuuccugccccuuggcuuugaucuggacugaccacuaaaauuaagguugcaauuuagagaugaggcaagaaauuagcucgucacucugugaacacuguucuucacacagucucugagcucuagucugucuccucuaacuucaguuuuccucuugcgugaauguuauauugcaugauggcagcugccccacccauuugcucuugccuccuguucuuccauucccuucucuuucccauggaauguucuggaauggaguugccugaguccuuagcuuuucucuccacacccucauuuuuccaguguuccucucugucuugagcucuucaaagaaugauaacuucaugguucuugcucaauuuguuuucauuccaaguuuuagaauccaaaauaaagcuuaagagugggaagaaaugaugccguaacgggccuucccguaaaugucagacggucucucagagccuggguggcggccaggagggaagugaggagaaggggcgcggcucuccaaggucgaggucucuguccaguccuaaagcauggugaccucagagcugugcaggcaguuacggcagcaugcucccgcauugccuagccaggcggucacccucaggaaguucuaaguggguccuuggaggcucccgucacucuguccuugugugacaugcauuuguauuuuugcuuccaggcugaaaagcauuauuggcaugggaacaggagcaggcgccuacauccuaacucgauuugcugugagugcuuuggcauuuuuugaaaaucgcauuuuaaauaacauuuuaagaugaaggaagacauuggaaaagcaucaaaaacccaaaagggaaaaagaaaugacccguauucuccacaguuguguguguguguguguguggugcauggguacucguauauauauauacucacagccuuuucucuuccuccacucaaggaugauacuggacacauuccuuugucaugggcuuuguccgcuuagccaucuagugaggacgcuccucacucacugaguacucugcuaugacacugcuuuguaacagcuguacagguuuuuguagucagggcacuccugggucauaacugauucuaaacuagaaucagacacgggaaguuuucaugacaguugucauuguuauuucucugggcucaggucaagagccacuguuccuuuguauccucaccgagcaauuguguaagaaugcaacaauacucauuuuguacauccauugguauuuugacuaccuauuauuugcugggcuuugcuggagguugggaauacugacaugauucuacaacauccaucuuacaaaaaaaagaaaggaaugcugacaugaauacaaaauggucuggccauauaggcucucagcaaauuaaaaauggucucaacuguaccccagguguacauaucuauaucuguauguaucugcaucacauaaugacauuuuggucaaugacagacugcacauuugacagugguuccauaagauuauaaugguucauuuuuacuguaccauuuuuauguuuagauuugcuuagauacaucaauacuuagcauuguguugcaauucccugcaguauuggguagcgucauaugcuguacagguuuguacagcaaaccuaggagcaaagggcuguucuauacagccuuggugaguuguagacuauacugucuagguguguguaaguauacucugagaucuucacacaaugacaaaaucuccuaaugaugaauuuucucagaaaguaucccuguuauucagcgaugcauaacucugucucucucucuguguguguguguguguguguguguguguguguguaugcauguguuuauccuggaaguaaguaauacaguuguuacugccacaacuagagagcauuugugcugugcgccuuguuugauugaugaggucgaugguguguuacacccauuugauagcuggagaagcugagccuccguggguugaagugacuugcccaaggcaggccugcaaagcagcgggcuuccuacuucuccugcacuuccucuuucuccuucccacucucucuaggacccgauaccgugucugcugugcuggaaccucaguuuugcaugggguggggccggggagcagcagccugcucugcugcccacacugccuuuuucuggguacuucucucaagcuuugguuugccuuggaaaguuccuaguguuucagauugcugggaugucugucucacuuugugucuugaauugcagcuaaacaacccugagaugguggagggccuuguccuuaucaacgugaacccuugugcggaaggcuggauggacugggccgccuccaaggugaggugggggccugucaggccggcgggaucccugcaagaagagggacaggugcacacagccucugccugggggaucccuggagcuacgagcucucucuuuacccacuccuccacuacccucuacugcccacuccaguucccucugcuuuacuuagaacaguacacaugaccucagccguuugccauucagaagacuuaaauaccaccaagcugucuaagccagggaaagcacugggacacaggucccugaggcagcuuggagaagcauugcuuggauuaaugaguauuagcuggguacauaacuugugccaggcuuuggucaagaugcugagcaucuugaagaacaagacuucuugagaugaacaagacaaaagccucuaggaaugaaucuuaggaauccauucacauauuauuaaagaaaaauaaauauguauuuaguacggacugugccacagaauuuuacgauaauaauuagcuaacguagauugagaguuuaccaugugcuaguuucauucuacguugcugugugugcaugaucucaguuaaucuucauaguaacucuaggaggugagaauuuuuaucaccguuucagagguaaggacucgguguggcuaaggggauuguccagggucacauaaagcuaggcaguagaacggggacuggaugcagcuugcuuugacuuugugguucguggaccugaccacccgugccccuggggcuccuguccagggugggagacaggcaggccuggcaagcaggguaggcugccuggaggagaagggaccugugcugucuugggaagcucuguccuggcugguguccuaagguuccuuguuuaucuuuuaaaaauuaucauugugguguuuuuguuuuuguuuuuuucccuguaaaggccucaguguuggccaaggagagggggaggucauuccaguugaaauaggacagagucuuucaagcugaggugaucgcagcuucucauucugcaagugcauuuuugcccaauuuuggguggcugccagggaccgaugguuugaaggggcccugccucuugccccauccccugcccuguaccagccacugugauuuugcauuuguucuuugaacauuccuccagaaugcaggagcccuuccguccagccuguaugacguucuggaguggaacacacucccuguuuuuuauuugauuuuccagcaaaggaagugacauuccagucaacccgcugggcuucaugauagcuguccugagugagacucgaaggucuggggaugucgaccacuggcuaaugugaagccugaggauugucuuuaauagcuguacuauucccuucaguacagcuuuaauagcuguacuauucccuucuuuuucaacuccagccuuucgauuaccaggcauugguauuagauacugugaugugugcaguuacuucuugcaguccuucccuugaccuuguggccuugaaguuccuggcacucccaguuccagauuagaagucugagacccagagguaugcagacugcccagugccacacagcuaggcuguggcaggcaagggccagccaaagacccuuaggucuagagcuucucuccuacucauuuuugccuaaugcuuaggucagcacacauuuauggagcuucugcuguauacuaggacuuauagagcuccugcugcaaaccuagucacuggggagagguaggaaaagaagauugucagugucuuugguaauaucaguauacuuagaaaggggaaacuggcuuggagaugagagaggagggauaguugggagccaagcauaucuugggguauagacuggggagcucaguguguuuuuagaagaggugaauggauggcccucuuugcugaggacuuggugaauguuuggagcaggguaagcuagcaguagcugggucuuuauucagcacuuauuugcugugcaucuugugcaugggccucugaaaauaaggaacuggauauagucccaggcccugcauuugggggaucagguccaggagggaacuggagacaggaacugaguuucuaucaagggggauguccuugaggccugcauguaggggggaguccagcaaugccacccugcacccagggaagugggguuuugcugaccuuguuaacuacuguuagcuccugguuucucauccacccacuuuacuccuuuccagaucucaggauggacccaagcucugccggacaugguggugucccaccuuuuugggaaggugaguugcguggucuggcaaaucuguuguuccugcugagcaaggcauuguguggugcucagcacagggccccauguggggguggagagaacaagacacaaucaacugggggccaccgagcuggugcucaugagauaaugugacauuauucauucauaagcaacaagucauucauucucucucuuuuuuaugugucuuuuaaaaacagcugauugaaguacaauuaacugcacauauuuaaaguguacaauugacaugcauauacauuuguaaaaccaucccuguaaucaggagaauaacgucuccaucacuccaagaguuuccuugugccccuugauaguccuccucucccuccuccucaggcaacuucugaucagcauuggccucuauagauugcuuugcaauuccuagaauuuuauauaaauggcauuauauaguagguacucuuuuuuuuuuuuuuuuggucuggcuucuuucccucagcauaaccauuuugagauuuguccauguuaaugaguggaucaauaguuuauuccuagucggggugcagugcucauuccuauaaucccagcacuuugggaggccauggcaggaggauugcuugagcccaggaguucaagaccagccugggcaacauagugacaccuugucucuacagaaaaauuaaaaauuggccaggcauggugguucugcaugccuauaguccuagcuacuugggaggcugaggcaggaggauugcuugagcccaggaguuugaggcuacagugagcagugagcugggauagcccacuguauuccgccuaggugacagagagacccugucucuuaaaaaaaaguuuauuccuuuuuagugcugagaaguauuccauuuuauguaugugcaacaguuuguuuuuccauucaccuguugauaagaccuuugaguuguucccaguucugggcuguuauaaaucuggucaguagcaaacauguccguggaguuagcugugugcugggcugggcucaguccuaagagcuucacaaguguuaacuauaggaauaggauuccacccaggugcucugugaccugugugauaaauucuguucucauucccaguuuauggaagaggaaacagaccagagagguugagugacuugcauagggucucaaccagggagagguggggccgguauuagaaccuaugaaucuggcuucauucuggucaccacagcaggauggcggcugccugugcugcugccuggcucugagaugagcugcucuucugcagaguuaccccacuaaaggggauugagccaagccccucacagcaugcuagaagugagcagucaucuuaucagcccagccugccuggccccagacacugguuuugugucucuagcuggggccagcuacccucgggaaggguaugccaugggcuugguugcaagcccagggucuggaaaaccccuugguugccugaaauugcagugaccugcuuugcuuacauaccacugucugcuucugagcuaacaugugugaccaucugacacucccaugaguccuggggacacagccuccacucuggagcuggcgaguacaccaggggaacagacgccccacucuggaguugacgaguguaccaggggaauagaggccccacucuggaguugacgaguguacgagggcaauagaggccccacucuggaguuggcgaguguacgaggggaauagaguccccacucuggaguuggcgaguguacgaggggaauagagccuccacucuggagcuggugaguguacgagggaaacagaggccccacucuggagcuggcgaguguacgaggggaauagaggccccacucuggaguuggcaaguguaccaggggaacagaggccccacucuggaguuggcgaguguacgagggaaacagaggccccacuccggaguuggcgaguguacgagggaaacagaggccccacuccggaguuggcgaguguaccaggggaacagagaccccacucuggaguuggcgaguguaccaggggaacagaggcuccacucuggaguuggcgaguacaacugcuagguuugccuguuguguugguuuccuguggcuucuguaacaaauuaccacaaacaggauggcuuagaacagcgaaagugggaugagcaggguggcucacaccuauaaucccagcacuuugggaggcuuaggcgaguggaucaccugaggucaggaguucgagacgagccuggccaacauggugaaaccccgucucuacugaaaauacaaaauuaaccggaugugguggcacgcgccuguaaucccagcuacucgggaggcugagacaggagaaucacuugaaccugggaggcagaggcugcagugagccgagaucgcgccaugcacugcagccugggugagacagagggagacucugucucaaaaacagagaaaaaggaaaacaaaaguguauucucucacagcucugagucuagaacuccgaugucaagcgcuggcagggccgccccuccgccacaggcuccaggggaaauucguccuugcuucuuacugcuccaggucgcugucggcauuccuuggcuaguggcugcucacaccacucucugccucugucuucacauggucuucuccucugugucuguuuuauuucucccucuccuuccucuuuuaaggauacuuuccauuggauuucaucccggcucauguaauccaggauuaucucaucucaagauccuuaauuaauuacaccugcaaaaacccuuuuucccagcaaguuugcauucccaaguucaagagauuugacauggacauaucuuuugagggccacaguuuagcccacuagaguccucuuuccccuuuuacgauucauuccacagcgugugacacauuuucccuguccugaguguguaaucugaaacugauaggaauugggaaaaauucacagccacugucucuguuucacuggaggagggaugucagacauagcguugagcaucugaucugauuauaccccaaguuauuuggagacugguugguccggccauggugucugaggguacccccagaucgcuauaguugguuuugaucugaaaucccagcgugauuccugacuauuuuuuccagaguuugcucuuaguagccaguugaccuccuugcugccuaaaugauccuggacuguuugaugcagcucaagcuugacaccggcuuucuuugacccccaacuccaacuucucaucugguugccacuggucauaucagacccuugugugaaaccuacagugucugcccucguacaaaugagaaacagagcaaacaaguuguuugucgcaaauaacauucaaaaagcacccagagacggggaggcugaggccgacuuccccaaggcucugguuggccguggugggaguugcaauugcccuucuuuucaguaacuuccuguggcaugaguugauuuugcuuuucaagcaugaaaaacuucuuuucagcucuucccauuggaaaacaauuacuaacauuugccuccaauuuuuacuguuaguagaggugagaacacaaccuccauuaaguccuacaaccuagugaaguaggcaacauucucucucuucccuuuuuuuuuuuuuuuuuuuuaagagaucugaggcucagagagguugaaagauuugccuacgaaagggacagugaugaagcuaagcucuagauccaggaugucugacuucaaauugaaacucccaaaguaaugaguuuggaagggugggguguggccuuuccaggaugggggucuuuucugcucccagcggauagugaaaccccugucugcaccugguugggcguguugcuuucccaaagguuuuuuuuuuagguccgucgcugucuuguggauuaggcauuauuaucuuuacuuugucuccaaauaaccuggagaauggagagaguagugaccagcucagggccacagugcgaugaggaccaucuucucaccucucuaaaugcaggaagaaaugcagaguaacguggaagugguccacaccuaccgccagcacauugugaaugacaugaaccccggcaaccugcaccuguucaucaaugccuacaacagguauugggauguaguucagccacaucauugcuauuuaugaggugucuucuguagauccgaaaugugggacagaugagagggagaguauaaaaugagcggaagaggcaggcucugaguuugagcaaauagauuaauaggacagguguccccaggaaggacaccuggccuguaagcugguuccuggcauucagcucgccuugcagggaucugaacaaacacuccagaccacugggggugcagacgugagagggacgcagucgcacacucagaggguugagaguaaauaugugugcccgcugcugaccuucacgaaaggccaaauguaagaagagcuaagugagagagcagcaaagcacuccuggaggccggggauaauccaggcaggcuucugggaguuugucauuccaaggauaaggaggaccugaacauggccuuugccuaaggcguggcccucucaaccagcacuaggugcuuaucuggagcucagcuaggggaggagacagcucagggccauuggugucagccagagacucuguaaucuuccagggagcucgcucaaccugcugagcucgcucugccacgcucgcagaacaggagauagaaaugagccucauaguguuuaucucugcucaaauguuaauaaagugacuucuugaaauuaacauuuguaacagagcuuaguaucugccuccuuuuacaauccugcccucaucucagugguaacauccucacuguggaugugacugaagaaaccgaaaccuggcagugcgguucacuuaguaaacacuuucugagaacuggagcgagucaggcauucggcugggcgcuggagacacagaggaaaccagcacagcccgcagacuccacacuguuaacuugcccguguagauagcaccguaauuaacugaccccucuccaaaucccacugugaagguccuggaauuacugucauuuccuguugaggaagcaaaggcgcaaagagauccuguguucuccccaaggccacacagcuagaaaguggcagagcaugauuuggauccugcuugucuaacuccaggcugugagcugggaaagagcuucucauguugggagcugcaagauagcagagaggguggguggcugcgugcaggaaagguggucggcacugggcuggacccacacugggccucacacgagugcagugggaaaccaccacaggguuugagacagggaauggaaagaugaggccugaguuuuaaagagaucauuugggugcuuuauagaggacucagaguuggugaggcugggacuuaaacuaagaggcugcgagagcauuugggagguggccccucugucaggugggggcucugacuagggggacagggaaggcggggacccucuaugguggagaaucugacuucuacuccuggaaaaaaaagccccacaaauauuugugacaaaaugagggggcucugcuugaaaugcauguguugugcugucccucuaaccaggucuguggacaccaagaggguguggaguccugaaagccacagggccucucucaaguuggggauguggguagcuuaccagaauggccacuggcaggaccuccugggcuuggcuggaugggagugggagauuucuccaggggagggguccucaugcuaaugaugcauuuguuuccugcagccggcgcgaccuggagauugagcgaccaaugccgggaacccacacagucacccugcagugaguggcuuuucucucccccagcacuugcagucggggcugcccacuauaaagguggccuugcuggcagggccuucuuucugaguguggcaggacauugugucagugagaccuggauauauuccacccagagacugagcauuacccagccugacuuggacuucucccugugccgguggcauccguuucuaggguguccccaugaccuaggccuuugaucuuggagaaggaugguugauuguacuugggacagcauuuauuaagcaccuacuacaucaauaacugugugaggcuuugcuccaugaagccuagggauggauagcacaggacccagccuuaaagugcuccauacaccuaggaggaaaagacagucauggacagaacuaacuggguuuccaccaguaaugauggugucuuuuuguggcugagugcaccgcguugugugacacuugggaaccuggcacgucauugccuuuguccuucaugcuguucuuguuucggucuugauugccagcuaaguccugcuuaaccauccuugaggagaagaugcuuuaaaacaaaagcacugagucacagaaauucccuggcugaaauucauacuaaguugugaaugacuaguaaccaauguuauccuaagaucaaaggagaaugaaguaaaagagcaaaggguguuggggaaaccaaaaugacauuguuuguagaaugcaggccccagccuggcaggccugggagugggacaaucuuuaaaggaaccuugugcuaauucucugcucuaucccugaccccaggugcccugcucuguuggugguuggggacagcucgccugcaguggaugccgugguauguagaaaucacagcugauuucuguguuuaauucaacaggcaaagucugguugacuuuguugaaguggcccugccugccccuccucuccucugccccaucagggcaggugauguuuuuugaaaugccauauuggccuuugggcagagggcccagccacucagucucuuucccugguggcugccagcccugguugcuuggcagugucuccucucccagguccccucacccgccagucugugucccaucggcuuguuuauaugggcauguuugccacuuggcuuccuggccaagagacucaccucuuauuugggaagcagcuggaucuuuccaaacugacuggugccugaugagcuggcaggggagagaggcacugggaggcagggcuuagcaaagcuuccugacuccuuucaccccuuaacucccaccugcaacuuuguggcagcaaagagaggaaucugccuuucaaacaaccccacagcuggggagauggaagacuuaggggcuauggaucagaguccugcaguacugccaugcuuugugcagugaucugcagagugacauuugcaaauguucauguaguaaauaccuggcaugccuuagugaaccaugaguuucuuacgggcugacugacuggagauaaucaugggauacaucaauagagauacacuguucaaaucaagggaggugauaguuuuacuuuaagcauuuugaacauccuggguuacauauggguauucugcccaauuccagaugccccuuucaagagguucacugacaaaaugaagagagaaaccagugugauuuuacaugaagaauaguuguuagaucugggaauauuaaaccuguagaaucucuggcagcugcugguuaaacaaggauauuuauuuagcagguauuucuacaguacuguuuacauuucggcuaaucuucauaauaaccuuuugaaaaaagauauuagcuccauuuuauugaugaggaaacugaggcccaaagaaguuaaaucacuuauccaaguugucacagcugguaauggcaaggcugggauuucaagccacaucugcugaaucccaauaacuccacauacuuucuucuuugccagcagaaauacuggaguuucuggugacgguggcagaguggcggagaagggggagauguuuuggcuuuggcuucacguagaaaauuaacagauuuccucccucuugugcagguggagugcaacucaaaauuggacccaacaaagaccacucuccucaagguacagggaaaacaguggggguucguguuuguuauuucuuagaaacucucagacguuuucugcaacauugaguuaggcuugaaaaaggcaaggcacacgaucagaaacuauagaauuaaugauuuaaucuaucuguuuaugaacauauauugggugcugacuggugaucugaggcugcaaagaugagggauccuucucugggacugcaggaaucaauaggcugcuggucugggggcuuuggggauagagggaccagggauggcuuggcaagggcccuccauaggcuggggccaggacauuccuccaagaggggcucucugcuugucacaauaagaagagacgugucccacagccggggaaggucaggacuuuguccagcaaguucaucugagcacauggugagccagcucacucgcagcuggauuugagugucuguagcaaccuccgccaguccuuugccaguuaugacugauugcacaaugcaaaccacuggcuguuuguggcggccucguccggagaugcagcccaagagugggaaccuuucagaggggccucucagccggggugcaccccugcaggggcagaugaccaggcgggaccuggguggagaugaggcggcucccucgcacugggggaaggacaaagagguggcaucuguaggucaccgugcccucaacuucccccauagaaguagaaugccuuugaaaggcauguaggggguguccgauacuuauugagugggaggcuguuuuccuguauugggcucuuuacauagauuuucuuucaagauucccucaaaaggaaauugcaagauuagaagcugcugggcgucaagcuugcauaaugccguacuuugagggcgguugucacaaguaucacaaaauggguggcuuaaagcaacagauauuuauucccuuuuaguucuggaagcuaaaaguccgaaaucaaggugugggcagggccgugcucccucugaaggugcuaggggagaaugcugccugccucuuccagcuucugguggcugcuggccacacuugguucaccuuagcuaguagacacaucacuccagucucugccuccauccucacucagcacucucccgauuguaucucugcgucuauguccaaauuuccuucuucuuuuaauaacaucagccguuagcuuuagggcccgcucuaauccaauaugaccucaucuuaacuugauuuuaccugcaaagacccuauuuccaaguauagccacagugauagguacugggguuaggacuucaguaugucuauuuuggggacacaauucaaccacaaccuacagcaaaggguagguggccugacugaggugggguggccgauuugaugguagauccagaaacagaacucacuuaggccugauucuggagacuuccacagcgucagucuaaugugcugagugccccgccuggaggaaaaauucgggcauccugcucccugcgugcugguugagcugagggcugccccaggucagugucgcuuuguggcuaguguuggggguccacacuugaggcgcccugggcuguaggaugcccacagccucaccacucccaugaacuccuccagccccguuucaccccaggccacccuccccgcagccucccccugcucccuugccgucagcgcugcccauuuccaggcuggcugcacagucucacagccugcaauggccucuugcgguucggugauuucacagggacuuugaacguccaccauuuaggaaggguacuggucagcugaauccggccugaagacccaaauucaaccacuuccuuuugagggaaacuuucaagggaauauaugaagagggucuuguuuaucaaacccuuucgggucagagagauccuggccuggaaccuugcgagucccucaagcucuuccuggcccaguuucugccuguaaaaugggacagcuguaccuuccaugguucuuggggaauggagugaaauuaucuguagggccuagcauagugccuggcacguagcaagcugcaagugaugguugccacggagacaccagcagccuugccugguggggcuggauuguucccuacccacgguccacccuguuccuccuuuguaaggcaggacaaggcagggcagggcagcgggcggaugggcauccuuucggaaaaaauucauagagcgcagagggccuuggcugugguguuuggcacuaacgagcuucccucucuccuagauggcggacuguggcggccucccgcagaucucccaggugagugccauguuggcuuuugcauuauacagcugucgcuucccccuggguggagugcaugugccucugugacaccuguucccucauuaccuugcugugacaucggaugacaguuuguggacuguugggaaaaggugcuauauaggaggacucugauucccuaggaaccaaccccuguggaguaggugauacugcgguucacagagguugggggauuugccaaguagacacaccuuggucaucaugggucagaaucuggguaugucugccccaaagaccacgggcuucugcuggagugaagggccgcaaggagcuccagcccagagcagagggacauggaggagauuaagccaaauugugugugugugcaugcauguuucugugugugcauguguacacgucugugugugugcauguguacacaugucugugugcauguguaaaugugugugcacauguacaaauaaacacauugaucaacguaauguguuugcuacguaacugaucccuucaauuuccccuccuauaaagaaucucaccaaccuaacaaguaaacuuuuaauuuguugucuuauaauuuuauauccugacaguuuuguguuccaucuuaaaaugaaauagaguuuuuugucaucuuuuuuauccaaaaccugcccugccuccuuucuuccuccuuuuuuucuuucucuacuuaaaaugagaacagauguaacccuggucauaauuaaaagaauuuucagagcuucagaggagugcaacgagcacaggcuucgaggacaccagcacaggggggagcaauuccugugugacacugucguccucaugccguugcagguuggguguauguuuacacaggguuuucccauccuugauuaaauuagguccuugcaauaguccucagaggugggaagagcaagcauuuuaucccagugucacagaagaggaaacugaggccaaaaguugagagagauugcccaugauuacuggagcuaaaauugggcccaaguguucucauucccaagcguguauucuugguucucuccaccaucucgaacacaggcgucccuguucccugcagcccugaccugcuucucuugucucuuucuuccacugucacacaaauuccagagggcaauuugagcauagccgcucuuuuaaaugucauuuggcucuuuguggaauccuggcaggaguuaguggagagcagggaggggggucagcccagccucuaccagugcccucucacugccucaggagaauaggacccagggcacuggauagaacaguugggauuaacugaagaacagauacgccuugcacguaugcccuugauauuugagcauucaccuccaaguuuacauuaaaugaacugagagaacugguagaacuggauguggucucagcauuccauacgcauuucacuuaaaguagcccaguuaguuguuaauuaauugguuuguuuacccauccaacgaaccauccaaccaucauccauucauucuucuucauauccuuucuuccuuuuauuuguccuucuuuuguucauauuucucuuuuuuucuuccuuuuguccaucaauucuuuuuuuaauccaucuuuccuuccuuccuuccuucucuuccuuucuuucuuuuuuccuuccuucuuuccauccauccuuuucuuuccacccauccaucuauccaucaucccuucuuucagccagccugcuauugaggcugacagugauuugccucaagaacaaguguuuuagguuuggagagcccuggguuaauguacaggacccaccacuuacuuguugugggacccugaguggauuuaccuguccaaaucuguucagcuaugaaauguaucuaagguagcacugaccucgugagggguugucaggaguaaaugaaugaacgcagcaaagccccuugcauugggaguggcucaugaugccgaugcaguuauguuccacuugcuggguuagacaugucccuuuguggaugguaaucuccucagaaacacacagaaauagcugugauacucugcccuguauuacaggugaggaaacuggcucagacaggucauguaacuuguccaaguuccacagcuguggggugaauuucccaucauugucccauacucuuacuuuuguguuuuguccugucaacacgugauggcuuuugucuugagccaaacucucaaaugaaggugaccacaggcacagccccccauggccucgggugaucuggcuccccagcaacugacugcauuuucucuccuugucucucgcagccggccaagcucgcugaggccuucaaguacuucgugcagggcaugggauacagugaguauggcauuccccgugugcagugggucggggcaugugucggaauuggaagugcucuguccugagccagguuuggaugagcaauucugugucccccuggccagcuucagcuuucugggaggaaacaguuagguguguggagggcauguggcagccuggaggaucuagccucucauuuaucagugaggcucauuuuuccuccuuuguugaauagaaguuguuucacaccagggauuuugggggguuuagaugaggacugucccuuuaagcaccaagacaaugaccaacagugaaacaauaacauuuuuaaaaauuuugaucacaaguuuuaagagaccacuagcuacagugaugaugaagauggugucgaugaugaugaaagauuacuaacacauuauuuuaucucacugaaccaucacaguacuccuuugacauauucuuagcccaucuuaucagugaugaagcugaugcuucgggguuguaagcagggagcagagggcggaucuguggaaauucuuugaagacugugaagcucuguggaaguggcuaacaaaguugcuuacauucaagguggagcaugccauagucaagucaugagcuuugggaaguggaggauacauuggaagcaucauucaggaacucacucguucuuauuuugcaguuauaguuuguuagacacauacagccuuuuuuccagaagugcugucccaggacuaggacagacccuggcgaguuguaacucggcugaacagcagccacacucagugcugugggccugucagccaugguccggcccugacaugacuaguggcucuucugacccuacugcuuggaacuauaauucguguguccucccuuacuaggaaguuauugaacuucugaucccuuuuaucauuuccuuaaacuguuugcccauguauaguaagaguaugcuugguaagcugacugcaguccuagcauuggccuuagccaugauuagcucuagcaaggcgaggcuggcagguuugauuuccaugccucaggcucaggcaggauccacauccccaggugcccucuuccaacagaagcuaucugcuaguggggcuccugccuuucuagccugcuuuccccgacggaaguugcaggcaaagguugucauuggagacagccauggagacagccgcggggcaguccugcuuuacccugcacggugugaauuguggcucccauuugucuuggucccgccaggguuuggauuucugcuuugagaguguguucuggagagaaaggaagugaaugcuagaccucaucuuucuccccaaaucggcuucuauuaccagaaagcugaagccuccugcaggucuuggggggaaaauaacaggaagagcuauggucucaaaggcaucagccaaagagaaggaaaggaaccggucacuggccuucugcacaccacggggugcuggcuugaugaacccuuugcacaccuggcaucagugcucacuguacgcuucucauccugcucaguagacaucccagauuugugggugagaaguaggggcucagagaaauaugugagcugcggauguggcauugaccccaauucuuucugaauucaaaacuagcucuuuaagacaauucagcaaggauuaauucuguuugggagugccugacaucaaaagccccucccugugccuaucaaggagauaacauaagcccugcaugcuugguguggaucaacugccccuguuucugaugucugacucaguguggccuccuagccaugaugcuucaguuggguggaguacuaguuuccuaaagcugccguaacaaaucuccacaaacuggguggcugaaaacaauagaaauccauucucucaaaguucaggaggccuaaaguccaaaaucaaggugugggcagggccuugcucccuccaacgcugcuguggaagaaccuuccaugccucuuccuggcuucugguggccccagcaauccuuggcuuuauguggcuuguggcugcaucacuccaaucucagccucugucuuugcguggacuucuccccugcauaucccugugugcuguuucuauaaggacaucacagucauuggguuuaggguucccucucaacccaggaugauuucaucucaagauccuuaacuaauuacauaugcaaagacccuauuuccaaauaagguucccuucugaaguuucagguaggugugaaucuuccgggacacugucccacccgguacaggugggcaggauuguuccuccucauuccaccccaucagcacgugcuaccccaucagcaugugccacuugcacgugccaugugcaagagcauuugaggucucagagaagaucccaaagaauagacagcgcccuuguuagcaccugggcugacaggcuucuuugggagagaugacaacgaauagccaugccgggaacuugccguguggccccucucccuuuccccaccugugaugugcagggccacugaccccagguguccucccugcuccagugaucauggacagcauggggucaugggcguacacacaggugcugauaccaggggucaguauuuaacauacuugcuuuacagaugggaacagggaggcucagggggacacucucaaaauuacacagcuuuuaacagguggcagaauugggguucagacccagaucuggguucaagucacucauggugugauugcggcaguuccuucccgcaucugggccuugccaucucucucuccgaguggacauggagaggacgggggcccagcagcuggauggcugcagggaucaagucuucucuggggcuggcacguaaaagagcauguggcugguggacgggcaugccuggcuccucaccuggcagucuccugcccucuaaccggcugucucuuguuccccuagugcccucggcuagcaugacccgccugaugcggucccgcacagccucugguuccagcgucacuucucuggauggcacccgcagccgcucccacaccagcgagggcacccgaagccgcucccacaccagcgagggcacccgcagccgcucgcacaccagcgagggggcccaccuggacaucacccccaacucgggugcugcugggaacagcgccgggcccaaguccauggaggucuccugcuaggcggccugcccagcugccgcccccggacucugaucucuguaguggcccccuccuccccggccccuuuucgcccccugccugccauacugcgccuaacucgguauuaauccaaagcuuauuuuguaagagugagcucugguggagacaaaugaggucuauuacgugggugcccucuccaaaggcgggguggcgguggaccaaaggaaggaagcaagcaucuccgcaucgcauccucuuccauuaaccaguggccgguugccacucuccuccccucccucagagacaccaaacugccaaaaacaagacgcguagcagcacacacuucacaaagccaagccuaggccgcccugagcauccugguucaaacgggugccuggucagaaggccagccgcccacuucccguuuccucuuuaacugaggagaagcugauccaguuuccggaaacaaaauccuuuucucauuuggggagggggguaauagugacaugcaggcaccucuuuuaaacaggcaaaacaggaagggggaaaaggugggauucaugucgaggcuagaggcauuuggaacaacaaaucuacguaguuaacuugaagaaaccgauuuuuaaaguuggugcaucuagaaagcuuugaaugcagaagcaaacaagcuugauuuuucuagcauccucuuaaugugcagcaaaagcaggcgacaaaaucuccuggcuuuacagacaaaaauauuucagcaaacguugggcaucaugguuuuugaaggcuuuaguucugcuuucugccucuccuccacagccccaaccucccaccccugauacaugagccagugauuauucuuguucagggagaagaucauuuagauuuguuuugcauuccuuagaauggagggcaacauuccacagcugcccuggcugugaugaguguccuugcaggggccggaguaggagcacugggguggggguggaauugggguuacucgauguaagggauuccuuguuguuguguugagauccagugcaguugugauuucuguggaucccagcuugguuccaggaauuuugugugauuggcuuaaauccaguuuucaaucuucgacagcugggcuggaacgugaacucaguagcugaaccugucugacccggucacguucuuggauccucagaacucuuugcucuugucggggugggggugggaacucacguggggagcgguggcugagaaaauguaaggauucuggaauacauauuccaugggacuuuccuucccucuccugcuuccucuuuuccugcucccuaaccuuucgccgaauggggcagcaccacugacguuucugggcggccagugcggcugccagguuccuguacuacugccuuguacuuuucauuuuggcucaccguggauuuucucauaggaaguuuggucagagugaauugaauauuguaagucagccacugggacccgaggauuucugggaccccgcaguugggaggaggaaguaguccagccuuccagguggcgugagaggcaaugacucguuaccugccgcccaucaccuuggaggccuucccuggccuugaguagaaaagucggggaucggggcaagagaggcugaguacggaugggaaacuauugugcacaagucuuuccagaggaguuucuuaaugagauauuuguauuuauuuccagaccaauaaauuuguaacuuugcagcggc

SEQ ID NO: 17799 - RNA, 1196 nt, Homo sapiens
uggacucugaagaaauggcauauuuuauuaaucuucaaguucuucagcauauuaauaauaacagcuugguauauauuaucgauaaguccgacuauuguacccaaagaauauccagauuauuuuaaggugaguuugcuuccuuuucaucugauucaucauccauacccuguucuacaccuucuaccucuggaauauaaacugcagcauguucugaauuccauuuuucagaguaaugauugaacuagggcagcugguacaagaacccuggaguuucagucauacgauaccaucuucaaaaccuuuguagauuacgucuccuccaucuucuugcacaguuggccacauucuaguaucuaacacuuccuuaaucaaugccacaacuucaucaucuucacauccugcuucuccuugaagauguuuccucaguaacuagggguaaaccagaugcaaagaaguccgugguuguugcguaaauaucugguuucaguaaauuccagucuaauuuuucauuuuccuuuguggcagugaugaaaucuggcccaaagaaaacacuuuuuacuccuucaauccuaaauaacugccuagccaaaggggagcaaaaugcugcagcuggggugggaaaauccaugggccuugucucaaaaacugguuuucaugguauaaacuuuaaacuguuaggauuugagauaucuuguguuugaauaaacauguaucucacuggguuacaaaaggcugcagguagugggaagaguagucuuucuacaaauugaugcagaggcuguuucucuuuuuuuugagacagagucucacucuguugccuaggcuggagugcaguggcacgaucucggcucacugcaaccucugccucccggguucaagcaauucucugccucagccucccgaguagcggggauuacaggcaacugccaccacgccuggcuaauuuucguauuuuuaguagagaugggguuucaccaucuuggccaagcuggucuugaacuccugaccucgugauccacccaccucggccucccaaagugcugggauuacaggcgugagccaccaugcccggcccagaggcuguuucuuaaugguguauagauugauucuucaacaaaugauagaaucaccugcgcagccccacggcaacagucacagcuccccagccaugccgggccucugcugccaucuuaguc

SEQ ID NO: 17800 - RNA, 1196 nt, Homo sapiens
gacuaagauggcagcagaggcccggcauggcuggggagcugugacuguugccguggggcugcgcaggugauucuaucauuuguugaagaaucaaucuauacaccauuaagaaacagccucugggccgggcaugguggcucacgccuguaaucccagcacuuugggaggccgagguggguggaucacgaggucaggaguucaagaccagcuuggccaagauggugaaaccccaucucuacuaaaaauacgaaaauuagccaggcgugguggcaguugccuguaauccccgcuacucgggaggcugaggcagagaauugcuugaacccgggaggcagagguugcagugagccgagaucgugccacugcacuccagccuaggcaacagagugagacucugucucaaaaaaaagagaaacagccucugcaucaauuuguagaaagacuacucuucccacuaccugcagccuuuuguaacccagugagauacauguuuauucaaacacaagauaucucaaauccuaacaguuuaaaguuuauaccaugaaaaccaguuuuugagacaaggcccauggauuuucccaccccagcugcagcauuuugcuccccuuuggcuaggcaguuauuuaggauugaaggaguaaaaaguguuuucuuugggccagauuucaucacugccacaaaggaaaaugaaaaauuagacuggaauuuacugaaaccagauauuuacgcaacaaccacggacuucuuugcaucugguuuaccccuaguuacugaggaaacaucuucaaggagaagcaggaugugaagaugaugaaguuguggcauugauuaaggaaguguuagauacuagaauguggccaacugugcaagaagauggaggagacguaaucuacaaagguuuugaagaugguaucguaugacugaaacuccaggguucuuguaccagcugcccuaguucaaucauuacucugaaaaauggaauucagaacaugcugcaguuuauauuccagagguagaagguguagaacaggguauggaugaugaaucagaugaaaaggaagcaaacucaccuuaaaauaaucuggauauucuuuggguacaauagucggacuuaucgauaauauauaccaagcuguuauuauuaauaugcugaagaacuugaagauuaauaaaauaugccauuucuucagagucca

SEQ ID NO: 17801 - RNA, 5606 nt, Homo sapiens
uccugcugagucugccuuucuuaccugccuuaggaaggcugcaucugcgccagcugggaugcaggcugccuucagucaugcuggaguuucuccguguagacagcgcaagggcaggcggaagcuugauuuccccgcagaucccagcagcagcccaucaccuugauugcuccuaaucagggcgaacugagaaaagcaaagcaggaacaucugcucucuuucugccacuuaaaaccggcaaaaccacuuuaaguuucauauggaaccaaaaaagagccuguacagccaagacaauccuaagcaaaaagaauaaagcuggaggcaucacgcuaccugacuucaaacuauacuacaaggcuacaguaacaaaaacagcaugguacugcuaccaaaacagauauauacacaaauggaaagaacaguggccucagaaauaaugccacacaucuacuaccaucugaucuucaacaaaccugacaaaaacaagcaaugaggaaaggauucccuauuuaauaaaugauguugcgaaaacuggcuagccauaugcagacagcugaaacuggaccccuuccuuacaccuuauacaaaaauuaacucaagauggauuaaagacuuaaacguaaggccuaaaaccauaaaaacucuagaagaaaaccuaggcaauaccauucaggacauaggcaugggcaaagauuucaugacuaaaacacaaaaagcaauggcaacaaaagccaaaauugacaaaugggaucuaauuauacugaagagcuucugcacagcaaaagaaacuaucaugggagugaaaaggcaaccuacagaauuggagaaaauuuuugcaaucuauccaucugacaaagggcuaguagccagagucuucaaggaacuuaacacauuuacaagaaaaacaaacaaacaaccccaucaaaaaguuggugaaggauaugaacagacacuucucaaaagaagacauuuauguggccaacauacauaugaaaaaaagcucaucaucaauggucauuagagaaaugcaaaucaaaaccacaaggagauaucaucucaugccaguuagaauggcgaucauuaaaaaggaaacagcagauguuagagaggauguggagaaauaggaaugcuuuuacaccauuggagggaguguaaauuaguucgaccauuguggaagacaguauggcaauuccucaaggaucuagaaccagaaauaccauuugacccagcaaucccauuacuggguauauacccaaaggauuguaaaucauucuacuacaaagacacaugcacacguguguuuauugcagcacuauucacaauugcaaagacuugaaaccaaccuaaauacccaucagucauagacuggauaaagaaaauguggcacauacacacuauggaauacuaugcagccaaaaaaaguaugaguucauauccuuugcagggacauggaugaagcuggaaaccaucauucucagcaaacuaacacaggaacagaaaaccaaacacugcauguucucacucauaagugggaguugaacaaugagaacacauggacacagggaggggaacaucauacaccggggccuguugagggauggagggcuaggggagagauagcauuaggagaaaugccuaauguagaugacaggcuuaugggugcggcaaaccaccauggcacauguguaccuauauagcaaaccugcauguuguguacauguaucccagaacuuaaaguauaauuaaaaaaaaaaagaaaaacuggcaaaacacugccaucaauauggucacucaacaccaaugcaaagguguguuuuaagaauccaauacauugucacuaacuguaguugccaugcugacccauagaucuuccuccuguacugcaguaauuuugcacucuuugacuaacaucucuucaacugcuccagccucugguaacuuccauucuacccucuccuucuaugagaguaaguguuaaauguucucaccacaaacaauggcuaugugagcuaaugcauauguuauuuagguagauucagccauuaaauauauauauauacauauauauauguauauauauauauauacauauauauauguauauauauauauacauauauauguauauauauauauacauauauauguauauauauauauacauauauauguauauacauauauauauauacgcgcacacacacacacacacacacacauauauauauucagccauuaaagcauauacgcauauauauauauauaugcuuuaaaguaucaaguugcaugugauaacuccauacaauuuuaucugucugcacuuugagaggucaaggcaggcagaucacuugaagucaggagcucgagaccagccuggccaauauggcaaacccccaucucuacuaaaaauacaaaaauuaguugggcauuggguggacaccuguaaccucagcuaccugggaggcugaagcaggagaauggcuugagcccaggagucagagguugcagugagcaugagaucacaccacugcacuccagccugggcaaaagugagacuccgucuuaccaaaaaaaaaaaaaaaaaaaaaaaugccaaaguaaauuccaaauacagaaugcuccaguagcaaaauuacgaaugccaacguugauccauccucucuuaagaaggaaaccacacgcuggcuuaagucagaaugagaugucuacaugucuuagucacaaacguccauaaagaacggggcugacuaguccugcauucugcccuuguggcauaguuagaagccugaauucaagacguggcuuugccgcuugucauguauuacaccuuugacaaauacuuuuguucaauaaauaaauguuaauuagaaacuacuuuucacuaucaucucucucuugaguugaugcaaaagcauccuagagggcucuguaugugcauucugacccccuccaucuguuccucaugcugccgucagagccguaaaauacucuccugccuccucucucugcaaauccuacuuugguggucagaucaagccucagaauuacuuugauuuuguucagcaagucacacuucauuucgccucugugccuuugcaugguguugcuucuaccuguggcaucccuaucuccucagugcuacccuguguguuucacugagccagcuccucucccuccaucaggucucugcuuugggaaacauucccugacuauucaucugaaucagacauuucuucaaagucccacgacaccucuuaccacacaauucccaggauguuguagcuuuuauguuuuaucucccaacacacggaauucuaugaaagcaggaccccuuguucaccauggauccuaagugccuacgaaguuaucuggcaacgaguaagugccauaacauuacuuuuugaauggauagaugaauggauagauugaaugaauggagaggauggauggauggauggauggauugacagauggacggacagaugaauggcaaugucagugauagucucugaguauaaaaaggugaaagagaagaaagccugugucuuccaggagcuuacaaagaagaagcaacaagaagcagccacaaagaggcaaugucaccugaguaggaacacgugugagaaggggaagauuagccagccucugcaagaggcucaugacagcuucuagcgggagccacaaccucagcugagucuugaagaaugaguagaaaggagcaagguaaggaaggaggaagggaaaaggcagccggggcaaugucaggaaucaaaggccagggagccccagaauccagacauuugugcgaagcuaauucuguacaaauagagcaucauauauguggggugugucaggugaugaggcuaaagugcagaaucagaagaggucagggcuggagauuccaaucagauggccaucugcuuacaauggaggcuaaauucaggagaggagauaagagcaucaacccagggcacaugcagaaaggaaggagucuguggaacacagauguuuaagggauaagggacagaauggagacaggaggagggacagauaauggaaaaagagaagggccaaucagaggaaaggaggagaacaggggagggugcugauguggaagacaagggaaagggcaguugcagaguaaaguggauguggcuaaccucaucacugcagcaaagaugguaugaccuaaccaaagcggugucagugaagugcagaggucacagagagugggaagucagacagucagacuguaguacauugauaaggacaggagaggugagaaaacagaaccagcaagaacuccccacucacucaagaaccuccaugcagaaggacaauaggagagagaaaaacuaaaagcagaacguagaaaauguaggagcaagagagaauuucauuuuggaauugggaaugcuuagccaucuuugcaagcuaaaaggaaauugucaggagggagcaaaagaucaaagagaccagggaggaagggacagggggugaggauguacagaaguggccagggucucacacacacaggugaggggcuggccuugucaagcggaaauugauagccucagaaggggaagacacacagguuguggagguaaguaagugucuagauagggaauaagaauggagauaauuaacuucucuaagcuacgguguucuugucugcugaagguggagcauguauuuccagugugaaaugggcucguaugugagagcaccauauacuucuugaaacuguccuucacugugaccguguggaaugcgagucugugaaguugaaacaugccugcagaaauucuaacguuuuaaauuaauucaaggaaaugaagagguuuucaugaagaugagccaucuuaaucucuauuuuucagucaaaaaauacauuagaugaaucaaaauaaguguuaacggggcuucccucgucucaaaauuuaagcucuggcagcacuggacugcuuacaggaaguccaaccuaaugaaaugggcacuuuugcaaaucaaaacauguugauagcagcaauuucauacaguuccaucuaagaagcccccugacagcccaggccuuuacucacccaaaaccuucauucaggcucugcucuccauuuuaaaagucaccuucccuuccacaccccuaucccucccuaaagugccagcuagcuccuaaccuauucuuuaaggcacaaucuagccaucacuuccuccaagauuuccuugagccguguauuaguuaucuaugcuacauaacaauauuaccgcaaacucagcagucugaaccaauauauauucauuaucucacaguuucuaugggucaggagucagggcauggcuuagcuugguuuucugcaaagcugcaaucaagguauacuggucuuggcugaguuuucauucaaaggcuacccagaaaaggauaggcuuucaggcuuaugugguuguuggaagaauccauucccuugcagacuguugaaacuggaccucacuuucuugcuggcuguugguuggaggccauacucaauuccuuaccaccugggccucuccauggaacaguccacaacaaggccacucacuucaucaaagguagcaaggaagagucagcuggcaaa

SEQ ID NO: 17802 - RNA, 1603 nt, Homo sapiens
aucacagcacaggaauaacacacagggugguggagaagccagggccagggugucaccaggucagcacaaugaccacaucauccuucuugaagaagccucaggccuuaccaacauucauggccaaguucacucggagguccacauccucagccuagggcuccuggaugggguccuuacacagcacagggaagauaccacgguacaggugggccuggcgagcugccuggggaugccaugucacaacaaucaugggggcacgugggcaguaucuggccaccuggugggcacaccugcagacuuggugaggacgauuauggccccacugcagcacuugaaggaggccuccacagugcccauggcaguagcuucugcggggucacugguaaugggugccagguggcagaacuccucaaauaauugcaagugguagaugguggccucugccucacaggcaaucaggugcugcaugugcacagccuccagaggauaguucccuuuggcuguuucuccagacagcaugaugcagucagcuuccaccagaacugcauuggccacaccacugcccucagcccaagugggguggagcuucuugaucacauccucuagcaucugaguggcaagaugacaggcuucccagcuugguugcaccacccaaucaucauccucugagcaaggcagaccuucccugcaggaaucucaucucgacggcuugugguggaucaccacgagcuaccauaaucccaucgcuggccuccaggauuucaucaaaccuccaacccccaucaugauucucaauuuugcugguuaucuugcuguucuuuccuuucucucccaagaccuuccuaacuucauggacaucagaugucuugcagaugaaugaugaaaacaucauaucgacaucuugcucgcccccaaacuucagguccuggauguccuucuccaacauggcagacagguccacggcagccccaggaagguucacacucuucuugcugcccaaggagccaccauuuuccaccucugucaccagaaagugagcauccuucugcuucacuuggagagaaauuagcccaucauccacguagaucuugcagcccacuuccaccaccuugcagauguucuuguagucccgccacaggauguucucuuacccuuuuccauguagguauuauccagcgugaacuugagaguggcucccuucuucagcuccaccucugcagugccgcugcccuugacgggcccaguugggaucucagguccuuuagugucuggagccacagcaaugggcugguagaggauggagucagaagcaaagcuuuccguggcugugcgcacguucuugauggucucuguaugguacucaugggcuccaugagaguucagaugagccacauuaauuccagacuuaaucguuuucuucagcaucucuagcaauggagaagcugggcccauaguacagaugaugccagugcuccaggcugugauggguggcgagucaguguccaggcagcacaugugcuccaagaaugugucagccauggcugcgugcagcugcugggucugaaugaaggcagcccuggcuucacuauggggcuucaacaug

SEQ ID NO: 17803 - RNA, 2838 nt, Homo sapiens
uuugcucagaugguccaucucuucccccugcuguggucucuggccaaggagauaucuagguauagcaugaaauggucucagaguggggagggcaggggccaaguuaaggguucaggguucuuucuucucuuaauaaaacagcacuaaacagagaugcccaacuccuaccacucaaucagcauuagaaucagauccucaaagccaggaggaagcuugguccaagucaucucacugagcagccuuuguuuucagacgaggacauugagguucagagaaggcgaacacuuaucuagaggucacagagagaggauucuaggucuucccacugauuucucuaccauguuccuggcuacuucuguugcuauuuacagccuucugaagaucucuuguugcuggacaauuuuaguuucuuagccccaggucucucuuccucccucuugcaccugguaauuucuuucuuucauccaagugauuuucauacccuucucccaguuaaccaugcccauucagcaagguggucgaagucacagcaggcugcuuggauguaggguucaacuucuguuagaaugagcucaggaagagccacgugcuaccagaaucacccaaggugagcccaccagccaguaccuagaaaucaacaugccuuguagguauuuagggaucaucaguaccaccgcccaaccuuccuccuauauuuggaguggauagaugaagauugagcacucuuaguugaaaagaguucaagugagaguaauaucucuaagaccccugggggcaacacuugcuagagaccauccagcuauaauccucauugcacccauccuggguggaaagugcuguguuggccuucagccuguuagacucuuuuacguaggacugaaccaaccccucuggguuuugagauacuugguugucccuacagcuaguaucagaucuguucuuuccaccugcacugcuucaucuugaaauccuggcaacagccccuuaagcacagcgagcugccuggcucuacaugugaacccccuuggaagcaucugcgcgcucccacugugcauggcugauugggaggggaaugccugcauucaggcauggucacagcagcucauuugcagcccaggauucccacugggguccaucauccuuucaggagaguuggcaaauggacuuagaccacuguccacaaaagccuccuugggaggugcucauuaaaaccccacccaucaaagggagggagauugaugaaucucagcucaccuguuccuuaucugugcacagggccuuaagagaacauugggacagcaugagaagcuugcagauaagccuaggcaggucguuuuucucugccucauccauaucuggaagccaauggguccugauucucacugacaaucacuugcagcuggagggaagaacaggguuucucagaggccucccuugucugugcacauuggccaggagagggaggugagcaaggagaaaaugaccaaaaaaccaccaucacugaggcuuauggcuccauuucuuuuuguaauauucuuuuucaaaugacaggccccaagauacccuuugaagcccucugcagaggcgccugccccuguccuaucagugcacuggccccgucaucagugaagcacucuggcaaacuguggcuuuguucuggaaguggagugacuuggggucugucccaugcaggccagcugccugugggucuaaaguggguuuccuccagagucguggccagcacagacccuggaaacaccguagaugaggacaggauggcaggcaggggaccuguuauugugcugugcuccacugagcuccuggaagucauuucacucccugggccucuggggcuuccccaucaacacaacgagacagcuugggugagauuuaugggcacuuagcacaaaaccaauuugacccacaaaagcauuuggccuggauguucugaucccugggcacacuugaagcuugagccacccagaagaaagccaaaaaucacuuuguuuggcaggggauggggagcuggggaagaugaagagggaccggcaauagcagagagaaccaugguggucacaaaccaaggccaggugcauucugggcuccccaaagcgcugagcauaaauccauucuaugugguucuuucuugaccacaccugauagaggcugcugauucaggaaaacagcaaaucuaugaccacggucccccacacugaccuucuauguugaagaucccagaauuacaaagaaugguccaaugagcuucccuagaccucucgcccagacccccagccucaauacuuugccacccugcuccccaacucucacucagauguuuggacaaugugucgucaugucugcaacuuuucagugguucagccaaagaagaaauuguccgccaugaacaagagcacucuccuaccuaacggugccauugucacgccuaagaaacauucauacaaucuuauugucugauacagacuguauguaaauccccaauugucccaaaaauguccaagagcuuauugagucuaaaauacaacccaagaucaccucccauaauugcuugucuuguuguuccagacuucccccaaauaggacguccccaucaccauuucugucuucacaauguuggccuuuuugagaaguccuggccagggucuuauagaauaaugcccugugaucuccucugcuuguuuccucagguuaagacaguuuuggcaaaaaaaacccaacagcguugaugucgagcagccaugauuuaugcauuugauguuuggcucucuggggaccucugugguaacugcuuucauuguggauaaauaagucauauuaaau

SEQ ID NO: 17804 - RNA, 483 nt, Homo sapiens
acccacgaacuggcccggcccucacgugcaccaugucuggcuccuccagcguugccgcuaugaagaaagugguucaacagccccggcuggaggccaggcucaacugcauaaaaguuucccaggcagcugcagacuucaaacaauucugucugcagaauguucaacaugacccucugcugacuagaguaucuucaaguacaaaucccuucagaccccagaaaaucuguucuuuuuuguaguaaaaugaauuucaaaaguuucccaaaccacuucuuaugauccaguggauauucaaaagagagcuaaauuugaagccuguacaaaagcuuaucccuguagcacaugugcuguaauauacgaacuucuaguuucaucagucuuuaacaucuaccucucugaauuucaugaauuucuauuucacaaggguaacuguuuuauccacacuggcagcagcauacaauaaaacucaguaugaaaaaaaaa

SEQ ID NO: 17805 - RNA, 919 nt, Homo sapiens
uuuuacauguagcauuuuguuuugcuuuuguuauuuuuguuuugauauaugcuuuuuggaccccaauagacuguugaaagaaauuuaaaaauuacucuuguagggauauaguauccuuaaaaaauaaaaauuuaaaaaaauuuaaaaaaauugcugcaauaucuggcucgaagguugcccuauauuagaauaauacuuuagccaaauacaccugaggaggcagacacuguguuuauaagcagacaauaauguucugaauccuuccuguucaugcugcuuucuuaauucauuucuccaugucaucaagagguuggauaacuuauuucuaagcucaagguuaaaaaucaugucaccuuuuuuuuuuucccccaacacagaccucagaaaaauugcgauugaggaaguagcaugauccuaaauguguugcugaaaucaggcagcccgagccucuggucucuccagagagcccgucuucacauuucucuauuccucagcacucacccgaaacugaacagauggggaguggucuugauugucaagauaaaacuggugaagaaagcuaaaugcugagaaacugagcaucuauugucguguuuaagcuuagcuggguccuuucuaguuuguuuuuacagcuuacuaggugaaguaguuugcacuauuuuugcaauaaauucauggaaaaccuaacaguuacuuguuuuguuucuuacuguguguauauaaacuaauacuaaaaguuuggcauaguguuuuuucaccuccuuacauaaccccuaacaugcacagaaugcuguaaaucugauaaaauaugaugugaaugauauuuuauaaaguuauuuuguauggugucaauuuuguuuugccucauaguaugucagcaaaaaauuaaauaaaaguccuccuauuuacagcugccucu

SEQ ID NO: 17806 - RNA, 1102 nt, Homo sapiens
cuugauaagcaaaagcuuuuuauuuuacuucauuuuuacuuuuauaaaagcuccuaaugcaaugacgugugucaccucucugggcuucaggguguucaccuuucaaaaggccucggugccugucuguccugcuuccuggcuugugguuagcaucaaaaugacaccauaaaaaugaaaguugcagccuugaggguucuucugguuucauuuccgaccacaagguugccagagugacuuuuuuuuuuuuuuaaauaacacaaaucaguuaucacuuccugcuuaaagcccuccaaagguucccuguugccuaaagaauaaacuccaggcaccuaagcaagccccacgcagccgucugcauuuuucaaucccuccaaccucgccuuuugcuauuucccccaccccaccuacggcacguuccggucauaaccaacuagcuccucgcugaaacuggcucacaccgcggaagcccgggucggugucggggcgagccuucccuccuuuuccuggagcccgucucaggucuguagcccucgggagggauugcagggcucguucccugcuggcguucauuuagguaaccugucuaccuccaguggacuucuaagucccuuucaugauuuuucaucuuccaaaaucaaauaauggcccagcccaacuuagcuauaaugccaugaaaagaaucucugagccucaguuuccuugucugcaaaaagggcccaggaaccgcucguuagggucgguguggugccuggagagugcacugcaaggcccggggcccgcagcgggugcccgacagcgggcguccaacucugggggcggggccgcagggccgcucaggagggagguucuccagaggggaccccuucgggauuugggggcagggaaggagauggggaggacuuucccgaaguccgucuaaucccgcuggcggagagcgaggcaggugggaccccaggauguccgcucggcggggcgaccccggccacccccgagaccagggcuuuccucguccggccgccacgcccgcgcgcagccucgggccaccccgaaaccccggcgcggucacuacaggacaaauuacgcgagcagagccuagcggcgc

SEQ ID NO: 17807 - RNA, 1202 nt, Homo sapiens
gcaguacauugagcuccauagagacagcgccggggcaagugagagccggacgggcacugggcgacucugugccucgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaaguugguuguagcgcaguuuuuuuucuugucuauaaagcauuuaaccccccuguacacaauucacucuuuuuaaagaaaaaaauugaaauguaaggcgguguaagauuuguuuuuaaacuguacagugucuuuuuuuguauaguuaacacacuaccgaaugugucuuuagauagcccuguccuggugguauuuucaauagccacuaacuuugccugguacaguauggggguuguaaauuggcauggaaauuuaaagcagguucuuguuggugcacagcacaaauuaguuauauauggggaugguaguuuuuucaucuucaguugucucugaugcagcuuauacgaaauaauuguuguucuguuaacugaauaccacucuguaauugcaaaaaaaaaaaguugcagcuguuuuguugacauucugaaugcuucuaaguaaauacaauuuuuuuauuaaaaaaaaaa

SEQ ID NO: 17808 - RNA, 3441 nt, Homo sapiens
ggaaguuucaguguuuuauuaacaaaaucuuacaaaaagagucugucucugggguaaggugcacagggccuggaccgacauuuaaggccuggucuguguggggcaaggggcagggguuggccacagccucaugagguuuccagggucuucacaggcuccagggcuuccccaaagccugugccagccuugaggauugguuauggcuuaugugcaaaaauaaaaucuguggggcuggcagggugugggcugaagacuugucagaguggucugcagggcuggucccccaguggacaaggcagaacgaugaacccugagccagcaccugcuuaggcugcagacgcuaguggcccaccagcaccaggguucuggugucggggcagggcagaaugccuggaagcgccccaggagccauggcuucugggauguccuuccugcagcugagcucagggcugcugggcagggguaggagcuguggccccagccuuggggcucaugaaagccucuggcagagaggauggccuggcagcgggcgggguuucccugcugggagggaggcagggcccgacuccugcugcaguggcucuggggacgggcagcuggcggccagcggggcgggcuuaguggcaggcccugguccucgcgcuggcgcucagggcuaagcuggggcuccugcccucugcugcagccgacuccucucuguagccccccucugggcuguccugggacuucgccucccacgcaggcagccugcaaggugagggguggguggugcccagcacagcagcaaagacuuugugggaaccuugagaccugaaagaacaggagagugggcagugaaggaccacgcaggacaguagccagggcuccauggggaggggcuggggccgguggauggcgcuggucuuccaaggcagaggccccccgaccccgucagagccucccagcgagcccgaacacuggggaguggccugggccgcagggugucuggggucuggggaggagcucauuuggccgggacagcugaugguggggucuggguggaaggguggugcuccguuaccuguugucacucuccuggcucugauggugccagcugcugccucagccggauuugaggacucagccccucugggacccuccgccugccaugggugagucaugagcugagcucugauucuucuccaggcgggcgugaaucacuggagcugggggagagaaagcgcggguccaugugagagcuggcucagcaaacugccccugccucccacccggcccacucuccccaaugcccccuuccaugaugccagccccaccccaucccuuuggcuaacuugcugggggcccaagccucagugggcucuccuagaaaacagccuccggaucccgccagcucucagaugccccacagccgguacugccuuggggcaggggcucaccugaggggccaggaagcaccgggacaucaggucugcucugcugcgugugcgacuucuacucuccccugggaggagggggccgcgcugcccgaggcuggccagcugcccugggaggcagggagggcgucagcuggcucugcggaugccgggagagggcggcggcgccggaagucgaggcucccucagcauuggcucugcccuagcuucugcucugggugucccaugagcuugguggccgcuggccccugccauccggacacuugguuuucuggauguccagagggccuggguguuguagcagaaugaggaagcugggguguucugugauggccugagaguguggagggugggguccaggccggaaagacagacggagggagggugauggguggagcccugcaggggggagggcucuuugccgcugggugcggugcucacaucuggaugacacgagugugugcgaguccgcccggagcucgagggggcacccagcuggaccagggcuuccccugcaggagucagccccagcucaaaaguccuggugggcaaagccacaggcuggauguagugggcaggcugggggcuccgggaugcccucuacucgggcuggguccggucacuggccacggacucgcuguugggggcgggcgugagggucuccgccucauccuccaccgggaggugggggccggccggcucggccgccugcuccaggucauccugcaccuccaugccccucuggaugagcugcuccagggucuugggcaggggguggcgcaggaaacgcuugagcuugggcugcagggugcccaccacguacuggaugaucuccuccucguccgcguccacguagagcgucugguacaggucccgcuugcgccacaggaacugguccagcggcucgcccugcuucugcggcagguccagcucgcgcuggauggccucucgggacagcgugcccucgcuguacugcaggaacuccuucuugaacuccacccaguucuucacggagcccugcuugaacucccaccacuucuuggccggcccguucaugugauucuggaucugggacagccaguacuccucagagccgcccaccugccgcaaguacuccucuagguggcucaggaacucucgaggguccucgaagaucugcguguccacgccggggcugggcugcccguccucgccggggacccacggcugguacugcugggccucggcgggcuccugcccgggcagcucgccagcggcugggggcggggugauggcguaggggcugacgguguagucguagccgucugccucguggcaguagcucucgggaccccccacgcccacggaaacgguguggcgggcugacucgcugcccaccggguacuugccgcccguggacuccaggcggucggcccagcgcuccaggcgguagaacaccucgcgccacacgugcaucucgcgcuugacccagcgcuccagguuggcgauggucuccuggcagcggcacaggcaggccuugauggacuucuuccagcgcugcgagucgcucgugggcacguagccguccagguugcucuccagcuucccgaccgaccggugcagccccuucagcucgcgcuccaccugcuuggacaccucggccagcaggugccggugcguccgccgcacgugcuccagcaucucggcccggcacuucccgaucugcaggaucacguugggcuuggccaccugcccgccccgcggcccgggguaggcguggagcccgccgcugguccggugguccagcuccaucugugcgcaggugcuccggcaggcggcaaacuccucggggcggacagagggugguccggcgcugggguccggcggccugggucccgugcggagcugcggggagcgccugucugucgcugcgggccggcggcggggccggcggagcacgcccggggaggcagguccggcucggcugcugcggagggaggacgccgcgcccgagcucugcgcugagucc

SEQ ID NO: 17809 - RNA, 3441 nt, Homo sapiens
ggacucagcgcagagcucgggcgcggcguccucccuccgcagcagccgagccggaccugccuccccgggcgugcuccgccggccccgccgccggcccgcagcgacagacaggcgcuccccgcagcuccgcacgggacccaggccgccggaccccagcgccggaccacccucuguccgccccgaggaguuugccgccugccggagcaccugcgcacagauggagcuggaccaccggaccagcggcgggcuccacgccuaccccgggccgcggggcgggcagguggccaagcccaacgugauccugcagaucgggaagugccgggccgagaugcuggagcacgugcggcggacgcaccggcaccugcuggccgagguguccaagcagguggagcgcgagcugaaggggcugcaccggucggucgggaagcuggagagcaaccuggacggcuacgugcccacgagcgacucgcagcgcuggaagaaguccaucaaggccugccugugccgcugccaggagaccaucgccaaccuggagcgcugggucaagcgcgagaugcacguguggcgcgagguguucuaccgccuggagcgcugggccgaccgccuggaguccacgggcggcaaguacccggugggcagcgagucagcccgccacaccguuuccgugggcguggggggucccgagagcuacugccacgaggcagacggcuacgacuacaccgucagccccuacgccaucaccccgcccccagccgcuggcgagcugcccgggcaggagcccgccgaggcccagcaguaccagccguggguccccggcgaggacgggcagcccagccccggcguggacacgcagaucuucgaggacccucgagaguuccugagccaccuagaggaguacuugcggcaggugggcggcucugaggaguacuggcugucccagauccagaaucacaugaacgggccggccaagaaguggugggaguucaagcagggcuccgugaagaacuggguggaguucaagaaggaguuccugcaguacagcgagggcacgcugucccgagaggccauccagcgcgagcuggaccugccgcagaagcagggcgagccgcuggaccaguuccuguggcgcaagcgggaccuguaccagacgcucuacguggacgcggacgaggaggagaucauccaguacguggugggcacccugcagcccaagcucaagcguuuccugcgccacccccugcccaagacccuggagcagcucauccagaggggcauggaggugcaggaugaccuggagcaggcggccgagccggccggcccccaccucccgguggaggaugaggcggagacccucacgcccgcccccaacagcgaguccguggccagugaccggacccagcccgaguagagggcaucccggagcccccagccugcccacuacauccagccuguggcuuugcccaccaggacuuuugagcuggggcugacuccugcaggggaagcccugguccagcugggugcccccucgagcuccgggcggacucgcacacacucgugucauccagaugugagcaccgcacccagcggcaaagagcccuccccccugcagggcuccacccaucacccucccuccgucugucuuuccggccuggaccccacccuccacacucucaggccaucacagaacaccccagcuuccucauucugcuacaacacccaggcccucuggacauccagaaaaccaaguguccggauggcaggggccagcggccaccaagcucaugggacacccagagcagaagcuagggcagagccaaugcugagggagccucgacuuccggcgccgccgcccucucccggcauccgcagagccagcugacgcccucccugccucccagggcagcuggccagccucgggcagcgcggcccccuccucccaggggagaguagaagucgcacacgcagcagagcagaccugaugucccggugcuuccuggccccucaggugagccccugccccaaggcaguaccggcuguggggcaucugagagcuggcgggauccggaggcuguuuucuaggagagcccacugaggcuugggcccccagcaaguuagccaaagggaugggguggggcuggcaucauggaagggggcauuggggagagugggccgggugggaggcaggggcaguuugcugagccagcucucacauggacccgcgcuuucucucccccagcuccagugauucacgcccgccuggagaagaaucagagcucagcucaugacucacccauggcaggcggagggucccagaggggcugaguccucaaauccggcugaggcagcagcuggcaccaucagagccaggagagugacaacagguaacggagcaccacccuuccacccagaccccaccaucagcugucccggccaaaugagcuccuccccagaccccagacacccugcggcccaggccacuccccaguguucgggcucgcugggaggcucugacggggucggggggccucugccuuggaagaccagcgccauccaccggccccagccccuccccauggagcccuggcuacuguccugcgugguccuucacugcccacucuccuguucuuucaggucucaagguucccacaaagucuuugcugcugugcugggcaccacccaccccucaccuugcaggcugccugcgugggaggcgaagucccaggacagcccagaggggggcuacagagaggagucggcugcagcagagggcaggagccccagcuuagcccugagcgccagcgcgaggaccagggccugccacuaagcccgccccgcuggccgccagcugcccguccccagagccacugcagcaggagucgggcccugccucccucccagcagggaaaccccgcccgcugccaggccauccucucugccagaggcuuucaugagccccaaggcuggggccacagcuccuaccccugcccagcagcccugagcucagcugcaggaaggacaucccagaagccauggcuccuggggcgcuuccaggcauucugcccugccccgacaccagaacccuggugcuggugggccacuagcgucugcagccuaagcaggugcuggcucaggguucaucguucugccuuguccacugggggaccagcccugcagaccacucugacaagucuucagcccacacccugccagccccacagauuuuauuuuugcacauaagccauaaccaauccucaaggcuggcacaggcuuuggggaagcccuggagccugugaagacccuggaaaccucaugaggcuguggccaaccccugccccuugccccacacagaccaggccuuaaaugucgguccaggcccugugcaccuuaccccagagacagacucuuuuuguaagauuuuguuaauaaaacacugaaacuucc

SEQ ID NO: 17810 - RNA, 2240 nt, Homo sapiens
ggucucucuggcuuauccaacagguguuuauuaagggccuacgcugugcugaggcugccauucagggagccccacgaaugugaggccuggccccuuccuccaggccuccaggccccaucucuggagacucccaggaacucacgucgacuccuguccuccaguucuacucaguccacuucaucucagccuuuaccgggcccuccugagugccuguccccugcugggugcgggggacaccacggaccagaccuggcucaagucauagauggggugggcagggaaggcuuccugggggaagaggugccugagcacaggguuaaggguggagaaugcugggccauggaaacagcagcagagaggguuggaggggccaucugcaggcggaucugugucaauagagccgaucugccgggugggaguccuggagagggccaugggagggucagggugggggacaggggcgcagacauacauggucagacuugcguuaggaugugccucaggaaccaggacaggcucccacugggccgggugugugaggaguggcacagaggccuggggcaccacacccagugugggcugcagcggggccccccagagccuagagcuggccggguccccagagcagcaggccgagugcagggagcagcgcaaggauggcagcagccggcugcagggcaugggccccgcuggcguugcacaagucggugucacagcacgugauguucuucuugcccacguaguaguccugugagucauccacgcaguucaagcugcagccuuugcugaugacggucaggaggccaacugcgccuggggagcagcgggauccggggauggggcugcccugugugcucaccugccugaccugccccaggccuccuccugucccacccugccuaaugcucuagagucccccugggcuggccucaggauugcaagcagugcgagggccuggucucggcccuggucucagcccuauccagauguccgaggcagauggaccacccgcugagcgucagaaauggggugagugaguaagugagcucagggauggggagggacagauggguggaggaguggaagauggaggauggggagggacagaugaguggaggaguggcagauggaggaggauggcuggagggacagaugcugggugauuguugggggugcaggugcgggacgggucggggacagguggaaggaaaacagcacacagaugcggacagauggccagaaagauuaauaguucaguggcagagaccuaggccuggcggcugucguccccccacucacggaugcgcgcgguccagcacugcucccccagcugggugcaguucuccaccugcaggcaguccucguugcucaccugggcuuugcaggaguagcacagcagggcagugccugugggguggagugggaggggccucagaggcugccccauagcacuccccaggaaugggggcucccaggcaggugggccuccauggcgguggccugaggaaguccucggcgcccucuugucacccucaaugucuccuccccaucuucacggcccccugcucagugccuccgaaauguugcccuguuuagucccucgguggcugcuuuugugaccguguguuucagaagaggaagcugcggcugugggggugacugaacccgggacccugggucgggagggucccaccucaagcagagcagcucccugggacccuuggaagcugcagugcugggacugggccggauguagacccccggguccucgcaggacacccccagcaccucccccuugugccccaaaaaccacuucuuagccugaggcuuccugucccaugucucccagcuccucaucagcaucucugcccauccauccgucagucugucuaccugcccccuaggagccaggcccugccccacgguggugaaggagagugacuccgugcugccccugcaagccccggucacaggggacggcagggaacaggucgcugccuggucgugccaagagcuucccuggaggagcggaggcuagggcaagagccucacccccuuccucucccuuccuccuuccuuccccuccucuccgugugcccugcagguaucccucuggccuccccggcucaccccugcucccuucccugcugggggccagccaaggccucaccuggcugcagggccaagccugccaucaacagggcaagcagcacagccuucguggucacuggugggcugug

SEQ ID NO: 17811 - RNA, 9710 nt, Homo sapiens
gcgcugugguucgcuccgggcgcgcugcgcucgugaguucccaggaggccuggcgggcaccguaaccagcgccgcggacaccggcaccggcgccacggacuccgcaggaccccgcgcccgccgccgccgcuaugcuggggcugcugguggcguugcuggcccuggggcucgcugucuuugcgcugcuggacgucugguaccuggugcgccuuccgugcgccgugcugcgcgcgcgccugcugcagccgcgcguccgugaccugcuagcugagcagcgcuucccgggccgcgugcugcccucggacuuggaccugcugcugcacaugaacaacgcgcgcuaccugcgcgaggccgacuuugcgcgcgucgcgcaccugacccgcugcggggugcucggggcgcugagggaguugcgggcgcacacggugcuggcggccucgugcgcgcgccaccgccgcucgcugcgccugcuggagcccuucgaggugcgcacccgccugcugggcugggacgaccgcgcguucuaccuggaggcgcgcuuugucagccugcgggacggcuucgugugcgcgcugcugcgcuuccggcagcaccugcugggcaccucacccgagcgcgucgugcagcaccugugccagcgcagggugagcggcccccgccccuggccccggagcacggccuuugugggaccuccgggggcuccuccuagucccuggcccccuccccuagggaaggcccgcugccugcaccucuuucggauacugcuggaguccugccucuuaccgcucccgccccucccucucuaccgggggcauuccucacugaugccuuuguucguggggguuccuaggguccccgaaucaacucuucauagucgggcuuagcgugcuucccuccugccauuucuuaaccuggccccucacgguuucguguucaccccucuccucucuccugguacucuguucuguggcuggaguguugaccucucugguccuugguccugaauauagguuggagaggugaucaguuagaagagguuccuaggaguucccgaggaccugagccccccuuucacacagcuuagagcugaagggcuggguucuggucaccuggguuugggguugagguauugagccgaguagcugaaagccuucuggccuuucugcaguuggagagaggagggccaugcaccucccagggcucgcuccucccagcagggcagaaccgccccugcagcauggcaccuggggcccuggggacggccaccaggccgauguggccagaccaguugccagaaaaguugccuggagcguccgugcaggaagccagggccugugcaccccuggugugcccuuagggcacugcccucuccggucucggacaggugccucccgagcagacgagggucaacgucucaucucaguccugauguuacaggaaagggauucagauccagaccucaagggaggguucuuggaucuuguguaagaaagaacucagggcgagucugcagcgcacagugaaagcaaguuuauuaagguaaagcggugaaagaauagcugguccguagacccaguagcauguuccuguaagaggaggaacgcguccacccuaggugcaaugcuuguauauauggggagaugugaucugcuacaaggguuugugauaaaggaguaauuuucuuaauuacuauauuuugcaagaaucaauauuacuauuuucuuuuuuuuuuuuuuuuuuuucagacggauucucacucugucgcccaggcuggagugcaguggcgugaucucggcucacugcaaccuccgccuuccggguucacgccauucuccugcuucagccuccccacuagcugggacuacggcgccagccaccacgcccggcuaauuuuuuguauuuuuaguagagacgggguuucaaaaucaggaaugccuuuguucuccagacaucgggauaucuggacacucccaagucugggucucuuuaguaaacauuauuaauuuguucccuuaacuguguuugaaacgcuuguuccccggugccguaaagaaauagcacgugaacauaaauuuaauuuccucagcaaggccauuuuuacuuccugcagaaaggguacacucgccagcagcuuugccaugagaguacaccgaacaaaggagacaggcucauuuauaaccugauguguaacaaucgcuuuuauuuaaagugcgaacggaauauuuaauccauuucagccagggauuugcaucuugauacucucucgauggcuaaggucuguuuuagaucucuuauuuuuacaauagacacccuaguuuuauuauuagauguagaagcaaccggugugagaucuagaacugaggcuacugaagaagggggagaugggggaauaaugcguauuuaaaaaauaccuagggggucuuuuccauuuaugucaauccccauaccacagaagcgacugagggcaggucuagaguuaguuaagguggagguggugauagagaaggacaggguuacacugauaaggcugacaguucgaaaggguaguccuuucagugaaauagaugagggguuuuagaucugcacagaccuuuuucuuggaaguuuaacuuugcuccugagcaguugaauguguauagucccguuuacuacaaaguuggcaggcuauaggagcagaacauuggcaucuuggcugcaggucauuacgauaaugagagcuagggguaaccauguccaucagagggcugggacguaagcauuugugugaaaaggcuagcuguuguugaucuuuuacauuuccgcaagguaugacagaacaagcauucaaggcgguggucugaggugaguuaguuacaguaauaacaaaggcgcuaguaacaauaaggaaaggaagcaauaugaagguacaggaaaauuaagcuuucuuuaacuuuaacuuaguaggauugguccuaguacagucauccaugauucugagagaaagauguuuucuugacuggaguguggucguuuuuuucuuggcucugcggauggcagucucagugguuaacagcauaaaauaggguucuucccaggcuggcucaaguuuuuucuuucugucuuuugaugaggacgugguuuucaggcuggugcugguguacuggaaauucuaggggugguaccuagaacuaaaagucuuuuaguucugagggaagggaaacuggaagauaaauuaaguauaucauuuuugcugcauauccuggggcuugaggccccauggugaugccucccgcuccauuccugcucagcgccgcccaggggacacugcggcccugccuccucuuaagcucuuggccuucuuggggccuucacugccccugugcacuguggccuuggacaugaggggccuugugacuuaccuggccaccuucaggccuuaagaaagcuaaacaccauuuuauauuugacagugcuuuuuguaugauuuuauaccagauaaguuaaauuuuaccuuuauacuaaugugcuauuaauguuaaacuuaauaaaaucuuuuuuuuuuuuuuuugagacagagucuugcucugucgcccaggcuggagugcaguggcgcaaucucagcucaccgcaagcuccgccucccggguucacgccauucuccugccucagccuccugaguagcugggacuacaggcgcccgccaccaugcccagcuaauuuuuuguauuuuuuaguggagaugggguuucaccguguuagccaggauagucucgaucuccugaccucgugauccgcccgccucagccuuccaaagugcugggauuacaggcgugagccaccgugcccggccaaacuuaauaaaaucuuguagacauuauuuauucaauuuuaaugucugacuauaggguaagauuuuuauagacucuuuuuaagcuuuuauaauuuuuguuaaagagcggguuagugcuuuaagaaaaaucuauugugcuuuuaacauccaguucacagaaaaacugcaugauaccccuuuagcuuuagccaauauguuuacacacagaauuuccuuuacaauuaacauuuuaaaacuugcuuaaaccuuuaaaacaaaauauauuuuuuaaccuuuuaauguagguaaaaauccauauuaugucuccuuauaauccuguuauuaaaaguauuauuuuauuuuucugacauaccuuguauauaaacuguuuuuuuuuaaauaauuuuacauucaggaggccuaauuacuuuuaaauuauacacuauuucuugcauaaauucccuuuuauagcuuuucuuacaacuuucacaaucuucaacaugucuuaacuuucugccugccuuuuacgcuauuucuuuuucucaguuucacccucuaugucuuccuuugauuucugucucuuccaguuucucucuuauucuuucccucuguauuuuaaucucuuucugucucuucucucucuucacucucuucauccccugcuuccuucuucccuccugaguucucccgcuccugcagcagcagggccgggcaauggcaccagccccugggcaugcacugccgucaguuucucuauccacccccaccauuccccuuuuuacuuuuuuuccccuuucuuccuacacuuaguuucucgggcugggugggauuugcauggcugcaguccggccccggcagcccagaggcuuggcagaugccugccacaaauugcaagaauuaugcccucucaccuccucugcucucuuccuggcgccgcugugcuugcuguuuuugcuuucuuuuuuucugacuuccucuccuaguucuuuuuccugucugcuggucuuuccuuugucucugccagccaccuaugcugcuguuuuccccccucuccuuccccuuccccugggggaccaaccagcgggagugaagcuuagccuuuuucuuucccugugaagaggggaaaagggaguuuugaauauauauauauauauauauauauauauauauauauauauauauauuuuaacuacuggagguuugugugagguucaacccccugaaauuaauggaagacuuaaccccucaaaccaggggugucuugccuugccugcccugggagguugaccuguuuccuccuuuccccccaaaggucccuugcauacuucccacuuguguuguccucucuggucgcccccccaagggagaauuaggccccucuuaguguaggcgugcugguauaaaucccacagcaggaccugcccuaagccauaugaggucacuacagaaccggaaccauggaggggacccacucacuguccagcaggaggacuugucaccguccacacaaaccacacugcaagcaggguugucugugaucauucacacauacacacauucagcccuccagaauuucaccaccaaggaaguacuuuaccagcuucuguggcuucuccuuccuuggucugugcacagaguugcagcccugguaugugagcauccuuuaccuuagguugcuggccaguuucuuuuuuuuuuuuuuuucugcauugcugagaguccggguuuauucgucacaccaggugggucucaauuucucaucccugaggccacugcagugaggcagaggagcgugcucccucaugagagaggaacagagaccgcccccgcaggagaauguagcccuguacggauugccaccaaauuguuugaaaugcuuguuccccggugccguaaagaaacagcaguugaacauaaauuuaauuuacucagcaaggacauuuuuacuuccugcagaaaggacacacuugccaucagcuuugccacaagaguucacccaacaaaggaaacagggucauuuauaaccugacgcguccacccuauugccgucucugguuuccauugacugggaugggaccucacauucuguaucugucccgauuggcuagcaacguacaacuuuuuaaaagaggcaaaggcagaggagaacaaaggaaggaaguaauuuguggaaugcugagaaagguaaaaacaccuucaaauaaggaagaggaacaggcuaugaccuaaugcccgcuuggaccaguauaagcaugccagggcaaauauuuaggcuaaauugugggagcuaagaaccuaaaguaguacauugcuuucuuuauuacugcuagcagauauuuaauaauguuagcacaggucuuugaauaaauuuugcuucuaagagaaguuacuauuuauuccuaauuagaucgguaggaaagucuuugaagaggaaccucuacuuuacaacuaaacaucuagaggcucggaaugccucuuucuggggaugcagcccagcaggccccagccucauuucccagcccucacucaaaauggagucgcucugguuccagcgccucugacacugagaggucaugucaggaauggggaaacugaggcucagaggagcuauggcacugcacaaagcuacacggcucccuggucuucuguuucuguugagucaugugaaccaaaaaguaucggagauaugucucagucaauuuagaaaguuuacuuugccaaggauaaggacucaccaguccugacaacaugugcccaagguggucggggcacagcuugcuuuuauacaucucagggaggcacaauacaucugucaguacauguaagauucacauugaugccaucuggaaggggggcuuucaggucaugguagauguaaaaguuuucugauuggcaguugguugaaagagcuauuaucaguagaaaggcaugucuggguuaagauacugguuguggagaccuagguuuuauuaugcagaugaagccuccaggcugcaggcuucagagggaauagaucauaaauguuucuugucggacuuaaggucuguguuguuaaugcuggagggcauaacaggccugucccacacccucuucuaucauggccugggcuagucuuucugguuaaauguggagggcccuggccuauuggaggaaguucauucagaugguuggggguaccuuccgauguuauuuuugguuuacagucaggaacccccuaaaaggccuagaucucucucuguccccaggugcuggacucuaugucuuucaugcaucuagaguccagaggcaaaggccaccaaggcugagagccgggcacggaggccgaggagauggggagccaggguugcuuuucugggaaagagggagugauaaaaucaggcaugggcugguuggugaggucccugugggaggugaaggcugggacccagaacagcagagacucugucgaugauguggaaagaccgcggcugcaguuugggcaggcugagccaggguugggucuugcauguugagaggcuggccugcggugauguggccaaagaggaagagcugggcuggggugaguguuggucacaugguugaaacuagguggggaggggagugguccaggggagaguccaggcccagcucugcugggacuugccaugggggucacgacucaucugcagggaaggucugggcuuuaucucugagcaccucugugugcugcucacccugaagugggggugggccugugccuggccuguccccucauccugggagcucccaaugcccaucugcaaggcuguggaccccucaggaguggccuggagccuggcucccauugccacaugguggcuguguguguggagaggguugauaguggaguggucaggcccaggcugcccugggggaugaagugccauccucugggugcccuggagaaagaagagaacucagugagcccugucugguacuuuccuggaggagggcucccaugcuggcccuccaccccucuguccccugucacccugaggccucuggauuuccucucugcccuucccaaccugccaacuucacggguuucuggcuggguucuggggauggccccuaggggagacgggccaggcacaagcggggcugugucaagguggguaugcagggguagcacaagugugcagagccuggggaggcaugggcaaagcauggcaggcggcggggcaggggaucuuggaaggucacgggcuggggagcagugugggcagcggcccagaggugggaaggccguagcuuagcuggguguccccuuucuguccucugcagguggagcccccugagcugcccgcugaucugcagcacuggaucuccuacaacgaggccagcagccagcugcuccgcauggagagugggcucagugaugucaccaaggaccagugaccgccaccuucacaccgucugcccuggccaccauccugggccugggggcugcccacagaugggcagucucagccauacucuguuccagcuggaguagccuccugaccagccuggcccacccugcuccacccacugggcccccccaguuauugauaccccucugugcugggcuccacgcuaggcagaaggaggaguggcauuggcauccugacccagcucugcccucaagguggggauggaugggcaaaggagaguccugccuggcccuacgaugaggccacucaugugggccuagguaggggaggauggugccuggagcagagggacccacaagugccucccgagccuagauccuggcucggaccacugcaagggccgaggcagggccagaccagagcauccuggguacaggccugggcucuccagggccugggccugauucaggugcagugggcacuccugaagggucagagcggcaucugccaggcagccccucuggcuuccgcugaggugguugcaggccuggggcagagccuggguggucagaggccggggcuagaggcagauggaagggaggcauuugcugacagaggacggggcacccgggcuccccacugcagucggccuugccuccuccuccuccucuaccuccagucaggcuggacgggaggguagccuuguggcugagaggggucagacuagguggcacaggggcuccuggaaagacagcaggcuuccugcugggcguucccuuguuggagggaauagagugggggugggacucugcagggguguccuuguccacucgcaccccucgccgcccaccagggccaugcucugugacuugggcugauccccacccuuucugggccuacagcaccacaggccgcuguacccccuuagagcugccccucucuggccuggccggcaggcgucuucuuaacuccucuguccucuauauucagcauguuccuugucagcugcugggccggcccugccuugcgcuagcagagccucuccuggcagcuucucaggucucccuaauggagacaccaggcuacuaggacacuggcuggggccacccccuccugccuaaugccucaccuuacagcuggggaaacugaggccuggaauggcccagagucaccaaggcaaaguuggggcuggucccagccugaggcuccagcugaugcccucagcucccagagagggggugccccaucuagcugggugcaggggucacugcuugucagcucagggcccugugcccgcuugccuguuccccuacaucugugccugcacauccagaacugccuccuugccgcugccuccaggaagcccaccuugagccagagucaagggcugcagcacugcccgauagaacacgcccgcccucacugcuguucuugccuuacagccaccaugggaaagcugcaaccuuucuguuuuauuuaaagaaagcccaacauuaaaggguuuucauugc

SEQ ID NO: 17812 - RNA, 7096 nt, Homo sapiens
uggagcccccugagcugcccgcugaucugcagcacuggaucuccuacaacgaggccagcagccagcugcuccgcauggagagugggcucagugaugucaccaaggaccagugaccgccaccuucacaccgucugcccuggccaccauccugggccugggggcugcccacagaugggcagucucagccauacucuguuccagcuggaguagccuccugaccagccuggcccacccugcuccacccacugggcccccccaguuauugauaccccucugugcugggcuccacgcuaggcagaaggaggaguggcauuggcauccugacccagcucugcccucaagguggggauggaugggcaaaggagaguccugccuggcccuacgaugaggccacucaugugggccuagguaggggaggauggugccuggagcagagggacccacaagugccucccgagccuagauccuggcucggaccacugcaagggccgaggcagggccagaccagagcauccuggguacaggccugggcucuccagggccugggccugauucaggugcagugggcacuccugaagggucagagcggcaucugccaggcagccccucuggcuuccgcugaggugguugcaggccuggggcagagccuggguggucagaggccggggcuagaggcagauggaagggaggcauuugcugacagaggacggggcacccgggcuccccacugcagucggccuugccuccuccuccuccucuaccuccagucaggcuggacgggaggguagccuuguggcugagaggggucagacuagguggcacaggggcuccuggaaagacagcaggcuuccugcugggcguucccuuguuggagggaauagagugggggugggacucugcagggguguccuuguccacucgcaccccucgccgcccaccagggccaugcucugugacuugggcugauccccacccuuucugggccuacagcaccacaggccgcuguacccccuuagagcugccccucucuggccuggccggcaggcgucuucuuaacuccucuguccucuauauucagcauguuccuugucagcugcugggccggcccugccuugcgcuagcagagccucuccuggcagcuucucaggucucccuaauggagacaccaggcuacuaggacacuggcuggggccacccccuccugccuaaugccucaccuuacagcuggggaaacugaggccuggaauggcccagagucaccaaggcaaaguuggggcuggucccagccugaggcuccagcugaugcccucagcucccagagagggggugccccaucuagcugggugcaggggucacugcuugucagcucagggcccugugcccgcuugccuguuccccuacaucugugccugcacauccagaacugccuccuugccgcugccuccaggaagcccaccuugagccagagucaagggcugcagcacugcccgauagaacacgcccgcccucacugcuguucuugccuuacagccaccaugggaaagcugcaaccuuucuguuuuauuuaaagaaagcccaacauuaaaggguuuucauugcaagcgugcuggggagggccuuguuucugagcuaccaccaccaccauccaugcaggggcggaggugggaccagggaagcuggggcacauucccaagaugggugucuggcauggggggcuauccagguuuguugggcucccgugaacuuagggaucaggcuggcagggcagggcuuguccucaucccauggggcauaggacugaggccaagaaggugcuguccaaagcccccuggggagccagcccuuccugcuccggcccuccugguucccagcucucgaggcuugcagccccaucuacagaugccagcgccagguucccgguuucccuccuucagggauuacccuggcggucaugccucagacucugggucuggcccuccaggcucccagagccucgggcagggugcugguagccauugggggcagaggucaauggacugguggguggacaggaggcagagagagcaugggggcuguucugcaggcccuucaaaagggguggggagaagugggacccuccgggacauaaaguugagugaggcgggguguggccacguccaugcugugaccaccuuccugggaggguccagaaggcucugagggccagggaaggagugggcaguuggaaacagcuaugaaaccggcauuuagugauggggcaguagggcuggggaggggaagcaaacuugcucagcaaaucuggggucuguagccagacugguuggccagaagccucugugcuuucucugggguccuugggggagguggcucguggggucgccacaggugugugagcugaguguugccagacaagcuucccaguggggcugcagaugaagcuguagggaugccguccagcugaugguccugaccaucugccugagcccuggagcagggcgggggccacaggacagggugccugggccuugggagggcaccaugugaugaugccacugcggucccuggcucagcagcuaccucugggucguggaaggcacauuggccuggauagggaguagggcucagugacuggacuaggaaugaguguauccagugcgcauauggaugugcgugccugugugcauuugugugugugugugugugugugcgcacgugcacgcaggcaacgggcaagcuucaaggugguugaaugggcagcacccgcaagccucuggggcuucucucuccaugcagaagcugaacacccugggcugucauaggcuggcucagaggaagguuugagccagcagggcccucucuuggucuuguuuuuggaggacgggcugacgacaggacuggcccgggucagggaauggguggcugggauuggaagugaaccagugccuuguccuggcggagccacuggagcccacucugcuccugugagccugccacucggagaaguuagagggcagcaacugcuucggcccgcguccuucccccaaggccaacagcugcagaauuucugccccagccgcccccacccccggaggugucugcacaguguccaggugucgggcccaggaagcccuugguggaugcuggugaagaagggacagguacaggguaugggaguguguccggagguccuggggugguggcugugcauggguccgucguccugggggaggaggcacugugcccucugauggccagguggacagagucacgacugcuuugguggguguccccggggcucacccuaggucaguugccugcucagucucagcauccagccaccgccucugggcucagucagcugacuggccacuguuguguccccucagggcccagggacacagauccccacaucugaggccuugcugaguggaguucuacugugccugguguccggaauucugggacagcaggaccaucgcccaccucauggauagggaaacagacuagggcagggaauucccaguauggccgccaggggcucaacgaggcaggccaaaggggcugauucgucccaggcccaggccgccgcuccccgcaugacuuccccucuggacaccugcgaguugggggcacccuuggggagguggagggucuugcuccugagggcggggagggacgcccugcggucugcacaccccucuccuuuagagauuucuuaaagcugcggaagacuagcgcuggcuggucugaccucuccgcgguagugggguucagaagggccucugcuuccccuccgcgcaguagggccuagcggcacgggugggcgcccuucucccuccccuccaccgccaccucuuggcggcuggcugcuuccccgccagcuuuacccacguccugcgacggucacggaugcgacgcccacucaccucccuagaccccgcgcgcccggguggugagcgccuggccuccgcgagccccaccccgugggcgcgcccucccgaggucccucccuggccguggccuccccacgcauuuccugggagggucgcggcgacaggcagggcaggugggcguccuccaggccggccgagagggccagggcucucugaacucugugcugcggaccccuacgguccaggcggcccagcugcgcgcgcagugcagguuccgggcagagcgcacagggucgccgcgugcucgcggugcgcgcucugggacgagucuuccuggcgcggguuccgggacucgggcgcgcgcccucugcuggccgugcgggcucagcaucgggggccccucgcaggugcccucccagggauaggggcaccugcugagccuucaccacugcgcucccaaagagccuggaggccucauccccauugugccgcuggggacgcugccagagaugcggcgacuucuugcuccgucccccuggugaggccaaggcccugcccccuuggcuccaaucgaggcccgggugaggcccuuggagguccggccaugacccaggggacgggcccuaaccggaagccacgccgccggcccggugcuggccaacggggaggcccgggguagcccuucaagggggccucucuggcagcuuucucuggucggggcugcuccccagggacagcauuuaauuccugguauuucugggagggcguagagguaggggguggguucugacaucugggcccuucauagacagaggugggcucucacagggguccuaggcgacccccgccacugcccugguuacucccgcaugcuccucggguaugcccagcuggucugaccacagccugcugcauaccgcucccaccccagcaggcacaggugcccacaagaccccacgggcgugacccagcugauguguggggccuuagaacccaagaccuagcugggcagcgcuuagauggugugcagcccaggagacaccaggggacuggggccuggagaggggcaguguccagggguggcucaggcccacagcagcccgugcuccccguuggcucugcccaccugccgacaggggugacaguggcacagagcacugugacugugaugggacagccagggccaggaagagggggaagcgagccuggaagucaggucuccuggguccugagaacccggggcuccuccgcuaaucucagcugucccaaggggacagugggcaguugucagaggaggugacugaaaccguggagcugugugguaccagcaggcccaggugcacacacccaggaagaccccuugggcugggcaggcagagccagauguauccacccuuggaggaaaguggaugccaacucugagcuuccuucccucucuagggugggagcgaugucuccaggguuuacaggggagauucuuagcgggagauguucccugggcuaggguacagguccuggucugagaugccaggcuaguuugcaucaggaaaggggcccaggaggcauuucuuccccuaagucucuguuuuccuaucugugaaaugggucacagaggcucugggugagagggaggagcaggugccuagaaugugcuguccuucagccuggcucuccugaaggccaguucuguagggugucagugcccaggaaggacaaaagucauguccacucuuggcuuaguuauguuuuauaagcgugggguauggaaggcagagggcgccccuggugugcuucucuccccucagaccccaugagugagcugugccacagcagcaggaagcagggggaggugaucacagguggagccaggccccgucagagaggaggugccugaggagcaccuuccgcccugccgcccuggguucagaguuccgaguugcagaggucucggaagcagcagaagaucaggugggcggccccgaugcugucggggucgguggccacacaggagcuggagcaggagcgggucaccacggggcucugguugaagggguacucugcagggugggccagugucagaacccucacuccccugcagcgccugccugcugcugcacugcucccagccgccgucgccugaccucacccucccugugaucccuguucccaauaguccacaucugugaagccacccagggcccagcccuccucugacugugaccuguucaugaauuauuaggccuugucagaccucugaagugccugcgcugagaugggagcccgagcccagaggcuguggcaacaccacccagugggucugugucagagcugggguuugagccccccaggguaccccggccauuaagccccacccaccuccagcgccuggugccccaggacugggucucugagggggcugugccacccucguggaaggcaccccugccaagguguggcagccuguucugcccaucccaccugcugccuuuugggccgggaggagcaccagcaaaggagggaggcacuugggggagguggcccugacuccagugcacccagggcugccguggggccuggccucaccugccuccaccgucaccagcguggucaugcaggcuguguccucuggcuugcagcggguaaugguccugcaggaagcacuggucaugggcuccuugcagguguagcacuugagggccucaccugggugagggaugggggcagaaccucaucaccugaccucgguggccucauccuggaaccaggaggcaggggcugaaggagucucgcugacaucuuucaaggccccgggcagcccuucaaggggccucucuggcagcuuucucuaacugagcugagccacagacuugaaugcugcaucccuccaccaagccucagucucccuuccugcagaguggagccgugaccccugucccagggugaagcugggcucugggacccaggaggcucacugagaaugaggagggugagccucauggaggccuaaggaggcucucagccacaaagcacccccaacagccccaucccccuaggaggugggcagacaagcucagaggcaggguccccaccagccugcggcccacucaccacagcccaugcuccaggcugccacgagcagcagcugcacagcccagcgagaggccauugcuccgugcucagaagugaugagagguagccagccu

SEQ ID NO: 17813 - RNA, 5472 nt, Homo sapiens
acgauccaaucacauuuuauuguggggaggucgggaccugaaggggcggcaggcacgaugggccccaggcuuggacggcagcagauugaggcaagacuccacgcaggacuucccuaggacaagcggugcuggacgguggcugcagaggccgggagaggugggcuggccagucucgagggaggggcagcugugagcccuggcgccaggcugugggggcugugggggcugagcguccgggggccuggaggagggcagccgucagucaugguugcagaggcuggucuggcagcaagcgauggauacguaggggcccaggcccaggcuggggauaucggggcagccuauguggcacaucuuggugaccagaggcaaauccucgguguugcugaggaccccugagugggcaggagagaaaccauggagcucccugaggcucugguuugcccagacccugcugccccaucugccacugagcugagggucagacgccccagguacaugaagcauacgggcccuccuggggcagacguggcccuuugcucauacccuucccugggcaucacuggcggacacuccccacuaugcuucugacuuacugggugccuggaucuggcucugucacccucugagcccacaucuucccaccugggcaagaaggacguggccagcccaccacuguucccacuuacggguggcaguggugacacaguggguggagucccucaggcaucuggauccaugggagcacccuccgaagcccgugcacuggugacaccauauggcuucggcugcagcugcggacauggggacagacaggacacaaacggaugggaggcaggugugggccaccuucugcagugacggcacgcacucaucuccacccagcagcccaugcuccuucucagcggccagugucccgacccugugauccagcccucucaggagcugggccccugucccucaccuuggggugccuggcagcccugcagcuggagccagcugguugcauccuugcccaggaagcagccuugggcaaggguggggccgggcagcccuggcucgcagugugaugucccagggcagugguggugcagcagccugggcuauuuggggucccagggugggggguggggaggagguggaggggcucugagacacgcuuucuggccaugcccauuuuugccucuggguacugagugggaccuguuagacccccgggacuggauucugguggcugcgaugauggggccguuccugccuccacagggagcccagggcaagggcgaccaggaugugguggaacaggaauuaaaagaaauuaaagaauguguaggccgggcgcgguggcucacgccuguaaucccagcacuuugggaggccgagguggguggaucacuugaggucagaaguucaagaacagccuggccaauauggugaaacccuaucucuacuaaaaauauaaaaacauuagcugggcaugguggcgugugccuguaaucccagcuacucaggaggcugaggcaggagaauugcuugaaccugggaggcagagguugcagugagccgagaucgcgccacugcacucgagccugggcgacagagcaagacuccaccucaaaaaaaaaaacaaaaaacaaaaaacaaaaaacaaaaaaaggcuguguaaacagaaacucaguuguauguaagaaaacccaauucccucugagaaagagaaagaacuagaguccuuuaauaauucccugccuguuccucuguggcuagugagccuucucucuccuccuuucccaggcgcuguggagacaccguuucucuaguugugcagcugcaaggucacagacagagaaacucaagucguaaaacauguuuuuccuucaaaaggaagaaaugauguaaggaaugucucaauucauugaaucacugucuuuguuucucgcuucuguaacaugcuucccccugcaccgaucuccccccaccccgcgaaaugcuuaaaagguaacuuaacucuuuguucagagcucaguccuuuggauguuaacccgacugggcuggugcaccuaaauaauaaauauccuccucaaccccuuggucucucugauuccuuaaaacaucccgcuacaguggcggcacccaggcagcugcagggagcggugagcucugccucacuuuacccaggaggacggcccgugcucgggagacacugcucuuccgcgggcgcugcugugggucugccccacucccgaggccugcuagcccuccugggcaccccccaagggcuucccugccugcucucugccccucuucaucccugacucuguccucuccucccuggccgccuccauccauuucucauuucucagccuccaacucccucccucccuguccucacccuugguucacacacccaggacuggguaagcagagucccuaacaccugcuggccccaggccugcucucucugcauaggagccugcagggugacaaggccaaugguguggccauaaggaugugagggcugcucugucacaggcaccaggcgcaggcccuggcuuccucuugagcugugccccaggcagcccagccucaggacacaggagcccacgccugcccuaucccaucucugcugggcugcccccgccucacuguugccaaagguggagaagggcuggagucagccccagucagugccagcuccaaacccggguuccugacagcauggcucuguaugcaccagcacugagcugaccucagaccucagugcacaccaggccccugccacgggccagaguccucuggucaccccuggguccugugggcggaauccuccaucgaggcaccacggagaaggugacacagaugggaaguuccggccagggcaggccccugccaucagcuuuggccccucuaccagccccggagagcaagcugagaccccaccuucgagaaagaaagguggugacagcugccuccaagccccucucugccuucccaccaaaguggcuugaagcuccccuuggcugucacauccaaccuagugacagccaauaagucggacacgccucuacucaacacuggcagccacaggccacagcuggcuggggugggggguagcagggaagaugggcaggaggcuggggcaccagaaggaggaggugaggauaugggugcccaagggugccauggagagaaccagcuccagccuguccacuacacaugcccacgcucccaaggccucccuggcuuugaacuugcuguuccuccugcccucugggcaaaacaagcccuggugcaaaugccacccccuccaggaaggccuccuugguuuccagggcagagugaaugguuccaacucugacacacccaccgugaacugcagcauccugccccagcuggcaucagugucccugcuccaagugauugugcucagggcuccuuccucacccccacccaagcaugagggccucugaggcugggcagggcguucuacccauuccucagugcucccuccccugcacuuaaugaggcccaggagaggcuugcagaaugaaugaauaaaugaaugaaugaaugaaugaaugaaugaaugaauuccgggggugguugcagguuggguuaucaagagaaauaauaauucugucccuuaucagaggguuuuugauuuucagcaaugagauccugagggaagcagauaaaauguuagcuccaaaccggaaaggcugcucgauggugacugugaggacacagggacaguguucagacuggcgccugacacacgggagggaggggagaucagggggagaagaggagagaggaagggagggaggaggagaggaaggaaggaagggaaggagggaggaggaauagagaggaggagggagguggggugggggggagggggcaggaauaauggagggacaaacaggauggugggaugggcucuggguguagcugcauggcugggggcaggucucucccacuggggacccccgugcuggcucugaagcaggcuggccccucggggagauugugcuguccauguauggcagagagcagacaccaagcaaugacaggggaugcaggugccccugagagaggcucgccaguccuccaaccggaagagcagugaggcagcuuggggcuuguuccucgaggggcaggugggauuucagcagaaggaagggcuccaggagcccuggugcagggaagggccucugggucagaggggaguccgugggcaccgggcacccaggcagaggcuccugugaugugccaucccuggccuggauggccaccugacugccuguccaguccugaugguuacaaaggccuucuccagguuaagucgaguccccaggccccugugugucucggaccuucagcacagagcuggucugcccucaugacccuggggcaguccucagggucagcggcucagccucucauaggccaggagggugccccuggggauggagacuggagggauguaagagacaccugagccagcgccagggacucaccgacgcuccacccccugcucauucagggccugggaggcaggggcugcccaggucguucaacccacagccagggacgcagaggcuuggccccuggggggcugggcugcuugggcuuggaggugcaggccaccggcagaucaaggggccagcugguuuuguugaggccucaggguggggguggagaugcccugccaagagaagacguucaggcucugcugggggaugccaaggccaggugugcacagcugugcuugaggggucauccccuuggagcccucaggaaggcccugggccaagggaucugaagcuggggggacagggccagccguagcagacgugggcacugcgggggucgaggguugggggauggggaggggguaaaaucacccaggaaagcggggagcagaggagaggacccgggagcaggaacuggggaugggagagcagagggacuugguuuucccaggcaagagggaagagggagucccgggaggguggccccaggagacaaaccagcugggaggccaggcccaagagggcuggaggggggcacauucagagugugugugugcacgugcacgaaggugcgugugugaggggugucgcgguggacuggagaggucugggggcugggcagaggaagagggggguuugagccaagggcugugcauccugagaagugugggggccagugucgggggcuggggcugagcuggauggaccugcaggaucgcaggaggcuuucggaggaaagcugcaccugguagaugguggggggacaggaauggguucucccgaggugggcagucacagcccagggcuggagggacggugguugggcuagagugaugggggccuugagcaggagguggccccagccccuggacucacccagcugcaggcucaggacggcggccagcaggagcccagugccgagcugcauguucuccuggug

SEQ ID NO: 17814 - RNA, 841 nt, Homo sapiens
ugggcgccgggggacgcgacagcccgcggugguggggagggccgccgccccccgcggguuacuaagcgacggcccugccuccacccucugcagccccagcagggccggcaccacucccucgacaaagcuggagccggggacugacccgggcccugagccggcccacaaguccuggcggacccuaccgucccccaccccagccgccacccagaacacgcgggcggugagcgaccccuucgacaagggggcaggggacccgccgcgaggugagggggaaagaaggggacucgcgucccggccccggccggaccuacccugcaguaggcggaucugccgccguaauaucuccuuuuccuccaucucccgaguccgcgacggccggccaggcccccacgacgucaucgcuacgcgaccuuuuucccgcgggcggggcggagcgggccagggcggagcugccaggagcaggcccggaugucugccgaccgccgaggacccgccgucgcgcugacaacggcagcggagaggcagagccgcgcacgcgcagaacgaggcggggacgucacuagugagcgccgggaaguggccugguaacggcugggaagggacugcuugggcucugggaggccgcgcgggcccagcuugugcaguccgggaucgcguccccuugggagacuuggcgaggggcgagaccuggggcccacccagcccauaccgcaguuccuucccacagucccugcguuucauuucgccccaguugaguguugggggggggggggucuacgcggggacccaugggagaagggccaguuaacaauuacucuugacccaggagggucuguga

SEQ ID NO: 17815 - RNA, 1015 nt, Homo sapiens
gggccgcccuccagggccuccccuccgcuaggcugggcaccugcgccagcagcccacgcaccagagcaugcaccugguggggaagggggcagacuucagcagucaggccuccuccaccguccauuccccucuggccugcaccccaccuccacccccacccugaucccgccuggcaggagcagccugaagauggcagggucaggcugcgcucuccaggccccucccaccaccuuggugcccgaaccggcaggauucuguagggcaugaagugggugaaggcugaccugguccuccaaccgcucgccccgggccuccagggcugaggacagggugagcacugucgccugggucccugcaaagccagccuccuccaggcaggcagccguguacaacgcgaggucggcaagaacucccuccucccaggaacucuggggaaccuagggcaggauggguggggcgucugaagugcccaaaccucuccuagcucuccuccuggucccucggccucccaccuggcuuccuacaaaaucccuugcuccucuguugcucaccagccuguuucacgcugaccucccccggggccagcaccgccccccugccaccccgccuuccaccuaccauccacaggacccccaggccgguucgcacaacaucccuucccucccccgucaccugguggggccccucaggggcugguuccagggcacuguugagggagcagggcucgcugccagcuucagggacgguggccccacguccaggcucugccucagagggggcggugagugccugggucuguggcucagccucagguuugaccucccaggacuugggcugagggccugcggaagggggucccuggggcugccccugccuggcccggauuccuucagucagugcugucaggguuagagcccccacgggagccucccgggcccggcuccggccccacacacccccagccauggcggcccuugccugcagcaccugccgcugcuccuccugcgaaguugug

SEQ ID NO: 17816 - RNA, 4149 nt, Homo sapiens
aacaagauggcagcugcggagccgucuccgcggcgcgugggcuucgugggcgcgggccgcauggcgggggccaucgcgcagggccucaucagagcagguggggcggcgcggggcuaggccugcggucuggagugggagcagccccgugggagguguccugccgcgagaguggggccgggggcgcgggcccagccaaccgggucuccgcuccgcugggcgcagccggggccacgccuguuugcucuuacuuuuuugacguggcugcgggaagauuugagucacacguggcuaggugccgcuuccguggccggcuuccuggccgcguggccuuggccaggcucaccucuuccagccucugauuuucucuuugcgcgccagccccucucauggggagcagcagggcuucucccccagacaccuuggcucuagggacaccugggccagacuauccauccugugccagcagcacccccacguugugacagccaaaaaugccuccagacacugccgaauguccccuggguggggggaggagacaggcaaaaucauccccuguugagaaacacugcuuuauacccggaauauuuaugcugaccauauacuccuccaggcauuuagaagccucucugcagauuguggauagggagagcugggugacuuuugacucucugccuucagccauacuucaggguccagaagagucaagaucaaucgggaaauagcuuacuaugagucucaggagucuucccugugaaaccuggcaguaccgcaugccucccagagcuguacagguuaaaugagacauaaaugucuaguguugagcuuaguacugguguguuuggcugccacugucaugauuaauugcuguguucagguugugguguacacuugugccuuccuguucgaccuuaccaaaaucuaacccaaucuuuccaccccguacccgacaaaagcagauaauuucuaccaaguaggcauuuagccuuuucuuagacauuccagcauagacucucccucucgaagaaccugggccccgauugggccuucuguggccaaucaacugccuuuguacccaccacauucccccaaggccugguguuccuccagagguacugccucuucugcuccaggcagccuucccuucccuggaggcagaggccccagggaucuguguccucaccaaugagguaagcuccuggccuccauacccagcagcagucaggggcguugaccgccaaguagaaucaguggaucugauugccugggcccagugaauggugcaucccgcuuuggguuccuggggccaggagggggcccaggaugggccaggcguggcugagccugagaggccaagugagcucccucuccucuccgugccauccuaucccaccccuucaccaaccccucuuccuuuuccuuucuuuccaggaaaaguggaagcucagcacauacuggccagugcaccaacagacaggaaccuaugucacuuucaagugagcauagagcccagguucuucauacccucaggagcccaggauagcucuuggcuccugucccacuaagacacuuaucagagccagggaugggugguuuauuuagcugaaguuugcagacuggcuggucugggcugggaaaagggagauuagaggccaggaggaaaguaagguuguggagggccaaagcaaaguguuuguguguguguguguaugcaugugugagugcauguccgugaguguguguauaugcacguguguauaugugaggcuaugcgugugcauguguguauguaugugcucaugugcguuugcacgugcgcuugugugugcgugugcacguguggugagugcauguaugucagugcaugugugugcguguguguaugagugcaugcucaugagugcaugugcaccuguguggucgugagugcacguaugugcuugugcaugugugccugugcagauguguauaugagugcgugugugcguguaugagugcgugcguguacacaugagugcaugcucgagugggugugugugcauguguuugugcucaugagugcauucauguguacauguguauguaugcucgugagugcaugugucugcguguguguauaugaaugcaugcucgugagugcgugcaugugcauggguguguuugcaugcugggugguggucacagacauucacuggggauggagggcucagggcuuggggaggcgcugacaucaggauggccugugaggaguagggcuagucugggggagucuugggcacuggagaagucgggguggucuagacacuugcaaugggagaggcccugggaccaugggaacguguggcauccagcaggaagggcugugauggagagggugcgccgcuuacauggccccugaggcuugguccuggugucccuggcgcaggcucuggguugccggaccacgcacuccaaccaggaggugcugcagagcugccugcucgucaucuuugccaccaagccucaugugcugccagcuguccuggcagagguggcuccuguggucaccacugaacacaucuugguguccguggcugcuggggugucucugagcacccuggaggaggugagugucccuugggcuaaggccuuggucccaguauaggcucugcuggccaggcuugggcggcaggcagccccccagagagccugagagguggccguguggcccaccuggaucaaguggcuggauuuaggguucccuccuggugcuguaccugggaggcagacgcuggagcccaccgcgagcugacguggaccuuuccugaggccccugcuggggccugcccagcagggcccaguccuacagacucccugauucugaccucucucuggccagcugcugcccccaaacacacgggugcugcgggucuugcccaaccugcccugugugguccaggaaggggccauagugauggcgcggggccgccacguggggagcagcgagaccaagcuccugcagcaucugcuggaggccugugggcggugugaggaggugccugaagccuacgucgacauccacacuggccucaguggcaguggcguggccuucgugaguauugccucguccauccccggccccacccucggcaaagagggggcccaccccagucccucugacagccucugcccucagaguccaaccuugaggccugcgugguugcuccccaggcccacugggagcucugcuuguccccgggacuucacugccuuggggaucuuugaggccagccccuuugcagaccguugggcucaggccuugguucuggccacccacggcuacugcucugggcauuguuccugaagguccugagcccccaggcuuugacaccuaucccccccaaccaccaugccgcggcuacaggugugugcauucuccgaggcccuggcugaaggagccgucaagaugggcaugcccagcagccuggcccaccgcaucgcugcccagacccugcuggugagugaggguggccccuggggaacaucgggaaggcccaggccuguaccucuuccagugcgcagggaaacagcaggcucgagaagcuggggccaagguugggggaugcaacgagggcaggccgcacaguggggaccgcaccaccuccccccgucaccaggcccuaacgcucuccucaggggacggccaagaugcugcugcacgagggccaacacccagcccagcugcgcucagacgugugcaccccggguggcaccaccaucuauggacuccacgcccuggagcagggcgggcugcgagcagccaccaugagcgccguggaggcugccaccugccgggccaaggagcucagcagaaaguaggcugggcucuggccauccuuuccugccucugugccccugccucucccugugucccuuccccugaggacugcggcucccucccuccugcaugagggucuccuacugcuccuucuccccuugcacagggaaaugcagggggcaggacuugggagguuccagcaggcgggggagccccgaccaguggggacacuccucccuccccagugagcagaaggcaccguggugguggcucugccccuugcugcagugagcccaccuugcugcaacauugguucugaggggcccaagagaugg

SEQ ID NO: 17817 - RNA, 1517 nt, Homo sapiens
uuuucauaaccaaaaaaaaaaagagagaauaaccuuaccguuaccuacuaagguaacaaacugugaaaucaauuccccaauaucgcuuugaaaauaaaccccuugguuguuaaagagaaauugcaacuuccagcuccauccgaauguauuauuuaaccgguauucuucagucaucaucuacuguuggcuugauugucacuccucuucuuaucugaccccaaccaauuaaacgccaguguuuuucaacucuucggcuaagggcaauuuuuucuccuaccucugugcacacuggauuggucaaaacaauuuugcccaaaucggccuugacagcacuaacucucccuccugucgacagggauccuauguucaccaugagcacuucauucuuagacagcuuuugaaccuuugcugcuuucuugucuccuucagugcguacaccuagaagccgucuaagcaggaaauaggaaauuuccaauucugugaauaucucagguaaagcuccgacugcaccaaguauuugccccaccauucugucagcccggcacaaaguggggucaauuuuuguuccaacuccaauaagaccgccuggagcagcauauugcagaucauuaugcuccgcaaaaagugaaacaauuuuggaaaagauugauuuacacaugaguuuuccuucacuaucuuuggaaacaauaccaggucuuacuucugucuccuggcccaccuuuaauacuccuuuuaggauacuaccaccagcuacaccucccuuaaggucaucaacuucacagccagguuuguugacaucaaaagaucuaauaacaauaagccggggcucugaaguaaagucucuuggggguacuggaauuuucuuuacuauguacucacaaacaacuucaauauuguauuucagcugagccgaaauuggaauaaugggagcucccucugcuacuguaccuuggacaaacgcaaggaucugcucguauuguucuuuagccugccuuucuuuuaccaaaucaauuuuauuuuguagaaucaaaauaugcuucaguuucaugaucucuauagcagccagguguucagaugucugaggcugagggcaagauucauuaccagcuaucaacagaagagcugcauccaucacugcugcaccguucagcauaguagccaucaaaauaucguggccaggacagucaacaaaggaaacaugucugacuaaucugaaguucccuuugguuccuggaaugucuguaggaaacucaucaggcauacugcucccacaagaucgauaacauucuggccgagggcaacuugggucaucaaguugauaaaucuuagcauuagcauauccaagcuugauuguaauauuucuuucuaguucauuuuugaaccugacggugugaacuccagaaauagcuuugacgacuguggauuucccaugagcuacaugaccaauuguaccuauauuaauuguggcuugucugcugauaacuucgugugaaaguggcgucaacuugguaacaucc

SEQ ID NO: 17818 - RNA, 2156 nt, Homo sapiens
ggaacguggugaagcuccucuucaagugggggacaacccgggagaaggcccguugcugaaccgaaggcgaagggcgcuucuggggucugugagauucagaagcacguccggaguccgucugaagcccaguuuugucagcucaggcccuaucucugggggcacauucacaagcagucacgggcgacucaagaugagagaguugugcggaaugaaggagucggccaucgccagaguaacggggugggggugggagaggacgaguaaguucugucuccauagagaccgugcccgccgagcagcaacauuacuaauguuaggcgcacccagacggacagcgaagguccagcgggagcccacgagugaagguuggcaaagcugcccugacccgcgacccaaagccccgaucugccuccccaaaagccucgugaccccgaggcgcgucccaccucugggccuggcgccuagaauauuuaggccagguaagaggaagggcuaaauuggggaaggggccggggucgcugcccucaccaguccuggugguccaggcaccaacccauggcgcccaagaaaaagcgcgggccgagcgcagggagccagccagguggugcggcggccgcgggugccgagcagccgcuaucggagcgcgcgcaguaccugcaacgcgaacacgcgcugcucucggagcagcuggacaccugcgaggagagcguugaccaggugcugcgagagaacgccuuccuggaccgcgaggcgcugcgccugcgcgaggagaaccggcucuacgccagcuacgugagcgcgcgcgcccagcgcugcgccaaagccaucguccggcuggacgagcagaaccgcguggaccuagcgcagauccacuggcagcgggcggaacuggccucgcucuaccacgggcgcgaggacggggugcgcgcgcagcuguuggagauggaggcgcgcgcggcacagauggcacagcaggugcaagagcugcagcccuacaaggccagugagcccgcccgcggccggggugaggcggggcggggcugguggccgggccgggggcggggugggggugagcugacggcgcccccgccgcaggugcugcagcuggagcagcuggcccggauccgggcgcuggagcgcgagcugcugcauaugcgcguggagcacacgcagcugcuccaccgcgugaagcggcgcuuccuggaggacaaggcggccuucgagcgcgaggcgcgucagcgcgugcagucacuggcgcggcgcgcggagcgggaggcggugcgcgcgcuuguggcgcacacgcaggccaucaaagcggacaacggacgccugcggcaggagcugcugcugcugcuccgccggacccagcugcugcaccacacgcggcgccagcugcuggaacagcgcgagcaacugcaccgcgagcacgaggacacgcgggaccuggcgcgugugcacggcuggcugcgcaggggccccggaggcccgccgcucugggagcggccggccuucucccagcccaccucgcgccccgggucauuagccgcccccauaagcccgucgcgcgcggccucccagaccccgucugugguaccgucgcgcgcggccccccgggccucguccguggucccgucgcgcgaggcuucccggguccccucguuggugcuaucgagcauggacuccagggucccaucgcuggccacuucaaaggugggaucccggaugccaucccugaccgcuucgcgcgcaggcucccgggcccugucgcuggugcagucacucgagggcucugggaucucuucgggguccucaccgaggguguccucacaggacacucuccgcuccacgaagucuggccccaagcuucucucuggccugucccgggaucgggauccggcucuucuccccccacagucggaggacagcgugaacgcugaagcugcggcagaagccuccccggguagagccugaaccugcagagagugaggcccaggaggcccuagugugggcgagucaggcgcgcagggcgcuuacggggauaaugcaaugguuaauaaaggcguggcccccaggcggcucugacacccgcgugcaugcucuagcauuuccggccggccacucauucgugcguccaauuuccaagcugcaagagagcu

SEQ ID NO: 17819 - RNA, 15336 nt, Homo sapiens
caccuggagcccacccucccaacaagaagcccagaggacgccggcauuuggggcuagcccugcacccccaccuccagccuggagacccaaaggcagcucugauccagucaggcccuuguugcagugcagugcaggacagccagcccccagccaggauggcaccaagagcccccgccccaccuccaugaccgccaggacuuuccucggggccccacaucaguucacaaagugccacgcagggcuuugagggcccagucucuccagccagccgcagugcaguggcccgaacccugcccuagcucccaccgggucccuggguccuuugucuccaccaaaccccagcggggcuccugugggcgugcuagcugcccuggagcccuccagagugcaugggcugcggguucccauggccagcugggcucagguugucuguggccagggagggucugggcccugagggucagugcgaccaggaugcagcuccuggcccuguggccugcaguuugaguuucccucgaccagcugugggaccgggggagccgggauggggcgggggcggggggcauuggugccgcccagggcaggaccaggcacgcccguugcugcgcacagcaggcacucuggcugcugcgcugccuccuccagcuucucagccucccucccagucucgccggcagggcccguggccuguaaagccccgugccgccgugucagcgcguuagucagccucucagcccaggcgagccaccgcgccguggagucccuauaaacucccuggcguggccuggccccaccgaguggggucagugaggcccauaggcagagccagagucccgagcugcggugcugcgggcuccagcaaggggcaggaccuggaacagggggccaagccuggcgugggagcacacggccacuguagccuccagggacgcccucugagcuggccugaggccggcugguccaugagccagggccccuggggagcagacaccuggugaaggaggcgcuggauccagggccaugucugggaaacgaagucgaguucgcaaaccccgggccaggagggcaggcagggcccagccggcagcugggcagcagggcccugaggucgagcccccgccccccaccccagggggcccucagggugaagcggggguggccccuacagggcacgugaccagcaucgagccagcaccucagggacaccccaggguggccaggccagagcagccacaggcagccucgagaccggugccggccacugcuccggggucugagcuggugcugguccuugcugggcacauggaaggcuguggagcaggggaccccaugccggcccugggccccgaacugcugaggcuccaugagguccagcugugccuggcccaggagcagcugcugcuggaggaccgguggcggcagguccagcugcagaugcagcuguggcgggaggagcagcuauggcugcagcagcuacaggaggagcagcuguggcugcagcagcuacaggaggagcaggccuggguacacguggaggggcugcagcuggccguggcccuggagcagcuccggagugagggcuucgaagcacugcagacccaaggccagguaaggccuggaugggguggcgggaggggucccggacuguuguguuggugcgguggccacugcagcaaccuagggaugccuguggaggcccaggaagccaggcuggaugcaggguaucugugggcccaucuucacaucugccaagugaagccggugcccgccacacagggcacugcaagaccaagggacagcaagccugcccaggcuggcccaaugcuugguggaaaugggcacugagggcagauacuuguucagggacagaggugucccugcagcagacccaggcaugcugggccagagccguccagggcaguguaugggcugcggugcagggcgaaggccugggugugcagucaguagguagcagaacugaagagcacagcccccaccccugcaacccaguuuccuggcugccuugcugguccaccugcccugccccccguuuauuggagugcaguguacucagggcuagagauugcggaagcagcaugcggcaccugugcccauuauccucauuccaggagggcggcuggccucagacgcagcuggggcuauuuuggggaacuaggaucuaaccccagccuggcguggaggagcggucaccaucaucccaccugcuccugugaaucugggagcucucuggcaaccagggguguuaggccaggcccacucuaagcagaggggcagucuggggagcaggauggggugcucucuuagcaagcacagaccccagugcaggccugggugcugaaggaccccagauuugcaaccuggaauguguucacagccagcauagagaauaaaugggagcuggagcaagggagugacaacagugaaggcggggcuggggugggggaggguacugggggaagucuccuuccugacccacaggaaaacccagcccaggugagcugucaccauccaaccuggaagugacuauggagaaggugacugggagcaaagccgcaggcagagggcagcacaggauggcccagauggagcagagagucagagaacacaugcuuagacugagaauccccaacuuggacucaaacccuccuguuucaaaacccauuuuuggccaucuaggcgccucccacuggcuccugcccccuucccaccuccauguguuccaaagcugggcuucucugagugcuaccccuaggcccccaccccaaccccagggguauaagauucaggcuuggccgggcauguggcucaagccuguaaucccagcacuuugagaggccgaggcgggcggaucaccugaggucaggaauucaagaccagccuggucaauguggcgaaaccccgucucuacuaaaacaaaaauacaaaaaucagcagggcgugguggcgcacguccauaaucccagcuacucgggaggcugaagcacaagacucacuuggacccaggaggcggagguugcagugaggagggauugcgccauugcacucgacugggugacaagagcgagacuccgucucaaaaaaaaaaaaaaaaauagauucaggcucaaggucugagaugaaugaaugggcucugaacccucagucaaucacaccuaaucccaacucagagguccccuaaaagccacucuuggaagaagggcucuccucagagggggugucucucgguggcuacauagaaggucucacaggucagugucugggugacagugcucuggaggucagagggugcacuuaccagcagcagcucuugucuugggcccaggguggagcgucugccacuucccagcugcagcuuugggucuccccuucuuacuguccauucuccugggggguggguagggaaggaccagggagagggugcucagaguggcagagggcaggggcaguggcaguggggaacagggcacaccaugggcgccugaguggaugacagcaggaacaugggcuccccugaggcuucccagcugguguccugucugccugcccgccccgggugugugcccagaagcuugagccgggaugccuggcaagagcacuuggccaccucccgucccccuggccguggcuugccugccccuccgccccaggcucagcccauccugccgggcgcaggaucuggagucuagcacucuucucccugccccaagcugcuggguugccagugggccggucuuuguucucaccguaaucaugagcauggcccucucugcugaagccuccaugccucuccacugcccugggaagccagcccaccccugagccugcuccccagcccacccaaggcacucaccccuccacacccucagaccuuauguggucccggcucuggcagaugguggugucaggcccuggagcaacaccccucucccuaguccacacagcugacccccaaguucauuucccugggaggcuccuccugccugccccagccuguccggguccuccccggugccccaugccccucacccgcugcagcacaguugccugggcacuggucugaccccccacccauguuuccagcaugcugguaccagugggguggcacugaguguuuggggaaagaacaaaugaaacugggacugacccugaaaacagaaaauaggaucacauggcaagaggaacaaagagaaaggcgacugaugaccaucagaaaggguugaggcagggccaguccuuggggugggaguggcaggggcgagggguggugguuuggacagaugauccaguguagggcagggccuaagagggggaggggcccuaagugagggccugagggggaccugggggacuggagcacccaggggcagcucggggugguguguggggguugcuguguacaugggggggcgucugguaugaggcuuggugugcacacugggucccuuguccguuggggcuugguuuuugcagagucccuguguguacacaggguuccguaugugagggagguccccugugcucucagagucagugugaauauggcauccccuguuugugugugggguuggugucugagaaaucucauaugcaggugggguucccuaggugugcggaugucagcguguucgugggugacuggcaugggcaggacucggugugcuuguggcuucugucuuccugaggagucuccugugcuuggggguugguguacaugaggcacaggucauucgggguccgcaugugcaugggggggucacugcggcagaguccccuacaagugugggcaucggugugagggggugagggagaaagaugggggaccccagguacuugugggcaucagugugugugguggggguuggggucuggggguccucugugugggcgggguccucgucuacguguggggcgcuggugcggugggagaccgguguguggugaggggauccccugugcucucggggcucccagacccggccccgcccggggcucgacgccgccccaccguccucaccugucgcaccugccucccccaacucggcgaggaggccagagcuccgccccuggcgucgggcucgcucguuuccuagcgacugagccggaacuuccgagucaccccgacuuccggggcgagggucaggggucaggcugggaacuuugagccuugggucaacaguugggcucccgggggucggggucuuugaagugcgggccucacggucuccggcggcgcugggccggggucuccgggcgcgcggccgcagggcacgggcgggucggggcgcgggccgggggcgcgggcuggggcuggcggcgggcgcggggcgcaggaaugcgggcgcgccgcggguggggcugccccgcccccaggugcugcccgggcaggcaggaggcaggagcgacgggcggggcgggggcgggcgcgugaaucaggccgggcgggccgcggcagggaguggcugccggaccgaccggaccgcgaggccgcugggcggcggucggcuccugcugccccugugccgagaccccgcgcaccuggccagguagggccccccucccccggcccgagcggggcggggcgaggcggggggcgggcgccccuuggcgcggucccacuugggcuacccuugcgcccacaccugggccggggccgcgcgacccagagaggggcggugggaguggagcgcggccgcgugcgcggggccgggguggcggggcugcucggacagggggcgccgcugugcggauauggacgcgagcgcccccgcacgacgccggcccgaaaagagccgagggggaaggggcccgggauccgggucgagccugcccggccgucccgacucgcucccgcccucgcggccuagcuggagucugggugcugggcacggccuggacccuucccuggggacauccgcccgggccgccguggacugggguggccagggugcggccuggauccccgcguggcgagcagggcgagugaugggagugcugccccucgcgcccacguuccugggcuggggugggcggauagggcacccagcggccgcagccgcgagcucguagggugcacugaccccguugggggcuggggugcccacuccgcaaguuaucacugagcgacuuccggucugugagccccguccuccgcaccccaccuuuccgccgccuagagccuccgcgcccuccugcgcccaucggaacuuggcacagguucaccccacuuuguguaggaacuccagauccuuccaugggguccuccuuccagauacucaggaaccccacuuccugccaggguggagaggaugggguccuugaaggccagcugagggcccugacuucgagucagaggucaggggucagcaagcagaagaguggauucgugcugagucauugcccauggguggguuccgcgcccucccucccuugggcagacguuugguaggcaaaugugugggcaugcaggccacuggggugcuccaucuugggcucgggaguggcugcagccccguccauagcccaggagacacguacccaugaaaggagacgacgugaggaaugaagcaguuggaggucugggcaucacccugugaggacgaggcaugucugcugggagggcuccuggccacgggggcuuccacugucuggauggucccugcccccauuacacacagccuggagccuggacacugaaauccaaagggacaguggggguccuuucuagaguguccccccagugucgggaaguacccucaaacaacaucagcaggguuguucccccugcccuguauggucagacaccgccccuacagacaggcuggcaauggugagugggcuccucggcccagccagacaggccuacaccucacccccaugugguuggccucgaucugccccuggcacaaccagagcggugugcccuaaccagccccauaugucaaccaugaggacggugccccaacaaagaaauguugggacagcuucucccaagccgguuggcaucuagggcuguugaguggcaccagguauuucccaugucucaacuccaugucacccccaggggcaccaggcaggacggcugccuccugaccccaacauucucagccaaguggcuccggcuagcacccauguaguccagcuggccggcauccauccugucagcgcccaggggcacgcuccucugggcaccuuccuagccagggccaacauucaggaaccugugugcuaggcggggacagguguccugccucccuccccaacccgaggagcagugggauggacugagcagucccuagggcucuccuuccagggagagguacccagguagcucagugacccugugugcgugggcccugggcgcuccccaucugacaccuuucuggagaggccaggcccccgcagggacccuuuggagaacagagugggcuguggggcagccaagcauggauggugguggcgagcccaggaccuggaaaggucccugcugcccuggaugggggcugguggggacaggacucugagcaaguggagagccagauuugggcgauguggagugcaggcccugcagggcccugugggcaccaaggggcuguggcccagggagguuuuaucugagagggacagugacaagaaagaggucaaagguaggccaagggaaggagggggugcugggagacagggacggagucuagggaucaguguuccaggacugggcggucauagaaugggcugugggagcccaauugugaaacccugaggauggggaggagguguggcccgggacuauguguggggcuuaagguugccauuccaggaggaggguagucacagcccuguuugcugcgcucaccuugggcuaggcguggugucauguggacccucagcuguguugugcaguagagguaggccagagaggugcagugaccuacccacagucucccaggcagucagagacggacacaugggcagcaugggcggcaccagcuuguccaguaggcacagugccagggguccgugaaugucuuaaaauaagaaaaaagugaauauuauaaugaugaaugcagccuggauuguuugucuuuaagccaacagucaugaaauauuuggggggggggguucguuuuauuuuuauuuuuuguagugauguggucucacucugucacccaggcaggagugcagugucacaaucauaauucacagcagccuccaacuccugggcucaaacaauccuucugucucagcuucccaagugccugggacuaugugugcacgccaccaugccugccuaauguuuaaaauuuuuuguagagauggggucuugcuguguugcccaggcugguuucaaacuccuggcuucaagcaguccuccugccucagccucccagagaaaggagagacagggcugggauaccugugccccagcccucugccaguguccccucagcuaggggcauccuagggucuggguugcucucugugagccugguucggcuggugcccuggaaggccuccugggcaugggcuaaacuccagccuacccaagucacugacggcccuuuccacaguguguccaugcucgaggguaggaguggucccagugcccccaccccuagucaugugucucccugccccuccaggccccuggccccaacauggcccgucgcucucagagcuccucgcagggggacaacccacuggcacccggguaccugccgccucacuacaaagaguacuaccgccuggcgguggaugcacuggccgaggguggcucggaggccuacagccgcuuccucgcuaccgagggggcaccagacuuccugugcccugaagagcuggaacaugugagccgacaccuucggccuccgcaguauguuacccgagagccaccugaaggcagccuucucgacguggacauggauggcuccucggguacauacuggccagugaacucagaccaggccgugccugagcuugauuugggcuggccucugaccuucggcuuccagggcaccgaggugaccaccuuggugcagccaccgccccccgacagccccaguaucaaggaugaggcccgcaggaugauccguuccgcccagcaggugcgccaucuugggcuugaggguagugggggaggggccugggcuagaggcacggggguggaggagaugcaugagcaugaucagcuugaggggugagccugagcuccagcuggagugggggucccuggcaaagaucuucagggcugccaggucucggucaucaggggcugcaggcucugcacaggucugcuugccuguggucauggccagugcccagaaacucgggggcucuggggaugggugggcaccccaccagccuggguucauuguucagauaauuaccucucauccugcccgguggcccuuggccagcugagggcuucuaaccaucaccaaacagcuagcagacggcggaaggugcuguuaaaccauagcgacugaggcaugagguccagacgcuaaaggcuugugacuuucuccccugcccagggcaacaaccccgucccagggcagaacuggagccuggcacuuggcccugacagcugcccuggaaugggggcagcucagccgucuguaggguggaggggauugaggggcccuugccgugccccaaccuggcccacccucauccaggguucucugcccugcaccugccucgguuucccccuuauggccagccguuccacaccucuucuguuuggucccuucuuccugcccaucuucccagauguggcgccaacucccuaggauggacuagcuuguuucacaguggucgugggugauccagacaccucccggguguggaggggaggcuggacaaugguguggggacagcaggggccucuccucuccguccugacccgccccugcaggugguggccguggugauggacauguucacugauguggaccugcucagcgaagugcuggaggccgcggcccgucgggucccagucuacauccugcuggaugagaugaacgcgcagcacuuccuggacauggccgacaagugccgugucaaccugcagcacguggaugugaguucccgggagugggagauuggggaggacccgugggagagaucugacuccccucccuccccaguuccugcgcguacggacuguggcgggccccaccuacuacugccgcacugggaaguccuucaagggccacgucaaggagaaguuccugcugguggacugugccguggugaugagugggagcuacaggugcgcccgcggggcucccucacccccuucucuggggccuccuccuguaaccccagcacccccuuuccacaccagggcccuccucgccaggagcccuuguccuguagaccccugcacagccuagccgggcccagguccuugcagaccucacaucccugcguccuccgcgccccacccgcugcccacggggcugcagugcccucgcuccagcucgguuugacucuggcccugacccccccacagcuucaugugguccuuugagaagauccaccgcagccuggcgcacguguuccaaggagagcuggucuccagcuucgacgaggaguuccgcauccucuucgcgcaguccgagccgcuugugcccucggccgcggcccuggcccgcauggacgccuaugcccuggcuccguaugccggggccgggccucucgugggcgucccuggggucggggcgccaacccccuucuccuucccuaaacgagcgcaccuccuguucccgccaccccgggaagagggccugggcuuccccuccuuccucgacccggaccgccacuuccugucggccuuccgccgggaggagccgccgcggaugccggggggcgcgcuggaaccgcacgcggggcugcggccgcucucgcggcgccuggaggccgaggccgggccggcuggggagcucgcgggcgcgcggggcuucuuccaggcgcggcaccuggagauggacgccuucaagcggcacagcuucgcgaccgagggcgcgggcgccguggagaacuucgcggccgcgcggcaggugucgcggcagacguuccucagccacggcgacgacuuccgcuuccagaccagccacuuccaccgugaccagcucuaccagcagcaguaccagugggacccgcagcucacgccggcgcgcccgcaaggccuguucgagaagcuucgcgggggccgcgcggguuucgcggacccggaugacuucacccugggcgccgggccccgcuucccggagcucggacccgacgggcaccagcggcuggacuacgugccguccagcgcgucccgcgaggugcgccacggcucggaccccgccuucgcgcccggaccccgcggccuggagcccagcggagccccgcgccccaaccugacccagcgcuucccaugccaggccgcggcgaggccgggcccagaccccgcucccgaggcggagccggagcgcaggggcgggcccgaggggcgggcagggcugcggcgcuggcguuuggccuccuacuugagcggcugccacggcgaggaugggggcgacgacggccuaccggcgcccauggaagcggaggcuuacgaagacgacgugcuggcucccgggggccgggcaccugccggcgaccugcuccccucggccuuccgcgucccagcagccuuccccaccaaggucccggugccaggcccgggcagcggcggcaacggcccagagcgcgagggcccggaggagccuggccuggccaagcaggacucauuccgcucgcgccugaacccccugguccagcgcagcuccaggcugcgcuccucgcucaucuucagcacgucacaggccgagggcgcggccggggcugcggcggccacugagaaggugcagcugcugcacaaggagcagacggucagcgagacgcuggggcccggcggagaggccgugcgcuccgcggcuuccaccaagguggcggagcugcuggagaaguacaagggcccagcccgugaucccggcggcggcgcgggcgccaucaccguugccagccacagcaaggccgucgugucccaggcguggcgggaagagguggcggccccaggugccguggggggcgagcgccgcagccucgagagcugccugcuggaccugcgcgacuccuuugcacagcagcugcaccaggaggcggagcggcagccgggagccgcgucgcucaccgcggcgcagcugcucgacacacugggccggagcggcuccgaccgccugccuucccgcuuccucucugcccagagccacucaacguccccgcaagggcuggacagcccucugccgcuggaaggguccggagcgcaccaggugcuccauaaugagucaaaagggagccccaccucggcuuacccugagcggaaggggagccccacgccuggguuuuccacucgaagaggaaguccaacuacaggauuuaucgagcagaaggggagccccaccucagccuaccccgagcgcagggguaguccggugccccccgugccggagcgcaggagcaguccggugccccccgugccggagcgcaggggcagccucacccuuaccaucuccggggaguccccgaaggccgggcccgcggaggaggggccgagcggccccauggaaguccugcgcaaaggcuccuugcgucuuaggcagcugcugagccccaagggcgagcggcgcauggaggaugaggguggcuucccagugccgcaggagaacggccaacccgagagcccgcggcgucugucacugggccagggugacagcacggaggcugccacagaagagcgggguccgcgggcgcgccuguccucagccacggccaacgccuuguacagcagcaaccuucgggaugacacgaaggccauucuggagcagaucagugcccacggccagaagcaccgugcggucccugccccgagccccggcccgacccacaacagccccgagcuaggccguccaccggcugcuggcguccuggccccagauauguccgacaaggacaaguguucagccaucuuccgcucggacagcuuggggacccagggccggcugagccgcacgcugccagccagcgcggaggagcgcgaucggcugcugcgccgcauggagagcaugcgcaaggagaagcgcguguacagccgcuucgaggucuucugcaagaaagaggaggccagcagcccuggggcaggggaaggccccgcggaggagggcaccagggacagcaaggugggcaaguucgugcccaagauccugggcacguucaaaagcaagaagugagucuucuggccuggcaacccaggccagggugcccgcaucgcugccccggucauccagaagccccgcggaacagagagcccugcucaucugcuugagcagcggcugucaggccacggccgcuuggggcuuggcugagugcgccagaccucggcuccacuggaggcucaccuggcagcugccgucucugcccccuggccuccccaacgcuggggcugcaccccucgccaccagugccuuucuccccucagcaccuucaucucugcaccgucagccuugcguggcgcagcgucuggcuccgccaucucuuugugccucagucccccccgcccccuuuauuuuuuugagaccuagggcuggagugcaguugagcggucugggcucacugcaaccucugccucccggguuccagcgauucuccugccucagccuccugaguagcugggauuacagauguaugcuaccacgcccagguaguuuuuguauuuuuaguagagacaggguuucacuauguuggccaggcuggucuccaacuccuggccucaaaugaucagcccgcuucagccucccaaaguggggggauuacaggcgugagccuugcaccccgcuaaguccccuauccucuugcaagggucucgccucugugccucaauuccucauucucugggcccuucuccuccucagggccuccuguucucagggccuccccccuccccgcucccucccucucucaaggucuccuccuucccucccccccccccccccccgucuccccccucccccgccugggcuucacuuccuuuccuacuuggauucuccugcucgcugccucccagcaucuuuuuuggaggcccgucucuugcuguggggaagacugggcuggcugcgggcaguuugcaagggguggguggggcaggggggggggagcuggaccagaagaugccccuuggaguggcaaggaagcuggacagggcaggccucuggggacgggacacagggaagcccgaaggggcgccuuggccaggucugccaucuccuccagcgaggcucuggccagcacugggugagaguggggagggggcauuggccuuugcagcacaguaaaacaugguccagacaaccuguggccccggccucaugagcacccccugcacaggcccggcccaagccaggcgcuagaagggcugguuguggagugcuuauccuugacagguauggggccaggugagggcaggggacaaggugcagcugaggccgagcccaacuagguccugggcaccccugcaggugggagugguccuuguccuccugguauccagcagacaccccccucuccccaccagccccauucucagguccuuuccucuuugucaccaacaccaagaaucuguccaggguucuuggcuuaucuuuuaucucuuuucacuccuagagaggaauugcaauugacucagaaugacacauuuuggcaccacguguguagaaagcccccacuguuagaugauagccucgugaaauucauguuucuguauucuccuauuucuuuucaaaaacuaauuuuuuuuuuaguguaauaaauccuaagagggaacugauuuaagaaacaaggccgccaaacaaaggcagcaguuccgacuccagcagcugggaaaggaaggaaagugaccccacuuucacuccugcacagcccacugguuaccaaaaccaccgugcaagucgggaugacagcagggacuucuggccaggugggaaaggugccuggaagcgggaugcgccugugcgucucuuggccaugauguucuugugggcauguuauucuuggugcugccugggguguugcugagcggacaggcucuccagcuggaguccauggagaggccagaggcuggcggcccugccugggccuucggagccuccugccugcacccuccaccucuucuaaaccaugauguggcacauuuugguguuaauaaaacacaacacacaaaguauucuagcauguucc

SEQ ID NO: 17820 - RNA, 24869 nt, Homo sapiens
aggcggcgagggccggacucggcuucccgacgggcugcgcggcggccgggugggugucggcggggcaguccggcgggcagcggcgguuccggugcggcacagcgggcggacgagcgggcgggacgagcugagcaggaccaagcgggaugcggagccgccgccgccgccgcuccccgcgcuuccuaagagucugagacccgccgggccgcgcccccugcccaggcccgcaguccgagcguuccgagcgcgggccgggcccagcgccggccgcggccgcguccccguccagucucgggcggcccgcccccugccugcgcccccuccccaugcgcggcgcccaugcggacugagccccgccccccggccccgagcccgccgagcgccgccgccggagcccgcgccgcccacccgcaccaugcucaagugcaucccgcuguggcgcugcaaccggcacguggagucgguggacaagcggcacuguucgcugcaggccgugccggaggagaucuaccgcuacagccgcagccuggaggagcugcugcucgacgccaaccagcugcgcgagcugcccaaggugagcggccgcccgcaccugccgcccaaaggcgcgcccccagcccgugauuccuccggcggcagaaucugcccgggcgagucaccgcagccuccagccggcccugcugguuugcacuggccagguccccaccccagccagccccacccuucucuuccagccgcccuggcuggcgcagguggcagcggucaucaggugcuugccuggggauagcgauugucaccgagccuggaggcggagccucagagugaaacccguggggauucagggagguggaugggguuaggguggaacuuggauucagguggcugaugaguacuagcuucuugggccgcucuggagguggguccagaccuccucuccuuuuuugcugggugcaggggugagugggggagcccucuugauguacucuuugcucucggaucuguucgcugucccccuuucuuuacccuugcuucucguggucaggugcucuccuaaggcugcuacaagaaaggaggcuggagaaagcagauuaaaaaguauuucuuuucuggagauggggugcugggugaucaguaccuagggguugggugucccaaagaaugugacccuguucuggccguggcagugacagcucgguccucuguggccaccugcaggccucgcgcguagcacugugccugugguacuguguuauuguggggagcguuuacugaguucuugcugcagaaccaggccaggcuuguugucaggaugcaguagcagaggccagugugggccccuggaggguggcagaagugguucaggggcugggugggcccugagguaagacacaggguaggggauuggggcuuugucuggucgccagcaggugucuucucagaguggaggcuggugugaagaguagagggaggcagccacagugggcguguguaccguguguuucuuuccuuuuuuugcaaauggggugucgugguuagaccccaggacccggugugaccuggagcagacagaggccuagggacucuugacuugugacacucacguguccaggagcucuucucugcucugcaguggucucugccacagaguccguguccucccugcccacagccuuuuuuccggcugcugaacuugcgcaagcugggccugagcgacaacgagauccagcgguugccucccgagguggccaacuucaugcagcugguggagcuggacgugucccggaacgguggggagccugggcaggggcuggguggggucuggggaguguccgcuggggcugcagacggccugcaggccauggcaucuguccacugugacccucugugacagauaucccugagaucccggagagcaucaaguucugcaaggcucuggagaucgcggacuucagcgggaacccccucuccagguggguggcagccugugguggggucgguaggggcuaugggucccacagcccuggacuggucauccgagggccucugcuuccucccauccaggcucccugauggcuucacucagcugcgcagccuggcucaccuggcccugaaugaugugucucugcaggcacugcccggggacgugggcaagugagugccuucucagguggaacuaggguggggugggggaccaggauuggcccugccccugcugccacugcuuuccuuccucuugccccagcgccuggucucucuuucagccucgccaaccuggugacccuggagcuccgggagaaccugcucaagucccugccagcgugagugugacaggcauucuccuaacagccagggcagggccacagcccagggaccagggcugcguggccacaccuccacccugcuuccucugcaggucccugucauuucuggucaagcuggaacagcuggaucugggaggcaacgaucuggaagugcuggugcguggaggccugacagggcagagaccggagggcgggccacggaagcaagggcaaagaaggggacagcgagcagauccgacagcaaggggcaccucgggagggcaggcgggugggagcugggugugggggcguauagucucuugagcacggcgcagcaggaggcuuugccucauagucacuauuuucucuguuccuucuugcagccagacacucugggggcucugcccaaucuucgggagcuguggcuugaccggaaccagcugucagcacugcccccggugagucaggguggggcuggcccccugcuucgugcccauccgcgcucugacucucugcccaccugcaggagcucgggaaccugcggcgccuggugugccuggacgugucggaaaaccggcuggaggagcugccugcugagcucggcgggcuggugcugcucacugaccugcugcugucccagaaccugcugcggaggcugcccgacggcaucgguuagugugccugggggugccuggguggggcacacggagccuggcccugggaggagcguggggcgucggggcugugugugguguggaacacaggggaggauccugagugugcccaggcucugggagcugucccuggggaggggaggugggacccuggggcagcccagaaggcugaggaggcagcugguggugcuggagggggcgguggagucugugagggcggaaggguggcagugccacuggggccugguguuuucuugaaggagguugggucaggcuuguggggcaagguagguaggguccucccgaaguacggcggcggcagaaggggcugggggccuugcugucugccuugagggcgcuucuggccagguggguaaggcacgucuggggaccaugcucagccuugucccccugucuccccgacgccaggucagcugaagcagcuauccauccuaaagguagaccagaaucggcugugcgaggugaccgaggccaucggggacugugagaaccucucugagcugauccucacggagaaccugcugaugguagggucuggcuugggaggcagaaaggauggggccgucgggggugcagaacaaggacagggcaucagccugugucugcugcuggggggugcugguggcagccugacguggagccacucaggaagggcucuucucuugucagagggggagcaugcuggccggaggugaggcggggcagugaggccagggcaggggccuuugccguuuaccgugaagaaucuaggucucguguuuaucgcuguauguuguaacacuggggagcgguuacagaagaggcaggaaugggaacuuauuugucuguagggaagacagauggagagcaggcugcuccccaggggcgucugccugccccucacaaagcagggcaagcugaggcaccaggccacgguucgggacggugguguugcuauccccauccccaggcugggaaacaggagcuagcuguggggaggguguucaugggaguuuccggggggguuccucacuggggagauggagaaagggacucugggguucagggcccugggaaggggcuggcccugagcaggcaggcuggaacugggggccuggggagcccuagggaugacagggcagaccaguggggcaccagacaggcucacagggcgcagccucgcaggucaguccagggcacccaugggagagggucagggaugaccuggugggguguuuuggugguggggacugaaggcugagggcagugggcagagcuuggggagcagagggcacgaagugggguggagacagcuucuguggucagguccuugucccggucuccaggggcugugagggacccuggcuggagcuggccuggggugucugugcccuccugccaggggcugucaucuccuucccacccccagcaagccccuagcguccucugaccuccucuucuuggccaggcccugccccgcucccugggaaagcugacuaagcugaccaaccucaacguggaccggaaccaccucgaggcgcugccgcccgagaucgggggcuguguggcacucagcguccucuccuugagggacaaccgccuggccguccugccaccagagcuggcccacacgacagagcugcacgugcuggacguggcggggaaccggugagugccagccuugcccugcgggccuaaccguggccccaacgccugcugacugugcccgcccggcccgcagccugcagagucugccguucgcgcucacccaccucaaucucaaggcccuguggcuggcagagaaccaggcgcagcccaugcuccgguuccagacggaggaugaugcccggaccggcgagaaggugcucaccugcuacuugcugccccagcagcccccacccagccucgguagguuguuggcaaccggugcuuagcgcgggguggcucucaggcaggguuuggggacuagccuggguccugacgcucaccugcugcagaggaugcugggcagcaggggagccucucggagaccuggagcgaugccccgccgagccgcgucagcgucauccaguuccuggaggcccccauaggugaugaggacgcugaggaagcugcagcugagaagcggguaugagggugaggaucuggggggcgaaccucugccugaccccugcccuguggcugcugcucauccuugucccuacaacagggccuacagcgccgggccacaccucaccccagcgagcucaaggugaugaagaggagcaucgaggggcggcggagcgaggccugcccuugccagccagacucugggucgcccuugccugcagaggaggugggcauggagccacggcaaccuggcgggccgcugacccgggagcuguggugguccgguccauccugggaguggggcugugagggccagggcagcacagagaaggagcaggagaugaggcuggugacagguuucagggacauggagcugcagggccagcugggugaagggugccaggguggacgugugggucgugcagggcgggucuguggggcuggaguauggggagaaccaguggugggugugccugggagcacagggaaugggguuugguugugggguagggucucugguggaacugccgugggugucaucggcaccugggaagggguuugggacugggacagagcaggccugacuguucucacucagagcugugacaugcgugcuguggguuuuugggugcagcagaaccagugaucugggcugggguaggguguguggggccgugcaugggaggggaggagguucauaucacgcugggauuuuccugggaacuugugugguccuuguuuguuuuaggaaaggcuuuccuuggggcugggcuguggaaccguggcuuuguccacccuaggcuuuggaggcguguggcuuccuugcaggcugggacagggagcagcugcgagggcgugagcccguuaacggugccuggucggggcagcgggaagcucagggaaggccugccacguggggggcaucccagguggccagccugugagucgggagcuccgucgaagccugaccccacuucccgccgcaggagaagcggcugagugccgagucuggccugagugaagacucucgcccaucugccagcacagucucugaggcugagcccgagggcccgucggcugaggcacagggugggagccagcaggaagccacgacugcuggcggggaggaagacgccgaagaggacuaccaggagguguggauuggcaggaaggaggcaggaggcugggccugcugggugggggcugccuccccugcggggccucagcugggaucgguuuuggugcaggcagugccugggcccugcugaugcuucggggagcugcccuguacagaguggcuacggguggugcagggccgugcugcugggggugcccuggagagcugccucccuaggugggguuaaggucuccccugacggcugggcucacagagcccacccccacccuggacucucuucugacccccgugggcucccuggugugaggccuuggcgcaccccuucguuuccaccuggggcgcugcgugucuccaggaugagccccuggccuucagcuuuucucagggcugagacacgcgccccucacugggcaguuagugcugagucuuuguguggcggggaggcuuucggagcccgucuguggccacacuguuuaguagggucuuccuguggaagcacagccacagagcuggggccacccucacccuuuuguccgcacagcccacggugcauuucgcagaggacgcacugcugcccggggaugacagggagaucgaggaggggcagccugaggcccccuggacccugccaggcgggaggcagcggcucauccgcaaggacacaccucacuacaaaaagcacuucaagaucuccaagcugccccagcccgaggccguuguggcucugcugcagggcaugcagccugauggggagggcccuguggcucccgggggcuggcacaauggcccccacgcacccugggcuccucgggcccagaaggaggaggaggaggaggaagaggguaguccucaggaggaggagguagaggaggaggaggaaaacagggcugaagaggaagaggccagcacugaggaggaggacaaggagggggccgugguuucugcgcccucugucaagguuggugucagccucaccccugccugacccagauuccccuggcccuccugggcacccagggcugcggcaggagcagggccgaggccugacccacuggccccuggccacccggagaaggugguggacacgugugcuccacagucggcaucacggccacucucaccagaccccaggccugcccuggcauuggucucaguccaugcuuggacuccaggccugcccuggcguuggucucaguccaugcuuggaccccaggccugcccuggcguuggucucaguccaugcuuggaccccaggccugcccuggcguuggucucagugccagaggcagcucugcuggccaguauuugcccgaccugcuggcgggcacggaguucacagaagucaagcauggcugcccacucuuugugggucuccagggccugucuacaugugucguggucccagggcagggucuguuccucucccaagaucacugggcucuccugggauccucucuuguguugggcacugcaggcccgaggcccugauggcucuuuucugccuugucgggcccuccugaggugccacacaggccuucggggcaccagugugucccucccuggcccucaagucuccucuccaugggucacaaagggucucaccugcucucugggcaaacucagauuccagggggaguccccgggucucacuaucccugcccuugaugacacucugacccugagugugggccaguggcaugauagcugagggggcccggaggggccacagcagggacagcccggugggacucugcucagcucuggagccccgcuuguccccagguguguggugucacucacgccuccaggauggaggcgcccgugccagggcagucgagggagcuugcuguggucuccucuguccuuucugcuuguggcgggggcugggugaggcgguggugguggucuuggcgguggcuaaccugcaugccucacugguccuguccuaacagggagugucguuugaccaggccaauaaccugcugauagagccugcucgcauugaggaggaagaggucuguacugcucgcucugcacucuggccgggccgcugcuggccuugcuucccgggcugugggcucacgccucuccccgccccuguugcuugagcgcagaucccucucaaaagagcucucagauccagcugggcuccaggaucaggacaccuccugccuggggcagcccgucuuggcaggggugagcggagaggcugguccagcucccaucagccgccuguggugcucugagccuuaccugccugcggaggcagcgcaguccucacucgaggguggcaggggggccucgggccaccaucaccuggaggugggcaagccccagcccaccacgcucugcagagcagugcccuccugcuggggucuuggggcuucuccagcuggcgucugggcuggcccuggcuggugaguggcaugaggccccauucagcugccuagagaaaagccagaaauggcaucugcgugcugguggggucuccugcagagagcacaggcagccccacugcggcccuucuagacacccugucuguucuguuuccagcugacccucacuauccugcggcagacugggggccugggcaucagcauugcgggcggcaagggcuccacacccuauaagggggacgacgaggugagcacugccuaggagggccuuuccgcugccacuggccugccccaccacaguucacacugauggcacacaggccccuugcccugagaacacucacacgcucuggggacacgggcugggcccaaggcaccuacuguugugggaucccgaaguccaagagcaaccugagggugccugggucugucuucccuucacagcccuccuucucucaccagcugccugugcaccaggccuggggccacgagcccuuucucggggcugacgugcuccuucuaacccccuggcacucaggaucccacaguggcuagagcucaguccuccugcuggccagggcuaggggcugcugggagugggucuuccccuccugggucuucugcagaaggagcaggaaugcgggcccgucucccuggccccugccaagcucgugucugugcccuagggcauauucaucucucggguguccgaggaaggcccugcggcccgggcuggaguccgugugggugacaagcuccuggaggugagucggcaaccucuccgccccgaguggcagcugugcccucuggagguacauggucccugguauuagggugcuuggcugccuucucccggccuccccaagaguuccaagcacaggacacccagacuuccgggugaagccacggaaccuguaaaccccaggagagaaucaccugggcaagugccaccugggcuuuccguugucacccuggcucccauccagcgcccugauugcucaucuuuguucuguggguacagguguguuuuucuaccaguggguagggcagcagcugcaccuggcacaguggccucuccaggaggggccgcuccugggcugaccgagaggggucaggcuacuggcaggucuggugggguuuggacccuguaugggaguccuggagccuccaccuggacaccuagcuguucagccggggcacgggcauccgggggcucugaagaggcaugcgcccuucuuguagggacacacugagggcaggugagggcccugaagcccagccaggaggcgucugcccagggcucauaugcugcgucugcugcucagcucuccugaccuuugcgugggaacugcugcuccuggguguuggggugggggugugggucaguaacccagcgaccuuagguguguguugggcugugcagaugggccggagguauccaggagcggggccauguguggccuggccgugggggcaucugcuugccucccguggccaguguguguccuggcccuagggcuucccacaccggguuucagaggaccugguaggggaggggucggugcccacgaggaaccuuguggcuaaaggucucgggugaugucagcgccuggggccuuuccccucgcccugugccucagucuccccauccuggagggagcguguggagcccccagcacguggcugucuguggcggcacuggguccugaauacgcacguggucccuggcccgcaggugaaugguguggcucugcagggcgccgagcaccacgaggccguggaggcgcuccggggggccggcacugccgugcagaugcgaguguggcgggagcgcaugguggagccugagaacgcggucaccaucacgccgcugcggcccgaggaugauuacagcccccgagagcggcggggaggggggcugcgccugccccugcucccgccugagagccccgggccccuccgucagcgccacguggccugccuggcacgcagcgagagggggcugggcuucagcauugcuggugggaaaggcuccacacccuacagggcuggugaugcggugaggcuggggcccagggccggggagggcugcucuagagcugacagccgcacuccagccucaccggcagcccugccuccuccacccuccccugcagggcaucuucgucucccgcauugccgagggcggugcugcucaccgcgcgggcacacugcagguuggcgaccgcguccucucugugaguggggauggggccccgccccacccacccauccccccugccccgccccgcgcccucuguccccuucugcccuugggccucccugauucgggcacgcucucacagauuaauggaguggacgugacugaggccaggcaugaccacgccgucucccugcugaccgcugccucccccaccaucgcccugcuguuggagcgggaggcugggggcccucuuccucccagcccucugccacauuccucaccccccaccgcugcuguugccaccaccagcauaaccacugccacccccggggugccuggguugccgagccuggcccccagccugcuggcugccgcguuggaagggccauacccaguggaggugagacacaagcccccacccaggcacccacccagcuucagcugugggcacuggccuucccaggaccugcucucuuauggccuugcggcccacuccaggugggaagccggccugcucgcccuuuccccugcagcuccuugaggcuggggcucugccccacagccagacuccucaguaugguccccuugacacagucuccuggcuggccacauggccacagucagcgaggauauuguccucacgcugcgugccugccugggcagcagaacacugguggcgcagaaauccccgugggcauuagggcagcccccgcccgccauccccaaggaccgggacggacucuugggagcccucccacacccuuucccuguccugaccgaggccuguccuugucccgcccuaaauccccaggagauccgucugccaagagcugggggcccucuggggcuuaguauugucggaggcuccgaccauuccagccacccguuugguguccaggagccugguguguucaucuccaagguagggcggcccauccaggcgguucugugagaggugcacccaucccagguaccagcgcaggucagcgcggccucagccaccagcugccacccuccucccugacaggugcucccgcggggccuggccgcucgcagcggccugcggguuggggaccgcauccuggcagugaacgggcaagacgugcgggaugccacgcaccaagaagcagucagugcccugcuccggcccugccuggagcugucgcugcuggugcggagggacccggcacccccgggccuacgggaacugugcauccagaaggcaccuggggagaggcugggcaucagcauccgcgggggugccaggggccacgcuggcaacccccgcgaccccacagacgagggcaucuucaucuccaaggugagccccccccaccccagcccgcccugggccccaccccccaacaggucucucccauaccacgucuccccacaggugagccccacgggggcagccgggcgcgacggucggcugcguguggguuugcggcuguuggaggugaaccagcagagccugcugggccugacgcacggcgaggcggugcagcugcuccgcagugugggcgacacccucaccgugcuggucugugacggcuuugaggccagcaccgacgcagcccuggagguuagcgaucccgccccggggaccgggccucccucuggcccagcccaagguguugugagccgcugacaccucucggggcaggcgacggguccccugugccucugggucugggcggugcucugcggcucugcaucagccgugcgggcuggggagcugugggcggagggcccugccuucccuuucugcugagcuccggcucaucgagcuguccagaggcccaguccaaguaggacgaggcacgugaacggauggugggaggggcguguguuugggacgcacuacguggucugguccuaaaagaagcugagcacuggugacuccugcagagucccaucaggcugcuaagggaugacuccaagcccugcccaaagcccaccagccaggcagacgccuugggaugcugaggguccccgcuccugugccuaguggcaccuugcuccucucagcccaucccugggccaugacuccagggagccccucuggugaccccucaacagagaacucccuacccaagaucuccugcccaacugcugguccgucccuuccuggacuccagagcagaagcccagacggggaguugggaugcgagguggggccccaggaguccuccccaccagcacggccuggauccuggacaagccuggccugucucagggggcucccaucucccuuccgucuucuuccccaugccaucccaggggcccugcagcaggccucagcaguuuccagggguucuucacuggcgccagggugugcaggcuggcuucccacuggaguggccugcagggccacaagagggugggucccgggagggccagcgcccauggcugaagcuggguggaugccugggccuucaccuggaggggccaucugcuccucccagagggugucccugcuggucacacagguccacagggggcagguggcugucaccacuccccaccggcacacagauggcuuccucucuguaacagccucugggaugcggcggccccucacauugguucuguccugcaagggaucucugggaugguggcuuucugccaggcugacagucacagaguguccugacccacagccagcgugggggccccuuggcgggaagugggucugcauucguuguuuuugcuccacagcuggacguugagcuugggguuggccccgggccagcccucacccaccggguccccuccuguccuugagggaguccuggugguuucuggggaaggauuuaucugaggacucgagcucuggaccaucugguucucagagagggccuugccuuuuauuauuuuaaauguguaucuaaacacguuucauucgauauauuuacucgugaaguuuuuauuagagagggagcgagcucccucagggaagagcuagguaugcagaaggcagggcuagugccaugucugcagccggcgugccgcgcugcugucggccacagguuguccuugcaucuggccgggucccccacgagccugccgugacaugucgguauaggaggggcaggggucucagaccucacacucuggccagccacggacagagccaccuccacacccucccugguguugggggcagauaccauuucugccgcgucgggcaagccaggggucccgagcaguggggcugagagcugccauccagcuccccuuccccgucacugcuaccucuuucccauguccuuccgucuucccgggggcucgcuguccgccccagcacugcccuugcucuccguugucacccuggcuuccguccagcagccugguugcucaucuuuguucuguggguacagguguguuuuucugcagcgguugcuuaucuuuuccuuuaaaaaaaugggaucuuuugaguuacaaaaaucaaaauuuuuaaauuaagucuucuggguucuuuaugacuucuggauucugguuuuuuccuugggaagaucuucccuacugcaagauuacaaaaacauugucauguuuucuucuaguauuucuggaaguuuaaacaacacauagcuccaugguccaccuggaauugcuuugaugaggucucgcuugucgccuaggcuggaguguggugacacaaucacagcucacugcagccuccgccuccugcgcucaagccauguccccaugcccagcccuggaacugcuuugcaaguaacuggaugcauagcuguccccacaguacugacugaacagucugucgcuuccccagugauuugggggaaauguggccucauuguguucaguuccuguaggcuccaagcccuguuucuggacuuggucccagugaguugugagcuacuucugggccaaugccacgcauuuaaaucccucacuuuguagcagguuucaugccuaauccuaaugggcaaagucacccacuccuuuuucuugucuugaaaaguuucuauugucaauguguuuucucuuacgaaugaaccugccaaguucugugcagaaaccgacuggaauucugggauuucacguacguguauguauguacauauuuugagaaagggucucgcucugucgcccaggcuggaguagcggcacagucgcugcacgccgcaggcucgcccugccgggcucaagcgauccucccaccucagccucccgaguagcugggacuacagcugcgccaccacacccggcucauuguuuuaaaguuuucuguagaaacgggguuuugucauguuaccuaggcuggucuucagcuccugggcucaagugaccugccugccuuggccucucaaagugcuaggcuuccaggcgugagcccugcgcccagccuugggguuaucuuuaugucgagcuuuucucuagggugucccccgguggcucuugcuuuccuaguaauucuuauaaauccucaccuggauuuguaaaucugcuucacccccuggcagaagccuggccgcccuucccccuucgggccucucccuuguccccucccgcagagccccugguccuguggaggugggcuugucuugugcucagcucugagggacuuucaucuuguacugugacguuugcuguagacucucuuacaacauuuuuuaaauggagggggggcuguuucuauuuauaaccuguaagaauuguuaucugaagcggguguugaguuuucugaaguccucuuaucugcuaaguaggguugguucagcccauggagguuucaucagcgggcuuggggcuugagagagaggagcuggggucucacacaucaggaguccacgccaugucuggcuuccuggcuucucacagaaagcucagaggacguggcacggccaggccggugcucccacagguccaucuguguuucugacuccagagcaugggugggguggggggggggcuucaauucaugacccuuccccauuuuucugaaacucaggccacuggacucaucugugucugucugccuggcccugugggcaucgguuugcccacuggguucuguaacuuucuucucacugugcgagcccaucuuggcauuggcucaggagcugccugcaugucccuagcacucuggagcaguggcccguguuugucugucagagccuacgucuccugcuuucuacggcccacgucugucugucagagccuacgucuccugcuuucuaggacuggugcauuuuuaggggucgugcacaguccaucuaagccuggcccucacuugcugucgggccuugacuuuacuccucagucuccucgucuguacaaugggucacccgcagugccugcuucucggggucgagaggauugauucaguaacgaccugccucgccauggucggcgccgaccccugcgcaaaccuaggugggugugcgcugucugagagacucgcccgcuaccccgcguguuuggcaugaggacgcaaguccucucccacugggccccuccucugcggccaccucccccucggcccugcuguccgcauccucuuccuccuggucacgcugaccaggguccuguguguugaugggcuugucagagccagcuucugacuacuggucaggaccaccucucccuugucaucaucaccauuaaaaauuaaacuucagaagagacugcccuuucuuuuggcauuuccucgauuuacgcucucaggaagaauccuucagucuuucccucugcaucucuggcuguuaacuuuucuguagauaugucuguaaagaagagaucacuagcucuguuucuguccugaugugagcuccugcaggaaagaccuaggaagaugaaaugcuugguucuuccauuuguuaguuuuuagaauaacaggcuggggcccuggaaucuuccaaaggugguuccugaggugucuuucuguuuuuaggguuuucgugaacuuaugagucuuuauuuuccugauggguuucaacacagcguucccuugaugucccuugaucaggcagcgagaccccgcaucccuguggcaugaccccaucauuccccagcugcuuugacagggcauucuuuguacuuccugccccggcccuggauuccaacauuuuugugugggaccuggccccucucggugggagcuggguguggggcuccuauaaccaugggccaggcgugcucaggacucaggcacugccuuugcugcucuguggccucugcagcagauggaggcugagagguggauguuuucagaaagagaacaaauccugaguuuguacuguuacauuuaacucauuuaagauuguaggguuuuuacuaacuuuuguaauuuuauacuuuuucucauaaaaucuuuccuuaauuccuuaauuucaaaauuaacugagugugguggcacauggccuguagucgcagguauucaggaggcugaaacaggaggaucgcucgagcccaggaauuugaguccagccugagcaagacagacucuaaaaaacaaaaacagugacaccacugguacaacugagagcaggagcguggagaggggccgaguucuggcggcugcuuccugaggguucacccugccugggacguacaguccgcauccuguguucucagccacuugagaucauucugugguuuugcuaccaagcugauaacacaguugggcugacucauuuuagcuuuuaggguaacuuuuuaaaaaucuguuuuuuguuuuuuuuuugagacggagucucacucuguuucccaagcugaagugcaguggcacgaucucagcucauugcaaccuccaccucccggguucaagcgauucuccugccucagccucccgaguagcugggauuacaggcgucugccaccgaaaaaaucuguuucuuaauuguguaaaucuucacgugguuccaaaguugaaguuauauagaaucauuucagaagaccggccuccaucucucugcucccagacuaccaucuuuauuaguuuugguuuauucugccauuuguuucucuuugaaaaauguaagcacauacauaaaugaauuuuaaacuuagagaaaaguugcaaaaacaggacaaagaaccucugacacucagcccuauucauggcucacccacugcgccggggacgugcuccgucguggaagggcgcggcccgaucccuguggggcuuggccaccgcaucccucuagucuccuucggucggagcgugccucugucuuugcugauuucucugaccuugacgcuucugcugggcguaggcccugccugcagugacugcccccacgcugggucugauguccucacaggcuucagcgugugcaucuuggccgggauuaucauggagcuaccacgugucugugugccuaccaccagggcucacuggugaugcucugaaccguggggucagccagguuucccccugcaguuacuccugccccuugaaaucagcaagugaggaaggugcuuugagagcauauaauaggcuguuucucauccagcuucgccugugagccucagcaccuugaugguucugagcgggccccgaggugguuggcgacauuccugacccaccacugccauacucaucaggcagcuuccugccaccgagccuucccuucucccaguuuaugugugucugcuuaccuguucacgugggcucacaagggaguccauuucauuaacaagugagcuuccauuuuauuucaugggcgacagccuuuuaccaucguaauuuauuuugaggcucaaauugucccagccuuggcccacggaaggggcuugaggaccugaggcauucugacacgaccuccccucucucagcagccccucaccuucugccuccaggaugugcugggcuucucuccauacccugcccagcccuggaguugccccuuucucucaggagcgcuggauccuuuuaguggagagugacauuuagaagcuguggucuggcccuggacccagcguucuuggggugucaucucgggaccuccugggggccagagcuggaggguaugccggucauucccaagguuauucuuggaacaguagaagagggugagcuccuaguggcugucggagucagcacccgggucugccuuuucuguguuugaacagcucucucugacaugagaggccgggcuaccugggaccuugcuucccacucugccaggaccccugccucucuuggaccugcccaguggcuuuuugacuuguuauuucagaaacugagaagacaggcaccuuguuuguuguuugucccgcuaguccugugagucugaaagagacguagcuaagucugccuguguaacugugcuuuuacgacacucgcguuucuagucuuugcuuucuguguuuagcugcuuccuuguugagcgcuuacaguugaugacuguaucaucguuguaaacagcaucuucuguggugacggcauccgucugccugcucgacagcucugaacucacacccuuucucccccggccugagcagccccucccugugccucccguguguuugccuggcaucucuuugccugccccuuacuuaccauuucagcuguguuuuuaaccaacaguacagggcuggguuugucccugaggccacacugagagcuccucgauuuugcagggaccccgucugugaugagggcggugagcaaugccuguguccacugugcugccuccuccgcugcuucuggcugcugcuggggguggagguuugaagcagucccguugcccgccgcaggcuuggaagucagcucuucccaugguucccucugcccguguuaaccccaggcucgggauucaaguacaucuugugcccaaccagaagccccugccuguccuggcccugucuccucgccccccucugcccugccugagcuaucugagugccuuuccuuucuagacgcccccuccgcccugccagucucuggcuugggacaggugauugagcucuggggagugcagagcuggccgggccuccugcauggugucccuuguuucagaaucccugcccagcacucacacuggggucuggagccagccuuuccacccgagggggccguucugccccaucaguuccagugccugcuacucacgccccuccuucccccaucuugguggcugucagcucuuccuggggaugacuuuacacagucagcagaguggcaggcaucaugcuacuucacagucuugccuagugcagacgugaccacguccacggcagcccugugagcugugauggggaccggccggggacagugcugcagcguccuggggggcccagcggagugcccuccaaggcugccccagccacgcggucagcccugcccagggacgcggcuccugggcucaccguugcugacuauucugggcugggaccccagccugccccagaggugggaccccggguugcaguccccccuucuuagcccacaccccucuucucagguguccccaggugucauugccaaccccuuugcggcaggcaucggccaccggaacagccuggagagcaucucuuccaucgaccgggagcugagcccugagggcccaggcaaggucagaggugccugcagccggcagccccagggccagggagcccgaggccgguggugccugacgggucugcucugcucugcucacaggagaaggagcugccuggacagacccugcacugggggcccgaggccacagaagccgcagugaguguggucgccccacccccucacaucagggcacuggagcggggugcacauugccuguggggugcuggguaguaacccccaggacccccucuccugcccugugcuggccgggugcugccacggagcuaccccugcuagugcuguguucacucugcccccagggucggggucugcagccccugaagcuggacuaccgcgcccuggccgccgugcccagcgcuggcagcgugcagagggugagugcccagugugcagugccccccaccuccguccuguuguccuguucaucggccaccccaggacaaacgccagggccauccgggagggaaccuuugggcgggggcuggggugggaggaggccacgucugaccugcaggcuaccccagccuggcacaugcuuaucacccucauucucaacccaagccauguuggugcugccccacccacacacccugagcugcggaugggugacacaggccgaggcaucccucuaguggcggugcgagagcuucaccugcugcugcuggggcugcccagccccagagggugcgagugggggcagaggcuccugggggauugggcaggcacauguccccaaggggaggacaggcuggagcagcuggaggggcgggugcuggggacaggcaggaggaugugcaggcccaucccuccccuuagagauacaaauaacccucccagagggugcgccccaccagccccaccgaacgugagugccgagggguggcuccugcaggcccuugcccaagcgguggggugguggugaggggccaggcagggccuggaucugaggcagcgcauucgggggcucuuggguacugacccugccuccucuggccaugggcagcgccaagagggaggcuuccgggaggcccuucauccucaugaacaacagcacagucaugggggcagcagucagggcgccacugagcccugagggcugcacaccacaaguaggggcuccccaccaucaccucugucucuggccccucccccgagcccucccugcucucuucuccggcuguccugucugcucccaucucuccugcaaagcuccagccagcacacugccauggagacagcagcugcccagcccaggcccccgcauccugugggaacggggacgagccccuccgugcugaccgagugucuggggcauccccugggcuauagucagguuggggaacugaagagcugcuguggcuuuuaggcaagccccagggcccccagucccuccuggucgggggccacagcccugcccauccucaccccacccacugccuacuccuccagguaccgucuggagcagcuggagggaagauggcugaaucucccugcuccccuaguggccagcaggugagugucccaaguuaacgggugugccccaugguggguggagggcagggcagauggccgcugugcacagggccccuccuccagggauggggggucaggggccaucguggggugcuguugacuccgguuuucccucugcuaccauggggccuccugugugaggaaggccagggacgcuuuccuggccagagcugccuggcgaugggguggggggccugagugugcuguuccuggaggggcucaagcuccugagaccccagucagugucucaggcccaacaccucccagggcccaccuuaucccugccugccuuuugucuggggguccuugcccccccacuguuggcaccucccaacacacugccacguggggguggagguggcagcccccaugagacccagccccagcucagccccucacaggcaagaugucagccccacccagguuggucggucucucucucucugucucucccaccccccucucuacccccgucccuugccuuaaaccccugauccugcucuccucugcccccgccgcccccaccugccuuuuuuagacaaaaccaggggugauccagccauuggcucaggccuggccaaggggcuccccagcccccaggggcagagguuguccccacuccgugagugcucugucccguggguggggguggcagagccuccuuccccagcaggaugguggguggggaucaaaggcaggcggggggacaggcggggggacagccgguggugaguugcacacagcugcagccccgacagcugccccagcauagcucacaagagccccaccccccagccgcccuccccgccuucuccggaugagcugcccgccaaugugaagcaggccuacagggccuucgcggccgugcccacuucucacccgccugaggaugccccugcccaggugugugggggcagcacgccucccugcugcgcgugguuggggugggugcccgggggccccaguaucucggaggaaugccagccaaaccucaagguccgcuccccccagccccccacgccugggccugcagccuccccggagcagcuguccuuccgggagcggcagaaguacuuugagcuggaggugcgcgugccccaggccgagggccccccuaagcgcgugucccuggugggugcugacgaccugcggaagaugcaggaggaggaaggugaggggcacggaagugggguggggguugggucucggcuggucuggccugacccacccugcccuccggcagccagaaaacuacagcagaagagagcgcagaugcugcgggaggcggcagaggcuggggccgaagcgaggcucgcccuggacggggagacgcugggcgaggaggaacaggaggaugagcagccacccugggccagcccgagccccaccucaaggugagcacccgcccaccagacgcccccuacucaccccacgugccccugccccccacagcacguccugucccuuccccaggcagagcccggcgucccccccaccccugggagguggcgccccggugcggacggccaaagcugaacggcgccaccaggagcggcugcgcgugcagaguccggagccaccggcacccgagcgugcccuguccccugccgagcuccgggcccuggaggccgagaagcgugcgcuguggagggcagccaggugagccccuguguggggucgccaccccgcccugcugccugucccugcuccugccccaagucaccccugcccgcuguucucugcaggaugaagucauuggaacaggacgcucuccgagcacagaugguccucagcaggucccaggaaggccggggcacgcgggggccccuggagcgacuggccgaggccccuuccccugcgcccaccccgucgcccaccccuguggaaggucugugggucagggcaggucgggggggucagccugccgcaugggcugcuuccaaugcccgcuucuuguccccccagaccucggcccccagaccagcaccuccccgggacgccuggugaggagccgguggcuaugccuucccuucacccccgaggcauggggguggggucuggccugcccccacccccguggcccucaucccccccuuuccucucacucucugccucuccccucacgcuguccuuucaagcccuugucuggaaagaaguuugacuacagggccuuugcggcccugccuucuuccagaccugucuaugacauccagguaccuggccuccaggccucugcaugccugccacccuguccgugccugccaccgcccccauccgcucccgcagggccuccccacgcucugccguggcccugccucuucacccccccucccccuucagccgggcucugugggccucagggcugggagcccacccguccaccugggugguuuggggcagggcuggcaccggccugaccaacacucuccccaucacagucaccggacuuugcugaggaguugaggucccuggaaccaucucccagcccuggugaguuggggccgggcuggggugagcucccaggagcccagcugcccucagcucacugcccaccugucccugcccuccaggcccgcaggaggaggauggagaaguggcucuggugcuucugggcaggcccucacccggcgcugugggcccugaagauguggcacugugcagcagccgccgccccguaaggccugggcgccguggccugggcccugugcccuccuagaggagcaggcaccucccccagacuuggggugggggcccugccagcuccagcaccacccuugccccaagucuuuuaaccuggguguuagcauuuuaaagagaccccacaggaguucuggccugugacuaacuaacugccccaccccagccgagaccucggcgagacuguaacuagugauguuuguacaaccaaagacucuauuuugugguuuaaggagaauaaaguugacuacauuuuaccuccc

SEQ ID NO: 17821 - RNA, 4371 nt, Homo sapiens
ccccuuuccagucuuugcugucccuucccggccccuuuggggccgcggcauguggucuugcugcuggguuugugagucccagccuucccccgcugcaggucauccagaugcagugcaaccuggagagaagcgaggacaaggcgcgcuggcaugugagcggggccugggagggcggcgcugccguggggaaggcgggagcguggcggagcccugaacccccagccgaccacgccccgccgccuccccagcucacucugcuucuggugcuggaagaccggcugcaccggcagcugaccuacgaccugcucccaaguaggcugggcaggggacuugggcggcgggcggugaccccaggcggcgggugggcagcggccucaugccucgccuuacgccauugccucagcggacagcgcccaggaccucgccucggagcucgugcacuauggcuuccuccacgaggugcgcugggcggugcggcgcggccuggcggagggggcgcacggggcaggccgcgccccuccgucccccaugccucccuccuuccgcaggacgaccggaugaagcuggccgccuuccuggagagcaccuuccucaaguaccgugggacccaggccugacccggagccccagccccaggggaccaugccggggugcugccugggcaggccauguuggggagacuccagcaccguggggcugcccuccuccaugcgccugggagcacaaaggccccgguagugaaggaaccccccgucuccugagaguggggcugacccugccuugggcgccgagggguuggggggugggugugggggagccguuaggccucccagguccuuaggaucaggguugcccccagaaccccuucccauauccuccauucuccgcccugaguuccuacccaggcugccuggccggggccacugccuccucagcaugcaggaggcugcccuguagggaaccccagcucuggggcuugggggugagggucagcccuggacagaccucugcccagggaacugcuccauggggucugggagagcagccauccccugcuggcaccauagacccacacaaggagccugcacagcaagccagcggugacacaccugcaggugucaggcauggcacugggcacaacagggaccuggcaggagaaacagaccacagagaggucuggaguugaggcuguugucagcaaagccccuggucccacacagcucugcccuagagccaccucuuugacccuuuacccacccugagaccagaacuugcagccccucugcagaucuccucuggccacugcagccccuccaaugggcuuuuucucucaugcauucccuggccuggaggcgucagggaccccacauccucccugcuccucagacucacagccccuccauguuaccucccgcaccuccucccuggggcagcugcucccugggccucugaggaugucagcuccuggcucccugccucucucccacuccacuccuggcucagucuuagagauuucuaugcccucauggauucuaccccugccuuccuggccucuugauucuuggcuugccucuccuccaauuccaaacuuagugaaauggccuuaagcauuuuaaacuguauguauacauuagcgcauucaugccuuucuaaacgcauuucaaaugucaaccaggaaggcacaccacuguauuaguuuuauacugccgcuguaaaauuuaccacaaacuuagugacuuaacacaaauuuauugcaauucuguaggcuggaagucugacuaugggucucacuggacuagaaucaaggcuggcaggcugccuuccuuccuggagguucuaggggagacucugucuccugcuccuucaggcugcuggcagaauccacauccuuucgguggcagggccaagguccccacuuucuugcugacuguaaacuaaggccacuuccagcuuguagaggcugccuacauuccuuggcucuuggcccccuccuccaucuucagagcuagcagguucagucugugucacgaaccauuucucugguucccugcagacaggaaagguugucccuaaggacucaugagauuagguugggcccagccagauaauacaugauaaucucccuccucaagguuuuuaauauuaaacacaucugcaggacacauuuugccauguaaacuaacauucacugguuccagggauuaaggaaugaaccucuuuuguuggggaaggguggcauucugcugaccacagcacuccaaccaaaagccaaaaaccaaagcaagacuuacuaacgcauaucaaauaaauuaaagguacaaaaucgugaaucucaguuaucuuaaauauuccaauacuauuuacaaaauuauucaaauucucacgccuuccaacucaaaauuagcaaucuaaaguaauuuccauauccuagauggaaacccucaugcuaaacugucugauuaugcaugguucuaaaugguuucaguggcaaauacauaacauuguacuacugauuaaacugaacuuaaaagcaucaauaccaccauugcugcacuuaaucaugucucuguugaauuuuuccuuuuaaauuuuaucuuuucagaauuauauauguauuguuuuuaaaguagaauaguuuuuuuuuugaggccaauaauaaauaauaaaugcaggcuccuacucugauccucuccaaauucaacucucuuaacuguuucuucaggcauuugaaauccauguuuuucaaaaccaugagcaugcuuuuaguccuguuuauucguuuuucuacauuagaugucccuggcuggcauccucugggaggagggcggucaccugccucagucuccuggcggcaucauuccaguguuacgggcaucauagcugcauggguguuauuacagcuucauuaccacacgucucaggagagaacacgguguucuaggauggcauuucuugcacaacuuuuuguuuucccuggaguuaauaauugccuuuuuuuugguuugccuaguuuucuauauguguuugucauugauucaucuuuagacuuuccugaagaagcaugagcauccugucacagcuuaggacucaucacauaacugacugcucaguuucuucuuuuccuggagcccccaccauacaagcccccugcccaggcuacuuguucuuggacuuacagcccaguggucagcauggguuaacucuucaccaguguccuguacugcuuuccucuuccuucauuugcccuguuugagaaggaccauccuccagguuuccugagagggugcauaggaaguuguggagucuuuaccuguuugucuuuguagggguggguugccccuccacaccuguggguguuucucguaagguggaacaagagacuuaggaaagaaaaagacacagagacaaaaguauagagaaagaaauaaggggacccggggaaccagcguucagcauauggaggaucccgccagccucugaguucccuuaguauuuauugaucauuuguggguguuucucgaagagggggaugugucagggucacaagacaauaguggggagagggucagcagacaaacacgugaacaaaggucuuugcaucauagacaauguaaacgauuaagugcugugcuuuuagauaugcauacacauaaacaucucaaugcuuuacaaagcaguauugcugcccgcaggucccaccuccagcccuaaggcgguuuuucccuaucucaguagauggagcaugcaaucagguuuuauauggagacauuccauugcccagggacgggcaggagacagaugccuuccucuugucucaacugcaagaggcauuccuuccucuuuuacuaauccuccucagcacagacccuuuacgggugucgggcugggggacggucaggucuuucccaucccacgaggccauauuucagacuaucacauggggagaaaccuuggacaauaccuggcuuuccuaggcagaggucccugcggccuuccgcaguuuuugugucccuggguacuugagauuagggaguggugaugacucuuaaggagcaugcugccuucaagcaucuguuuaacaaagcacaucuugcaccgcccuuaauccauucaacucugaguugacacagcacauguuucagagagcacgggguuggggguaaggucauagauuaacagagucucaaggcagaagaauuuuccuuaguacaaaacaaaauggagucuccuaugucuacuacuuucuacacagacacaguaacaaucugaucucucuugcuuuuccccacagucuuuaugcuaaccucacauaugcuuaacagugcgacuagcuacaaaaagcuuggcuugguugaaaaucauuuauuccca

SEQ ID NO: 17822 - RNA, 8014 nt, Homo sapiens
uugaugcuuuuaaguucaguuuaaucaguaguacaauguuauguauuugccacugaaaccauuuagaaccaugcauaaucagacaguuuagcaugaggguuuccaucuaggauauggaaauuacuuuagauugcuaauuuugaguuggaaggcgugagaauuugaauaauuuuguaaauaguauuggaauauuuaagauaacugagauucacgauuuuguaccuuuaauuuauuugauaugcguuaguaagucuugcuuugguuuuuggcuuuugguuggagugcuguggucagcagaaugccacccuuccccaacaaaagagguucauuccuuaaucccuggaaccagugaauguuaguuuacauggcaaaauguguccugcagauguguuuaauauuaaaaaccuugaggagggagauuaucauguauuaucuggcugggcccaaccuaaucucaugaguccuuagggacaaccuuuccugucugcagggaaccagagaaaugguucgugacacagacugaaccugcuagcucugaagauggaggagggggccaagagccaaggaauguaggcagccucuacaagcuggaaguggccuuaguuuacagucagcaagaaaguggggaccuuggcccugccaccgaaaggauguggauucugccagcagccugaaggagcaggagacagagucuccccuagaaccuccaggaaggaaggcagccugccagccuugauucuaguccagugagacccauagucagacuuccagccuacagaauugcaauaaauuuguguuaagucacuaaguuugugguaaauuuuacagcggcaguauaaaacuaauacaguggugugccuuccugguugacauuugaaaugcguuuagaaaggcaugaaugcgcuaauguauacauacaguuuaaaaugcuuaaggccauuucacuaaguuuggaauuggaggagaggcaagccaagaaucaagaggccaggaaggcagggguagaauccaugagggcauagaaaucucuaagacugagccaggaguggagugggagagaggcagggagccaggagcugacauccucagaggcccagggagcagcugccccagggaggaggugcgggagguaacauggaggggcugugagucugaggagcagggaggauguggggucccugacgccuccaggccagggaaugcaugagagaaaaagcccauuggaggggcugcaguggccagaggagaucugcagaggggcugcaaguucuggucucaggguggguaaagggucaaagagguggcucuagggcagagcugugugggaccaggggcuuugcugacaacagccucaacuccagaccucucuguggucuguuucuccugccaggucccuguugugcccagugccaugccugacaccugcaggugugucaccgcuggcuugcugugcaggcuccuugugugggucuauggugccagcaggggauggcugcucucccagaccccauggagcaguucccugggcagaggucuguccagggcugacccucacccccaagccccagagcugggguucccuacagggcagccuccugcaugcugaggaggcaguggccccggccaggcagccuggguaggaacucagggcggagaauggaggauaugggaagggguucugggggcaacccugauccuaaggaccugggaggccuaacggcucccccacacccaccccccaaccccucggcgcccaaggcagggucagccccacucucaggagacgggggguuccuucacuaccggggccuuugugcucccaggcgcauggaggagggcagccccacggugcuggagucuccccaacauggccugcccaggcagcaccccggcaugguccccuggggcuggggcuccgggucaggccugggucccacgguacuugaggaaggugcucuccaggaaggcggccagcuucauccggucguccugcggaaggagggaggcaugggggacggaggggcgcggccugccccgugcgcccccuccgccaggccgcgccgcaccgcccagcgcaccucguggaggaagccauagugcacgagcuccgaggcgagguccugggcgcuguccgcugaggcaauggcguaaggcgaggcaugaggccgcugcccacccgccgccuggggucaccgcccgccgcccaaguccccugcccagccuacuugggagcaggucguaggucagcugccggugcagccggucuuccagcaccagaagcagagugagcuggggaggcggcggggcguggucggcuggggguucagggcuccgccacgcucccgccuuccccacggcagcgccgcccucccaggccccgcucacaugccagcgcgccuuguccucgcuucucuccagguugcacugcaucuggaugaccugcagcgggggaaggcugggacucacaaacccagcagcaagaccacaugccgcggccccaaaggggccgggaagggacagcaaagacuggaaaggggggaaucucuaagaggagcccaucucacugcuaguggcuuggcaagcuaaggaaagcuucgagaagagucgacauuaggggcuggguacugaaggcugaauaggagcuuucaccgcggagagaacaacuugaacaaagagggaacugugggcguggggaaagggagguugggcgggacaggaccgcgccgaagugcacggugccugcgggaucaggccucccagagccugggcgucagcugaggacucccaugaucucugcuggcagccaggagcaggcaguuugccuguuaggacaugaauucuggcugcacugcaccgagagaggccccuggccaggagggggugcugcaggaaaagucuggggagacaccaggacauagauguccgggaaucagcaccaggugggggaugggagggguggggggggggugggaggggugcgggggugggggaagauugcuggcaggguggaagagcccgggugaguucuggaggaaggaugcuuggaguagguucagggcaggcagcaggaugcaggggaaggaucugaggggacagggagccucccggaaaaggagagugcccagccuguccuauaacccccaugacccccacaagggggucagccuggaucuggucucuggcagccaggaggagagcugggcuguggggaugcaggcccuaagagaaggaggggcaccucuuaucuggcuguuagaaggucugagggauggcacugagcagcaggagaggggacucaccuuucuggucucagagucaaagggcucuggcgucggggucuuggccuuuuggaccuccuccggggguggggccagcacacggggcagccccaggggucgaguggcugcaaaguucaucaguggguagauuccauuccuggggacacaacaggguggcuggggguucaggccugacagcugccuggcccccaaccuuacaucaguucucaccugacauccuccaggaauuuguccagcuccaugaaggagacuuccgaguaccuggcauggaagugggaggcacaugaggggcuggccggggcgaggggaggggaggugcggggaggggagguguggggaggggaggcuucugggugcugacugcucaccgccacugcagcgggggccugcggggccggggaagcuccgccaagaccgcgugcagguccauggccuuggucuucuccuccaccacauucucaggcaugaggucugcggccacaagagcaucaaggcggugugcucaggccguggguccugcagggccccuuccacgucccaaccuccaccuccccagccaccccccgggccggccugcugcucacacuggugcuggaugaagcagugggcugccaggagcuucagcgagugcaccucgaagagcacgcgguggaagaggaggcugugggcagagggccggcgggcagggucccgggccaggcagcaaaggaugaacuccuggggcacagggaggagaggcugguggugugcaagggcucucugcucuggccccgcaguucgaggagagguggccccugaguuccccaugucccuccucagggacacacaggacaugcagggaugcccauagggaggagucccagcagcagcagccaggccaggaccugguccucugagcuugaggacagcuggguucugggauuggagcaccaugcucugcuucccucgacccccaaaaaaucguggggagaagccaugauccuaaagucacaccugcaagccuccuacccauggccuuuugaucggcucagcucgggcccaacacuggagacgaccuugauggguccccacucuguccacauccgugcccagcccggcuccagcucgccaccagccccgaccaggcacccccaucuccugaggccauggaguuaagucuagacuccgagcagagggggcuguggaugcagcuuccaucccauaccucuuuuugccugcuuggcacccaccauguccccccacaagcuggagccucaucaccuccuggaagcuuaaagucaaggacuuggagugaagcagacccaggugcagauguuggcuccaccacucacucuaaagccuugggcaaaggacucaucuccucugaaccuugguuucuuuauaaaacgggcauggugauggcagccacagagggagggucucucuugccuucuuguccuuagaaugugcugaccccuuagggccuucaggccuggaaccaguaugugcucccacugagguccucuuugggaggggugcagucagcugguauaccccucaacugcacaaacugugauguucucccaggucugccuggagcaccuugcuagcccuagcugagcacggugagccagcuggggaggggcagggcaagcugcuuacccgcauguuggggucacucagcgagugccuggcgcgagcaauggccuccucugugacccggguguccccauuggucuggauuuccaguacagccaucuggggcacagagccaggucaggcauggggaagggaccacacaggugagccaggcagggcacaguuaggaggagggcagagcacaagguggagggcgggggcaguaccuccagcgcacacaucccaaaggagaagauguccacagcggucccaucggccaccucugaacagaagagagcacaggacacguaggagagaagcgcaggguaggcacggggcacccggacccagcaccacucaccuccauacucuggggggaagaagugcagguuccgaaguuccucucgcucagcgcggauggggcuucggagaucaucuggaagugcugugggagggcgcagagcugagcgggcggggaccucuccaggaccccguccccccaaaguccgcacuuaccauuggagaagauucggugccacacugccaaggggcgggagaaagaguggaguuagcugcuggggcaucagaacuccucugcccuuggcuccaggcaccuuccccugccccguucccccacccagcccugccccgccagcaccggagccgaucuugaugaggccguugugcugaaugaagauggugucgcuggucagguucccguggaugauuggggggcugcaggcgugcaggaagcugcagacguuggggaggggagaguaggaggagccggucaggaggcucuggagagaugggggcucgguggcgccgcgcccaggccagcccaggcccucaccugagcgcagacaggaucugcgugcaccagcgcuuccaggccuggcggcggacgcacgacuccgucggucgggugggcgcaggagaggcggcugggccugcggagcccgccccgcauccucgcccagccccuguccgaggccgccgggcacccccucaccaucccaguccccgaggcugccccaaccccguccuguccccguggcugccccagcccgcuccccauacccgggcguucauggccuugugguucuucuuggucuuuuugaggaauugcuugaggcugccugaugacacguacucugugaugaagaugaccugcacggugcgagcucaggauuuccaccagcugcggguucguccccaugcccgccccaccuagcuguggucucugccugcccggggccuugcccgugcucacccucgcgcaggccucagagguauccagccaguacuugugcaacuucacgauguucgggugguccaccagcaccagcugcucgaacacggucuggaucuucuccuggggagggaggguggucgcuggguggucagcagguggucacccaagcaggaugaggagggggcagcggucucaccucgugcgccgcgaaggccuuccugucuccgaaguggagcucguuccacaccaccucuacccccuccuccguguccauggcuaggaaggugcucugaagcccuggcauguucccuugguuuaccugggggugaauaaaggguuaugugugcccuggugugugucaggguugugggugaggauuuggucccuguccacaccuuuccagugggcccaagcgugggcugcaggcccugagccacucugcgggaagguggggcuuggaggguagcugcccccaggagccaagggcuccuauccaagggcugggcuaaggggauuuggagcagguuucagggggucgagggggauccccaggaagcuagcggcugaguccagaggcauggggaggugguccugggaggagacuggcccucagggagucccagggcgagcgccaggccaaagggguccagggguggcugauucgcgggccgcgaggggccgcggagagguuuccagccgccgcgcucucccagcgcccccacgccccgcgcagccuccaggccccucccgcucugggagggcggugucaccccgugccccaacccccgcgcccaccugcucccgucgcuuuugccagcgaccacacgggcuuuccuccaggaugucgcucucguccucgcucucguccucccgcucccgcucccguucccgggcccgccucggcgccggcuccggggccgccaugguucggccagcccaggccaccgcccucugcgcgauccgccgccggcgcagccucucccggcccgcccuggccucgcgcccagcagcccagccuagagccgccgcggcagccuagagccccagccccggcucugggaauugggaggcgcgggcgcgcggcggacgggcggggcccgggggcggagccggcgcgcaccucccgagccgccugugccugccggagccagagcagagcuuccccgagagcugccgagcccgggccgcgcccaggccccgcccccccggaggccccgccccgcgaagccccgccccagucccuguuuccuccucgucucccaggccugcuccgcgaagccccuccccaggcccuguccccuccucguccuccaagccuccuucgcgaagccccgccccaggacccgccccacccccgcgaauccccgccccguuuuaguccccgcccccgcccguucccaggguccuccgcgaagccccaccccaggccccgccucaccuccucgaagccccgccccuaugaggccccgccccgcgcagaggaaccgcccccaaauccccgcccccucggaggccccgcccugcggacaccuggagcccggagcgcccacuucucucgcgguugcuccccuaggaucugggggaagacccggggcaucugggggcccccaagcccacggcacccuccagcugcagaagaccccgcgggcucgaaagcgggacccgcucuccuggccacgcacucauuccccggccgacccccaagggacaggucgaaggggcaccgagggcgggggaaaggcccaccagcaggcugacccaggcugacuuugaucggugaccacgaaucucucccuggcccgcccaccagugccuccucccgcccacaagcccaucuucucac

SEQ ID NO: 17823 - RNA, 8014 nt, Homo sapiens
gugagaagaugggcuugugggcgggaggaggcacuggugggcgggccagggagagauucguggucaccgaucaaagucagccugggucagccugcuggugggccuuucccccgcccucggugccccuucgaccugucccuugggggucggccggggaaugagugcguggccaggagagcgggucccgcuuucgagcccgcggggucuucugcagcuggagggugccgugggcuugggggcccccagaugccccgggucuucccccagauccuaggggagcaaccgcgagagaagugggcgcuccgggcuccagguguccgcagggcggggccuccgagggggcggggauuugggggcgguuccucugcgcggggcggggccucauaggggcggggcuucgaggaggugaggcggggccugggguggggcuucgcggaggacccugggaacgggcgggggcggggacuaaaacggggcggggauucgcggggguggggcggguccuggggcggggcuucgcgaaggaggcuuggaggacgaggaggggacagggccuggggaggggcuucgcggagcaggccugggagacgaggaggaaacagggacuggggcggggcuucgcggggcggggccuccgggggggcggggccugggcgcggcccgggcucggcagcucucggggaagcucugcucuggcuccggcaggcacaggcggcucgggaggugcgcgccggcuccgcccccgggccccgcccguccgccgcgcgcccgcgccucccaauucccagagccggggcuggggcucuaggcugccgcggcggcucuaggcugggcugcugggcgcgaggccagggcgggccgggagaggcugcgccggcggcggaucgcgcagagggcgguggccugggcuggccgaaccauggcggccccggagccggcgccgaggcgggcccgggaacgggagcgggagcgggaggacgagagcgaggacgagagcgacauccuggaggaaagcccguguggucgcuggcaaaagcgacgggagcaggugggcgcggggguuggggcacggggugacaccgcccucccagagcgggaggggccuggaggcugcgcggggcgugggggcgcugggagagcgcggcggcuggaaaccucuccgcggccccucgcggcccgcgaaucagccaccccuggaccccuuuggccuggcgcucgcccugggacucccugagggccagucuccucccaggaccaccuccccaugccucuggacucagccgcuagcuuccuggggaucccccucgacccccugaaaccugcuccaaauccccuuagcccagcccuuggauaggagcccuuggcuccugggggcagcuacccuccaagccccaccuucccgcagaguggcucagggccugcagcccacgcuugggcccacuggaaagguguggacagggaccaaauccucacccacaacccugacacacaccagggcacacauaacccuuuauucacccccagguaaaccaagggaacaugccagggcuucagagcaccuuccuagccauggacacggaggaggggguagaggugguguggaacgagcuccacuucggagacaggaaggccuucgcggcgcacgaggugagaccgcugcccccuccucauccugcuugggugaccaccugcugaccacccagcgaccacccucccuccccaggagaagauccagaccguguucgagcagcuggugcugguggaccacccgaacaucgugaaguugcacaaguacuggcuggauaccucugaggccugcgcgagggugagcacgggcaaggccccgggcaggcagagaccacagcuagguggggcgggcauggggacgaacccgcagcugguggaaauccugagcucgcaccgugcaggucaucuucaucacagaguacgugucaucaggcagccucaagcaauuccucaaaaagaccaagaagaaccacaaggccaugaacgcccggguauggggagcgggcuggggcagccacggggacaggacgggguuggggcagccucggggacugggauggugagggggugcccggcggccucggacaggggcugggcgaggaugcggggcgggcuccgcaggcccagccgccucuccugcgcccacccgaccgacggagucgugcguccgccgccaggccuggaagcgcuggugcacgcagauccugucugcgcucaggugagggccugggcuggccugggcgcggcgccaccgagcccccaucucuccagagccuccugaccggcuccuccuacucuccccuccccaacgucugcagcuuccugcacgccugcagccccccaaucauccacgggaaccugaccagcgacaccaucuucauucagcacaacggccucaucaagaucggcuccggugcuggcggggcagggcugggugggggaacggggcaggggaaggugccuggagccaagggcagaggaguucugaugccccagcagcuaacuccacucuuucucccgccccuuggcaguguggcaccgaaucuucuccaaugguaagugcggacuuuggggggacgggguccuggagagguccccgcccgcucagcucugcgcccucccacagcacuuccagaugaucuccgaagccccauccgcgcugagcgagaggaacuucggaaccugcacuucuuccccccagaguauggaggugaguggugcuggguccgggugccccgugccuacccugcgcuucucuccuacguguccugugcucucuucuguucagagguggccgaugggaccgcuguggacaucuucuccuuugggaugugugcgcuggagguacugcccccgcccuccaccuugugcucugcccuccuccuaacugugcccugccuggcucaccuguguggucccuuccccaugccugaccuggcucugugccccagauggcuguacuggaaauccagaccaauggggacacccgggucacagaggaggccauugcucgcgccaggcacucgcugagugaccccaacaugcggguaagcagcuugcccugccccuccccagcuggcucaccgugcucagcuagggcuagcaaggugcuccaggcagaccugggagaacaucacaguuugugcaguugagggguauaccagcugacugcaccccucccaaagaggaccucagugggagcacauacugguuccaggccugaaggcccuaaggggucagcacauucuaaggacaagaaggcaagagagacccucccucuguggcugccaucaccaugcccguuuuauaaagaaaccaagguucagaggagaugaguccuuugcccaaggcuuuagagugagugguggagccaacaucugcaccugggucugcuucacuccaaguccuugacuuuaagcuuccaggaggugaugaggcuccagcuuguggggggacauggugggugccaagcaggcaaaaagagguaugggauggaagcugcauccacagcccccucugcucggagucuagacuuaacuccauggccucaggagaugggggugccuggucggggcugguggcgagcuggagccgggcugggcacggauguggacagaguggggacccaucaaggucgucuccaguguugggcccgagcugagccgaucaaaaggccauggguaggaggcuugcaggugugacuuuaggaucauggcuucuccccacgauuuuuugggggucgagggaagcagagcauggugcuccaaucccagaacccagcuguccucaagcucagaggaccagguccuggccuggcugcugcugcugggacuccucccuaugggcaucccugcauguccugugugucccugaggagggacauggggaacucaggggccaccucuccucgaacugcggggccagagcagagagcccuugcacaccaccagccucuccucccugugccccaggaguucauccuuugcugccuggcccgggacccugcccgccggcccucugcccacagccuccucuuccaccgcgugcucuucgaggugcacucgcugaagcuccuggcagcccacugcuucauccagcaccagugugagcagcaggccggcccgggggguggcuggggagguggagguugggacguggaaggggcccugcaggacccacggccugagcacaccgccuugaugcucuuguggccgcagaccucaugccugagaaugugguggaggagaagaccaaggccauggaccugcacgcggucuuggcggagcuuccccggccccgcaggcccccgcugcaguggcggugagcagucagcacccagaagccuccccuccccacaccuccccuccccgcaccuccccuccccucgccccggccagccccucaugugccucccacuuccaugccagguacucggaagucuccuucauggagcuggacaaauuccuggaggaugucaggugagaacugauguaagguugggggccaggcagcugucaggccugaacccccagccacccuguuguguccccaggaauggaaucuacccacugaugaacuuugcagccacucgaccccuggggcugccccgugugcuggccccacccccggaggagguccaaaaggccaagaccccgacgccagagcccuuugacucugagaccagaaaggugaguccccucuccugcugcucagugccaucccucagaccuucuaacagccagauaagaggugccccuccuucucuuagggccugcauccccacagcccagcucuccuccuggcugccagagaccagauccaggcugacccccuugugggggucauggggguuauaggacaggcugggcacucuccuuuuccgggaggcucccuguccccucagauccuuccccugcauccugcugccugcccugaaccuacuccaagcauccuuccuccagaacucacccgggcucuuccacccugccagcaaucuucccccacccccgcaccccucccaccccccccccaccccucccaucccccaccuggugcugauucccggacaucuauguccuggugucuccccagacuuuuccugcagcacccccuccuggccaggggccucucucggugcagugcagccagaauucauguccuaacaggcaaacugccugcuccuggcugccagcagagaucaugggaguccucagcugacgcccaggcucugggaggccugaucccgcaggcaccgugcacuucggcgcgguccugucccgcccaaccucccuuuccccacgcccacaguucccucuuuguucaaguuguucucuccgcggugaaagcuccuauucagccuucaguacccagccccuaaugucgacucuucucgaagcuuuccuuagcuugccaagccacuagcagugagaugggcuccucuuagagauuccccccuuuccagucuuugcugucccuucccggccccuuuggggccgcggcauguggucuugcugcuggguuugugagucccagccuucccccgcugcaggucauccagaugcagugcaaccuggagagaagcgaggacaaggcgcgcuggcaugugagcggggccugggagggcggcgcugccguggggaaggcgggagcguggcggagcccugaacccccagccgaccacgccccgccgccuccccagcucacucugcuucuggugcuggaagaccggcugcaccggcagcugaccuacgaccugcucccaaguaggcugggcaggggacuugggcggcgggcggugaccccaggcggcgggugggcagcggccucaugccucgccuuacgccauugccucagcggacagcgcccaggaccucgccucggagcucgugcacuauggcuuccuccacgaggugcgcugggcggugcggcgcggccuggcggagggggcgcacggggcaggccgcgccccuccgucccccaugccucccuccuuccgcaggacgaccggaugaagcuggccgccuuccuggagagcaccuuccucaaguaccgugggacccaggccugacccggagccccagccccaggggaccaugccggggugcugccugggcaggccauguuggggagacuccagcaccguggggcugcccuccuccaugcgccugggagcacaaaggccccgguagugaaggaaccccccgucuccugagaguggggcugacccugccuugggcgccgagggguuggggggugggugugggggagccguuaggccucccagguccuuaggaucaggguugcccccagaaccccuucccauauccuccauucuccgcccugaguuccuacccaggcugccuggccggggccacugccuccucagcaugcaggaggcugcccuguagggaaccccagcucuggggcuugggggugagggucagcccuggacagaccucugcccagggaacugcuccauggggucugggagagcagccauccccugcuggcaccauagacccacacaaggagccugcacagcaagccagcggugacacaccugcaggugucaggcauggcacugggcacaacagggaccuggcaggagaaacagaccacagagaggucuggaguugaggcuguugucagcaaagccccuggucccacacagcucugcccuagagccaccucuuugacccuuuacccacccugagaccagaacuugcagccccucugcagaucuccucuggccacugcagccccuccaaugggcuuuuucucucaugcauucccuggccuggaggcgucagggaccccacauccucccugcuccucagacucacagccccuccauguuaccucccgcaccuccucccuggggcagcugcucccugggccucugaggaugucagcuccuggcucccugccucucucccacuccacuccuggcucagucuuagagauuucuaugcccucauggauucuaccccugccuuccuggccucuugauucuuggcuugccucuccuccaauuccaaacuuagugaaauggccuuaagcauuuuaaacuguauguauacauuagcgcauucaugccuuucuaaacgcauuucaaaugucaaccaggaaggcacaccacuguauuaguuuuauacugccgcuguaaaauuuaccacaaacuuagugacuuaacacaaauuuauugcaauucuguaggcuggaagucugacuaugggucucacuggacuagaaucaaggcuggcaggcugccuuccuuccuggagguucuaggggagacucugucuccugcuccuucaggcugcuggcagaauccacauccuuucgguggcagggccaagguccccacuuucuugcugacuguaaacuaaggccacuuccagcuuguagaggcugccuacauuccuuggcucuuggcccccuccuccaucuucagagcuagcagguucagucugugucacgaaccauuucucugguucccugcagacaggaaagguugucccuaaggacucaugagauuagguugggcccagccagauaauacaugauaaucucccuccucaagguuuuuaauauuaaacacaucugcaggacacauuuugccauguaaacuaacauucacugguuccagggauuaaggaaugaaccucuuuuguuggggaaggguggcauucugcugaccacagcacuccaaccaaaagccaaaaaccaaagcaagacuuacuaacgcauaucaaauaaauuaaagguacaaaaucgugaaucucaguuaucuuaaauauuccaauacuauuuacaaaauuauucaaauucucacgccuuccaacucaaaauuagcaaucuaaaguaauuuccauauccuagauggaaacccucaugcuaaacugucugauuaugcaugguucuaaaugguuucaguggcaaauacauaacauuguacuacugauuaaacugaacuuaaaagcaucaa

SEQ ID NO: 17824 - RNA, 2130 nt, Homo sapiens
aagguugagguuuccuggcacgugggugccaggggcguugucuuuccucauuguccuucuuggcauuucacggaucuuguguaucugaagauguuccuucagcucagggaagcgucuucccugugugugcuggagcuccggccgguggagcuccugcuaugccggcucagaccucaggcccccucaccugcucccucggaguuccuuucucuuccguuagcuucucacucugcaucaguuccugaacuccaucuagaacgcuagcugggucuucaguuugaaccacuuccucauuuggcucacccccucuagauuuagcucagcgucccuuucugaaugcaggagcacucugguuuucagacuaguuccuuuucauagcagcuaguuuuguuuaauagacaugguguucuuuugcaacucucugaagaaacuauuuaaaauuucuuuaaaaguguuucccagggcugucagguuggucaccugaggccuucucucccaccugggucuuucagcacugagaggucuguggcaucuccucguguuggagucaaguccuguaggcagcauagggcccuggcucagcuuuucucugcagaggccucgcuugagugggugggguuugcccgcccgcagaccuccacgggagggggaggggucaggccuccccagcggcccucugaagucacuugcuucacggagguguuacugucugcugcuggacagagcaugaugggggcugcaagggcucccucaaacccuggacuccuccaacagagggcuccugguugccaggcucagcucugcccugcgucggccccagggcguagggaggguguuuaauccuggcccgggccuuccccgcagguggagcgcgugucgcacccgcugcugcagcagcaguaugagcuguaccgggagcgccugcugcagcgaugcgagcggcgcccgguggagcaggugcuguaccacggcacgacggcaccggcagugccugacaucugcgcccacggcuucaaccgcagcuucugcggccgcaacggugaggccugagccgggcaggggcgggggcucugcgcaccccgaccacccugaccuugccccgucucgcccugcagccacggucuacgggaagggcguguauuucgccaggcgcgccucccugucggugcaggaccgcuacucgccccccaacgccgauggccauaaggcgguguucguggcacgggugcugacuggcgacuacgggcagggccgccgcggucugcgggcgcccccucugcgggguccuggccacgugcuccugcgcuacgacagcgccguggacugcaucugccagcccagcaucuucgucaucuuccacgacacccaggcgcugcccacccaccucaucaccugcgagcacgugccccgcgcuucccccgacgaccccucugggcucccgggccgcuccccagacacuuaaccgaaggggccacccucuggccuccugcuucccaggcucccagcuccgcacaggcugaugcuccccgcccccaacuguggccgccugagcuguccccggggacgccccugccucccucugcgggcuccagaaggcggugugggggauggcggucagcagcggccgaggggggccgggcuaggucccagccugggccgaccccaccaccaggggucagcagagcccaggaggcgacaccgcccgcccgccgcucccagaccucgcccgagucggcucuguuguuugaauaaacgugaacgugaacccaggcggaagggacccgggaacucugacugcgaccucuguuuggggaguggggaucuccgcggcccaggggcgggaucugcugcuuccgaggaggcgucggggugcggggcggggcccggagcucaccggggcgagcgcacgacguucccgugucgcgcacgccggcgcagacagcgucuccuugacuaccggcccgccccgugcgccgggggcucaggugugcgccgcugcccuggccgaaucgcccgcccgggccccagccccgccgcucccgagaucucggcggccccgcgcagacacgggcgcccgaucucgcuggcagcguucgcucgcucucggccgggcccgcgcggcgcagcucu

SEQ ID NO: 17825 - RNA, 830 nt, Homo sapiens
cguacagcaacgggcccagguugggcgccaggcgauucaccaagcgacgagcccugcgcagaucgaauaccuccugcaggcacacaaaguccagacccacgggcagcgaggccaccagcgucccgcgcggcgcccuggaccacggcuggcugcaguccguagcccuguagagcgcgggccgcgcggcgccaauggccucggccggucgcuggcugugcgguagguugccgaagcgcgcuugcccgucggggagcaggcacagauuggcggugaggaagacgaagcagcgcccggguucggcaggcgggcgccagagcgcgggcggcgcccagcacagcggaggggagcgguagcagaaggggcggcgccaaaccugcggcaccagccagagcggcaggccgggcagcgccaggggcgggccgaccaccagcagcagcagcagcagcgccgcccgccgcccgccgcccuccucagccacccugcagcuggugcagggcccaguaggccgggaacagcagcgcgcgggccaagccguggagggcgugcagcgccgggggcgggaagggcgagggccgcggggcgucggucgccggggaccagucgggcggggauugcaugguacaccuagcucuucggccacggggcgccggggagacucauuggcuuccagaggacaagcugacucgucggugcauccgcgcgagcugcggggagucacaggggugaaggccgcguggcacagccugugugcaaagccggugaggugcugacgcagcgagccuggcggaggcgcgggcggaggcagaggggcgcuucaaaaagaaaacccg

SEQ ID NO: 17826 - RNA, 2743 nt, Homo sapiens
agaccugaccagaggccgaguuuaauuuggccccggaaggaaagggggcgcguaccgggccuccgugguccaugggggcgggugauggacgcugcccgguggggaggggacugcgcaggugacagggaggggccacgccugcacugagcccgccuccccgcccccccccgcgccaacaggauguguucugucuccacacgcccggcggcgguggcuauggggacccggaggaccccgccccaccgccggggucgcccccgcaagcacuggccuuucccgagcacggcagcgucuaugaguaucgccgggcccaggaggccgugugaggaucccgcaauaaagaugccuuaagucucccgguucuggggacgcagcuacggcgccuaguucgugcuccgagucgugucugugcgcgccagccgcgcgccccucaucugugcuugccuuaggaggacacugagacucggagcugcaggcgcacugcccggugguccgugagccccuccagggcgguacugaacgucaccugcuccaccuccugggggcgggagucagguugagggucgucccagugccgcaggcccagccacccgggaacuccgcgguacgugauguaguccaggcgccgaccucuccagggcuuagcucggcggcuucugccgggaaggccggccagguagagguggcgcccuuucuccugcuccagggcccugguaggggggcggugucaucaaggccagggccccuccgcgcgcuucgggcgggcagugccuacauccaggucgcaacucaccgccucggcaucuugggggaggaggccauggacugguggagcacggaggugcucagcgcggucccugggggauccgggggagggcggcaucagccagagccucagccgacggcgcuccccagguccacuucccgcuccgauacccucccccuaagcacgauacccagggcccagggcugcucuuggcgcgugcccagccggcggggguacccuccccccaagcgcgauacccagggcccagggcugcuuuuggcgcgugcccagccggcagggauccuggaaacagcggaagagcucgugcuccugcucuagccgguggucugcagagagaggcgggcgcgcggugggcggggccgggccuccuggcuccgccccuccucgcccuccucuccugcuggaccuuuccagcaguuaucgaaguuuaggucgcccaggagcacgcugaaagccacgaccucuccacuuuguucucugucggccucaaacuucucggccccaaacuucucggcccaguccagcagcggcgucagcuguuugcugcgcaagggcccgucuucugcgugggggagggggggguggggugggcuuggcuccagauucggacccgcauccugggcagucagcucccgucuccgcaguuccugaucugugagccccgacaggcacuucucaggaauuccggugccgggggcagugaacaaagggugggagguggggggcggggugcaggcgaauguagggaucagcagccgcuauggagaggcgggaccuguuccgaggacccauccgcagggcucaccagccagugcuugcaaaugcgugcagugcaggaaucccacgaugcggcgcccguccaggcugcccagccucgccugcaacaccacggacggcuccagcuuucuccgccuucucggccgaacccccgcccccucugcgggcugcaccggauaggccaguaccugugcggacgguagucccuuggaggccagcgcguccucgccacgugcgugggggaagcaacggaagguggcgcgcagcagcggguagcgcgaggccagcagcagcccgcuguccagcagcuugaggugccgcccgggcuguaggccgagcgugcccacgucguacagcaacgggcccagguugggcgccaggcgauucaccaagcgacgagcccugcgcagaucgaauaccuccugcaggcacacaaaguccagacccacgggcagcgaggccaccagcgucccgcgcggcgcccuggaccacggcuggcugcaguccguagcccuguagagcgcgggccgcgcggcgccaauggccucggccggucgcuggcugugcgguagguugccgaagcgcgcuugcccgucggggagcaggcacagauuggcggugaggaagacgaagcagcgcccggguucggcaggcgggcgccagagcgcgggcggcgcccagcacagcggaggggagcgguagcagaaggggcggcgccaaaccugcggcaccagccagagcggcaggccgggcagcgccaggggcgggccgaccaccagcagcagcagcagcagcgccgcccgccgcccgccgcccuccucagccacccugcagcuggugcagggcccaguaggccgggaacagcagcgcgcgggccaagccguggagggcgugcagcgccgggggcgggaagggcgagggccgcggggcgucggucgccggggaccagucgggcggggauugcaugguacaccuagcucuucggccacggggcgccggggagacucauuggcuuccagaggacaagcugacucgucggugcauccgcgcgagcugcggggagucacaggggugaaggccgcguggcacagccugugugcaaagccggugaggugcugacgcagcgagccuggcggaggcgcgggcggaggcagaggggcgcuucaaaaagaaaacccg

SEQ ID NO: 17827 - RNA, 2711 nt, Homo sapiens
cuccccggcuuucgcgagguuuugacucucguggcgccccaggggccgacgggaguggcggccgcgcggaggaggccaagauggcggcagcugcggcuucgcuucgcgggguaguguugggcccgcggggcgcggggcucccgggcgcgcgugcccggggucugcugugcagcgcgcgucccgggcagcucccgcuacggacaccucaggugagcgcugggccgggccccggccuccgcgcggccccgcaucuccgugaaggucacggcggggaggcugcgggcgcgggccugggcagcgcggaagcgguaccggccacccagcguccccggucccagcugccugccgaccuugagcgugugggaucagggcugggcgcccaccucuccgaacggcagagagcccguccccagcguggggguuggcgggacgggcuagcugccguggcggggcuggggcuuucccgaauggcgcgcccaggacggcucuugcggcuggcuguccaaacugggcccgcguccugaagugaccccagccugaucucggccagcugcuugugaccuuggccugucccagcacccuuggucacuucggucugauccccggcucaggauccaggaacacccucuccugagagcgaaucacggucuaggggucagcggcggagagggaugggguggguagugggacagggugugcgucuggugcccugcaggaggaggccauugcuggguggagaggugggcgcugagagucagauccccagguagggcugggugguguccuggcaggcgcugagcggagaucuugcaggcaguggccuugucgucgaagucuggccuuucccgaggccggaaagugaugcugucagcgcugggcaugcuggcggcagggggugcggggcuggccauggcucugcauucggcugugagugccagugaccuggagcugcacccccccagcuauccguggucucaccguggccuccucucuuccuuggaccacaccaggugugcagcuggcuggcuggcuggcagcgggagguucuggguggagcugguaagguggaaucuucagcuuuccuaacccuuucccucccuccagcauccggagggguuuccagguauauaagcaggugugcgccuccugccacagcauggacuucguggccuaccgccaccuggugggcgugugcuacacggaggaugaagcuaaggagcuggcugcggagguguggggucuggggaugccugggacccagggcucagggcucccacuguugagauggcaggguugugaugaggcucucgguggcagguggagguucaagacggccccaaugaagauggggagauguucaugcggccagggaagcuguucgacuauuucccaaaaccauaccccaacagugaggcugcucgagcugccaacaacggagcauugcccccugaccucagcuacaucgugcgagcuagguacacgggcugcccaugggguggugcuggagagaugggggaagggcugacuugugcuuggaacuaaggagccauggaucugguccuaggcaugguggugaggacuacgucuucucccugcucacgggcuacugcgagccacccaccggggugucacugcgggaaggucucuacuucaaccccuacuuuccuggccaggccauugccauggccccucccaucuacacagaugucuuagaguuugacgaugguaagaggccuccagucuggcagugggcauguggaauacuucuccacuacccccagggaugcuuucccuguguuccuggguccaggagguccugcccacuucuugucuggggcgucuucugugcaugucucaggaggcuuuugggcuccuucaguuuugcguauguccgguggaggguacugccccuuugaugccuuggguaggggcagugucugcuucacagagggggggcaugaucccagguuggacaugagccugagaauagcccucacugcuugucguuggccaggcaccccagcuaccaugucccagauagccaaggaugugugcaccuuccugcgcugggcaucugagccagagcacgaccaucgaaaacgcauggggcucaagguaaaaggguugggaggccaugguggguaucagagaagggcugggagcugggcagggcuccuccccacucccuucucugagccuuccuugucugcagauguugaugaugauggcucugcuggugccccuggucuacaccauaaagcggcacaaguggucaguccugaagagucggaagcuggcauaucggccgcccaagugacccuguccagugucugcuugccauccugccagaacaggcccucaagcccaagagccaucccaggccuguucaggccucagcuaagccucucuucaucuggaagaagaggcaagggggcaggagaccaggcucuagcucugggcccuccuucagcccccaucaugggaauaaauuaauuuucucaauguacauauuugaguuauuauauggaaagagugcacguuugcaaggaacucugauaccaagacccuugccuucacaaggcucccaggaugucccaugcaguguggccagcaaugcccugcacugacugguagcugggaguccagacagugggugugggacagaaagcggagaacugcauguuagaggaagucagcauuugguggggugg

SEQ ID NO: 17828 - RNA, 2711 nt, Homo sapiens
ccaccccaccaaaugcugacuuccucuaacaugcaguucuccgcuuucugucccacacccacugucuggacucccagcuaccagucagugcagggcauugcuggccacacugcaugggacauccugggagccuugugaaggcaagggucuugguaucagaguuccuugcaaacgugcacucuuuccauauaauaacucaaauauguacauugagaaaauuaauuuauucccaugaugggggcugaaggagggcccagagcuagagccuggucuccugcccccuugccucuucuuccagaugaagagaggcuuagcugaggccugaacaggccugggauggcucuugggcuugagggccuguucuggcaggauggcaagcagacacuggacagggucacuugggcggccgauaugccagcuuccgacucuucaggacugaccacuugugccgcuuuaugguguagaccaggggcaccagcagagccaucaucaucaacaucugcagacaaggaaggcucagagaagggaguggggaggagcccugcccagcucccagcccuucucugauacccaccauggccucccaacccuuuuaccuugagccccaugcguuuucgauggucgugcucuggcucagaugcccagcgcaggaaggugcacacauccuuggcuaucugggacaugguagcuggggugccuggccaacgacaagcagugagggcuauucucaggcucauguccaaccugggaucaugcccccccucugugaagcagacacugccccuacccaaggcaucaaaggggcaguacccuccaccggacauacgcaaaacugaaggagcccaaaagccuccugagacaugcacagaagacgccccagacaagaagugggcaggaccuccuggacccaggaacacagggaaagcaucccuggggguaguggagaaguauuccacaugcccacugccagacuggaggccucuuaccaucgucaaacucuaagacaucuguguagaugggaggggccauggcaauggccuggccaggaaaguagggguugaaguagagaccuucccgcagugacaccccgguggguggcucgcaguagcccgugagcagggagaagacguaguccucaccaccaugccuaggaccagauccauggcuccuuaguuccaagcacaagucagcccuucccccaucucuccagcaccaccccaugggcagcccguguaccuagcucgcacgauguagcugaggucagggggcaaugcuccguuguuggcagcucgagcagccucacuguugggguaugguuuugggaaauagucgaacagcuucccuggccgcaugaacaucuccccaucuucauuggggccgucuugaaccuccaccugccaccgagagccucaucacaacccugccaucucaacagugggagcccugagcccugggucccaggcauccccagaccccacaccuccgcagccagcuccuuagcuucauccuccguguagcacacgcccaccagguggcgguaggccacgaaguccaugcuguggcaggaggcgcacaccugcuuauauaccuggaaaccccuccggaugcuggagggagggaaaggguuaggaaagcugaagauuccaccuuaccagcuccacccagaaccucccgcugccagccagccagccagcugcacaccuggugugguccaaggaagagaggaggccacggugagaccacggauagcugggggggugcagcuccaggucacuggcacucacagccgaaugcagagccauggccagccccgcacccccugccgccagcaugcccagcgcugacagcaucacuuuccggccucgggaaaggccagacuucgacgacaaggccacugccugcaagaucuccgcucagcgccugccaggacaccacccagcccuaccuggggaucugacucucagcgcccaccucuccacccagcaauggccuccuccugcagggcaccagacgcacacccugucccacuacccaccccaucccucuccgccgcugaccccuagaccgugauucgcucucaggagaggguguuccuggauccugagccggggaucagaccgaagugaccaagggugcugggacaggccaaggucacaagcagcuggccgagaucaggcuggggucacuucaggacgcgggcccaguuuggacagccagccgcaagagccguccugggcgcgccauucgggaaagccccagccccgccacggcagcuagcccgucccgccaacccccacgcuggggacgggcucucugccguucggagaggugggcgcccagcccugaucccacacgcucaaggucggcaggcagcugggaccggggacgcuggguggccgguaccgcuuccgcgcugcccaggcccgcgcccgcagccuccccgccgugaccuucacggagaugcggggccgcgcggaggccggggcccggcccagcgcucaccugagguguccguagcgggagcugcccgggacgcgcgcugcacagcagaccccgggcacgcgcgcccgggagccccgcgccccgcgggcccaacacuaccccgcgaagcgaagccgcagcugccgccaucuuggccuccuccgcgcggccgccacucccgucggccccuggggcgccacgagagucaaaaccucgcgaaagccggggag

SEQ ID NO: 17829 - RNA, 5654 nt, Homo sapiens
cuaggggggucgaccccguaaccagugaggcgcgggccaaccuagugcgacgugugggcguggcgggggcuggggucugcgggcgaagguggcagcccauuggaggucccgggagcgaaguccagcugccguuaggcgcugggauagucgcacgcuggaugcaucuacguccgccgagccccuggggcgaagaggccgcguccgccuucaguuguggccggugcuucgcccccugacccuucgcccccaaagaccagcucuaacgugagcgccucggccgcccugccccagccucguacacgccgccagccucgcccagccgguguccggagacccucgggccguguccauuugugggcaaagccagcggggcaggcuuggccagagugcaccacucggcgccgucccaggcccgacgcucugggcgcgcccggaaccccagguucgcggcccguguuuccgaccggcggagggggcucagcggcccgaucccacggaagcgcgcucggaggggugggacccggccggaccggagauggcgccgccagcgggcggggcggcggcggcggccucggacuugggcuccgccgcagugcucuuggcugugcacgccgcggugaggccgcugggcgccgggccagacgccgaggcacagcugcggaggcugcagcugagcgcggacccugagcggccugggcgcuuccggcuggagcugcugggcgcgggaccuggggcggugagugggggcggagggcgcgcggucaguccucuuggcccgggcagggcacggagcccaaaguuaggccccuccgcuugccaccugggugcccuuaagcaguuauguuucuuugcuucuguuuucucguccgugaaaugggggugacgcucggaccuacugggaccuaccuggaccuacuuuacagggcuauugugaggauuugaugauaggcguacagggcuuaggaccguguaaauggucuauaaauguuaccuuguauuucuuugcuccucgugcgauguagggcggggggacgcccugagccuggacucucccucuucucagguuaauuuggaguggccccuggagucaguuuccuacaccauccgaggccccacccagcacgagcuacagccuccaccaggagggccuggaacccucagccugcacuuccucaacccucaggaagcucagcggugggcaguccuaguccgaggugccaccguggaaggacagaauggucagugcccuguaauggauacaauuacaauuuggaauagccuuggccccccaguccugguuggggaaguuggauccaccuuccccacugcuggaugucugggaaggcuuccaggagggaguagguggagccuggaguagcuuggaguacuuggaguggcugcuggagucagucuccuacaccaucugaggccccagccagcacaaguugcagccuccaccaggaagcccuggaaccucagccugcacuuccuuaacccucaggaaggaugagaggcaagcaugaagaggcagagcaggcagggucaggaccugugugagaagacaucaucccaagagcagcaggagagugacaggagugggagagugacagacucagauaccuccugcuuaagacagaguucugcaguggcaaggguuggugcagauaggguuggggagaaggauguuucuagagaugcuuagaagauggaauuaguggccgggugggguggcucacgccuguaauuccagcacuuugggaggccgaggugggugaucaccugaugucaggaguuugagaccagccuggucagcaaggugaaacccugucucuacuaaaaauacaaaaauuagccaggcgugguggcgugugccuguagucccagcuacuuggggaggcugaggcaggagaaucacuugaacccggaggcagagguugcagugagcugagaucuugccacugcacuccagccugggugacagagcaagacuccaucucaaaaaaaaaaaaaaaagaagauggaauuagcugaguuucauggcugcuugggagguuuuuugcagacaaagacucccucucucacccagacuggagugcaguagcgugacccuaacucacuggagccuugaacuccuggucuacggugauccuccugcuucagccuaaguagcuguuauuggcaugagccacugccccuggcucacauggcugcuuaaauggaagaguuagcaguugagacugagaaacaugaaggacuagguaguauggggcucccagauagagggcagcccacaaacgagauaagcagagcugccagagggguaggaagacagccagacagugauguaagagagacucaagcaacucaggguuuauaaaaggagcuaagcucucuuuagucauucaccaagcauauguauucagcagcugcccugucccagguacuccuuuggcaugaacaaaaccucccauccccauccuauuggagcuugcauuuuuagaggggaggaggcagacauauaaaauaaguacagggcugggcaacauacaaaaaauuuaaaaauuagcugagugggccgggcacgguggcucacaccuguaaucacagcacuuugggaggccgaugugggcagaucaugagguuaagagaucgagaccauccuggcuaacacggugaaacccugacuacuaaaaaaaaaaaaaaaaaaaaaaaauuagcuggguguggugguggggaccuauagucccagcuacucgggaggcugaggcaggagaagggcgugaacccaggagguggagcuugcagugagccgagauugcaccacugcacuccagccugggcaacagagcgagacuccaucucacaaaaaaaaaaaaaaaaaaaaauuagcugaguguagucgugucugccuguaaucccagcuauucgggagguugagaugggaggaucacuugagcccagggguucuaggcugcagugagcugugaucgugccacugcacuccagccugggugacagagcgagauccugucuccaaaaaaaaaaacaaaaauaauaaaauuacuguagaguuuuuuaaaaaagaaagucuguuagauggugugggaaugagaaugguggagcugggaggauugcuguuuaaaacgguggcaggggccgggcgcgguggcucacgccuaucaucccagcacuuugggaggccgaggugggcagaucaccugaggucgggaguucaagaccagucugaccaacauggagaaaucccgucucuacuaaaaauacaaaauuagccgggcgugguggugcaugccugugaucccagcuacucaggaggcugaggcaggagaaucgccugaacccaggaggcggagguugcggugagccgagaucacaccacugcacuccagccugggcaacgagugaaacuccgucucaaaaaaaaaaaaaagugguggcagggaaggccucauugaggugacacuggagugaaauuugaaggucauggcaugaaccaugugaccaaggaagcagcaaacaaacccugaggugagcauguauaagugauccuugagguucagugggggccggggccggggccggggccaggaacagcgcugggugcguggaaggcccugcuuauccuaguagggagaugguagaauauagugggccugagaccacgggagcugugucagcacuggauggggacccccccauugcagugggcugggccucacagggcggguaagaaggugagucagcagggugcucagcucugaagacgcccagggcaguggcuugucuggagugcuggcagcccaggugugggucagggagcccggagaggggagguccccaagggcuccaagaggccacccugacugcagggccacugagggccugcuuugguucugcugugaggcaucccuggcuggcagaaagagccaagagagguggccuagccaggcacaaaaggguuugaaaaggcucuaauucccaaauaugaacuaagugcagcuccagcacuaacagaagucuggcaggggccucugagggucuugccagagccaaggcugggagaagguguggcuagaaguguggccugaggcagggcccuggcauggacugaggugagggagaaggcaaagguccuggaaaaccaagggccuagaggccuggacagaggccacagcacagcacacccauaucuuaccucuaggcagcaagagcaacucaccaccagccuugggcccagaagcaugcccugucucccugcccagucccccggaagccuccacacucaagggcccuccaccugaggcagaucuuccuaggagcccuggaaacuugacggagagagguacagguggggggaggggguugggggguucggggauagcagauaguccccaguggugacagcuguccuuuccuuacccugcagaagagcuggcagggagccuggcccgggcuauugcagguggagacgagaagggggcagcccaaguggcagccguccuggcccagcaucguguggcccugaguguucagcuucaggaggccugcuucccaccuggccccaucaggugaggccuggggcugcuucuucaccuuguccucgugaccaucccaggucccccauccaucccugaacccacauucuggcacaggcugcaggucacacuugaagacgcugccucugccgcauccgccgcguccucugcacacguugcccugcagguccacccccacugcacuguugcagcucuccaggagcaggugggcacagggucuggggagcccugccaggggcagaggagccuaggugacaucaccugcccugaugcucuggccacagguguucucagagcucgguuucccgccagccgugcaacgcugggucaucggacggugccugugugugccugagcgcagccuugccucuuacgggguucggcaggauggggacccugcuuuccucuacuugcugucagcuccucgagaagccccaggucaguccucgauggggguggggugugggagguggggugcagccccacaguccugagcuccacccccucagccacaggaccuagcccucagcacccccagaagauggacggggaacuuggacgcuuguuucccccaucauuggggcuacccccaggcccccagccagcugccuccagccugcccaguccacuccaggugggcacgggacugggcagggagggccaggacagccaugggcauuggaaagagcagggaagcaacaacugucucucuucccccagcccagcugguccuguccuuccugcaccuucaucaaugccccagaccgcccuggcugugagauguguagcacccagaggcccugcacuugggacccccuugcugcagcuuccaccuagcagccaccagagguaccagagguggcacaggcaggggagguggggggcagggcagaauccacaggaaugacccagcuccucccccacagguuacaaggggagaguggcccuucccucacaaguccgacaucuccaggcccccacugaacuccggggaccucuacugacugcuugcugggacagucaccaggguuggggggaagggccacaaaaugaaaccauuaaagacccuuaagagccagc

SEQ ID NO: 17830 - RNA, 3158 nt, Homo sapiens
cauucagaggcgcggggccgggcccggcggacgcuuguuguuguccggccgggggaggcggaggucgcucgcucgcucgcucggcucgcugacucgccggagcgcucuguggcggucggcggcaggucggucgcgagagcgggcucuguggaagggggcgaggcuaugucgcgguggcagcccggaugggccggcagggccgggaguaacgggacgucgccgcggagcuucuucccccggauacagugcggcccgagcggaggccgcggcgccgcccuccgaucuugaagagcccgcgcugcgcggagcccgcccccgccugcgcaccggcaccgacgcggagcgacccagcccagccagacccggcccggcgcggccugaucuaacccagccaggcagguggguguccgcccugcgucccgcgccgucugcguacccggaaccacagcccccagcaggccucgcgcggcgcgcugccuccugggauuuguaguuccaccgcggcuuggcuggugcccgacguggcccaggcgggcgcugccuggugacugcagcgccccagcggggccgagggaccgcccuccuaggcgucuggagaaacuaggcaauuuuuccggguagaguggaggaaccuguaguuuuccucuccccgggccagaaaguagccaaaacgaaagagcgcccgcccaggugaccgcagggcccggagucccagguguccugguuccuaaccgggaugcagccucuuaccuuggcugaggagcccagccagccugagggagacugcaggagucacgucccguugcggacucaagaguuacccccaugguggcuggagcucuuuuggagugggcguggagauggggaaugggaauguugagcaacaaucucagccagcagccccagggugagcaggguccccgguggucuagucuagucccagaacucgcguguucugcaggggguauggcugaccuggagccuggacuuaccacccucagguaaaacaggaucucugucaccucuccuggccgggcagagaggggagcuccugaugugcagccuggacagaggccagacucagcuuguuccuagcggcuccacuuaguggguaggagggcugaaggcagggccccaaggggccagauagauacccauggucuggucucucacuccccaggcaauacuagccccucuggagcacggagcuccuuccccaaagacaugaagcuauuggagaacucgagcuuugaagccaucaacucacagcugacuguggagacuggagaugcccacaucauuggcaggugaggcaggcugggggggcuggcaucucggaggucacacugccgcgcccuucaguggaaccugggggaagcaugcuucaugguucucucugcauccuauaggauugagagcuacucauguaagauggcaggagacgacaaacacauguucaagcaguucugccaggagggccagccccacgugcuggaggcacuuucuccaccccagacuucaggacugagccccagcaggugagccaugguggggccuaccuggggcuggggguugaggggaggugaugggcccagcugaugguucugucugugcagacucagcaaaagccaaggcggugaggaggagggcccccucagugacaagugcagccgcaagacccucuucuaccugauugccacgcucaaugaguccuucaggccugacuaugacuucagcacagcccgcagccaugaguucagccgggagcccagccuuagcugggugagggucagguggagggaagggacccacagccaccccacuguccuuccccacuuuggguagcccugggcuccugucacccugacugugaccugcccuagguggugaaugcagucaacugcagucuguucucagcugugcgggaggacuucaaggaucugaaaccacagcuguggaacgcgguggacgaggagaucugccuggcugaaugugacaucuacaggugggccggcaucccugcagauggccuccaggccuccagguuuguggggcacuuggcgccucacaccaccugucacccuauacuccccagcuauaacccagacuuggacucagaucccuucggggaggaugguagccucugguccuucaacuacuucuucuacaacaagcggcucaagcgaaucgucuucuuuagcugccguuccaucaggugggcaccccccgccuccucccccaccucccuguugggccgauacaacuuccccagcugugccaucuccacccagcuuugcccucccugaacauccucccuggggccagcagcaggccuggguagggguccugaaacugguuucccugccuccccucaguggcuccaccuacacacccucagaggcaggcaacgagcuggacauggagcugggggaggaggagguggaggaagaaagcagaagcgggggcaguggggccgaggagaccagcaccauggaggaggacaggugugugaugggggccaugacccggguccuugaagccuggaguggguacaacagggugggggccuccucuacuuggucuaagugguggcuccugaaggcccacugugugccaaccuccgcccagggucccagugaucuguauuugaugaggaggagccgaggccccagcuucauccagcuucaaccaaugccuggaccuguccaccugagaggccccuggggccuccccagcugcuggccagacccuggcgcugccacaguccuggcacugcccaaggccauaccugccuagcccuuuggcuccauccuguggaugcccacucaccccucagacuccugcugcccaugcuguggccggacuugucagcagggggccuggugggaggagcgacugcccugcccaaaugaacugccacagcagggacagcuggaccgcagaguuuauuuuuguauuucuacugggccugcacacuccagcccaaagggucuguggccggaggccccacgagcaggccccagcagucaccggcucuggucuugggccggccccggugcccaccuguacccccaccucgcccauuuggccgcgugcacugagugucacuuugcugcagcucguuucuuuccaauaaaaguuucugugacuuagugugg

SEQ ID NO: 17831 - RNA, 3158 nt, Homo sapiens
ccacacuaagucacagaaacuuuuauuggaaagaaacgagcugcagcaaagugacacucagugcacgcggccaaaugggcgagguggggguacaggugggcaccggggccggcccaagaccagagccggugacugcuggggccugcucguggggccuccggccacagacccuuugggcuggagugugcaggcccaguagaaauacaaaaauaaacucugcgguccagcugucccugcuguggcaguucauuugggcagggcagucgcuccucccaccaggcccccugcugacaaguccggccacagcaugggcagcaggagucugaggggugagugggcauccacaggauggagccaaagggcuaggcagguauggccuugggcagugccaggacuguggcagcgccagggucuggccagcagcuggggaggccccaggggccucucagguggacagguccaggcauugguugaagcuggaugaagcuggggccucggcuccuccucaucaaauacagaucacugggacccugggcggagguuggcacacagugggccuucaggagccaccacuuagaccaaguagaggaggcccccacccuguuguacccacuccaggcuucaaggacccgggucauggcccccaucacacaccuguccuccuccauggugcuggucuccucggccccacugcccccgcuucugcuuucuuccuccaccuccuccucccccagcuccauguccagcucguugccugccucugaggguguguagguggagccacugaggggaggcagggaaaccaguuucaggaccccuacccaggccugcugcuggccccagggaggauguucagggagggcaaagcuggguggagauggcacagcuggggaaguuguaucggcccaacagggaggugggggaggaggcggggggugcccaccugauggaacggcagcuaaagaagacgauucgcuugagccgcuuguuguagaagaaguaguugaaggaccagaggcuaccauccuccccgaagggaucugaguccaagucuggguuauagcuggggaguauagggugacagguggugugaggcgccaagugccccacaaaccuggaggccuggaggccaucugcagggaugccggcccaccuguagaugucacauucagccaggcagaucuccucguccaccgcguuccacagcugugguuucagauccuugaaguccucccgcacagcugagaacagacugcaguugacugcauucaccaccuagggcaggucacagucagggugacaggagcccagggcuacccaaaguggggaaggacagugggguggcugugggucccuucccuccaccugacccucacccagcuaaggcugggcucccggcugaacucauggcugcgggcugugcugaagucauagucaggccugaaggacucauugagcguggcaaucagguagaagagggucuugcggcugcacuugucacugagggggcccuccuccucaccgccuuggcuuuugcugagucugcacagacagaaccaucagcugggcccaucaccuccccucaacccccagccccagguaggccccaccauggcucaccugcuggggcucaguccugaagucugggguggagaaagugccuccagcacguggggcuggcccuccuggcagaacugcuugaacauguguuugucgucuccugccaucuuacaugaguagcucucaauccuauaggaugcagagagaaccaugaagcaugcuucccccagguuccacugaagggcgcggcagugugaccuccgagaugccagcccccccagccugccucaccugccaaugaugugggcaucuccagucuccacagucagcugugaguugauggcuucaaagcucgaguucuccaauagcuucaugucuuuggggaaggagcuccgugcuccagaggggcuaguauugccuggggagugagagaccagaccauggguaucuaucuggccccuuggggcccugccuucagcccuccuacccacuaaguggagccgcuaggaacaagcugagucuggccucuguccaggcugcacaucaggagcuccccucucugcccggccaggagaggugacagagauccuguuuuaccugagggugguaaguccaggcuccaggucagccauacccccugcagaacacgcgaguucugggacuagacuagaccaccggggacccugcucacccuggggcugcuggcugagauuguugcucaacauucccauuccccaucuccacgcccacuccaaaagagcuccagccaccauggggguaacucuugaguccgcaacgggacgugacuccugcagucucccucaggcuggcugggcuccucagccaagguaagaggcugcaucccgguuaggaaccaggacaccugggacuccgggcccugcggucaccugggcgggcgcucuuucguuuuggcuacuuucuggcccggggagaggaaaacuacagguuccuccacucuacccggaaaaauugccuaguuucuccagacgccuaggagggcggucccucggccccgcuggggcgcugcagucaccaggcagcgcccgccugggccacgucgggcaccagccaagccgcgguggaacuacaaaucccaggaggcagcgcgccgcgcgaggccugcugggggcugugguuccggguacgcagacggcgcgggacgcagggcggacacccaccugccuggcuggguuagaucaggccgcgccgggccgggucuggcugggcugggucgcuccgcgucggugccggugcgcaggcgggggcgggcuccgcgcagcgcgggcucuucaagaucggagggcggcgccgcggccuccgcucgggccgcacuguauccgggggaagaagcuccgcggcgacgucccguuacucccggcccugccggcccauccgggcugccaccgcgacauagccucgcccccuuccacagagcccgcucucgcgaccgaccugccgccgaccgccacagagcgcuccggcgagucagcgagccgagcgagcgagcgagcgaccuccgccucccccggccggacaacaacaagcguccgccgggcccggccccgcgccucugaaug

SEQ ID NO: 17832 - RNA, 2565 nt, Homo sapiens
cggcuuucgcuccucuggugggcgggguugcgggccacacagcggaccccuaagcggaccgcuggcaccggucggguggcagcagagugucgcucgacaugggggaggccggggcuggcgcuggcgccucgggagggccggaggcaagcccggaggcagagguggugaagcugcugcccuuccuggcgccgggcgcgcgggcggaccugcaggcggcggcggugcggcacgugcuggcgcugacuggcugcggacccggccgcgcgcuguuggcggggcaggcggcgcugcugcaggcgcugauggagcuggcgccggccucugccccggcccgggacgccgcccgcgcgcucgugaacuuggccgccgaccccggccugcacgagacauugcuggcggccgaccccgggcugccagcgcgccugaugggccgcgcguuggacccgcaguggcccugggccgaggaggcggccgccgcgcuagccaaccucagucgcgagccggcgccgugugcagcgcucauggcggcgcuggcggccgcggagccggcagacucgggccuggagcggcuggugcgcgcgcugugcacgcccggcuacaacgcccgcgcgccccugcacuaccuagcgccgcugcucuccaaccucagccaacgcccugcggcgcgggccuuccuacuggaccccgacaggugaagcccagggcgcccgcgcgggcggggaggggacggaaguuaggggggacggcccuaagugacaccucccaacaggugcgugguccagcggcugcugccccuuacccaguaccccgacuccucuguacgcaggggcggggugguggggacgcugcggaauugcugcuucgagcaccgugagugguggguguggcgggggugcguugccagguguggggacuggacuccggggcugcucuggaccaguuuccauucccgucuccccacccucaccaucccucaggacaucacgagugguugcuuggaccugagguggacauucuccccuuuuugcuccugcccuuggcugggccugaggauuucuccgaggaagagauggaacgugaguggcuaguguggagccucagaguuggccggagaggagggaggccaguggagggagagagagguguccaggccacaggcuccugaaacuuugcagcagugaguugcugagcacaggugggacuuacacaggcagagccuggcucagcugcccagcccagggacacaguggcucccacacacucaccccuagggcugccugucgacuugcaguaccugccaccagacaagcagcgagaaccugaugcagacauccgcaagaugcuuguugaagccaucaugcuggugagcaggagcccugcugcaauaagcaccaccccaacacacacacaugagcaugcugacaucuggguaaccucuuccaccuccucagcugacagccacagcaccaggucggcagcaggugcgggaccagggagccuaccugauccuucgagagcugcacagcugggagccggagcccgacgugcggacggcuugugagaagcucauccagguuggugcaggguuggagaggcuggggaaggggugucuguagcuggccagcugcucaccugcuucccgucuggcaggugcuuauuggggacgagccugaacguggcauggaaaaccugcuggaggugcaggugccugaggauguggagcagcagcugcagcagcuggauugcagggagcaggagcaguuggagcgggagcuggccccagagccauggguggagagggccacacccaccugaggccccugcagccggacaccagcuccaggguccccuuugccaggcuuucucagaccaggccuuccugcagcugucugcaggcccccuggguccccuuguucagagacugugcucuucugagaagcagagcuacgcuuaggcuccaguaaggauuggaggcacuuuccagcccugugcaguguugcuaccagcaagaaugaagguugugcagagcaguacugugagguaggcaccgugacucggcugccugugcagaagguggagguggcaggcggauggccagggagccaugagaagacucuuccugggcacggcguggggacuggacagaaaaccacugcaagccccaaggagccagcugaagccucccaauccccagggcacugcagagucugggcagaggugggcgcauagguacaagugcugcuuugucagccucacucccugcagcucucagcucccuguucccugagaccuggccucaaagggcugacccagccauacguagauccuggggucuuucuaggacugugccucccugcuugaccuaugcuccaggacccugcccucaacccuugucagcucccuaagucuuccuguuucccagucucagauugagugggugcucucauuggccucucuagcuaggccgucucccuggucagcuuccuugagccugggccacuccucccuggccuucuuaccucugccaagagccuccagaugugccugcagccuagucccugccca

SEQ ID NO: 17833 - RNA, 1617 nt, Homo sapiens
aguuuguuguucauuucugcaaacgcugagcguagcugccucacggugcgucugcggugccaucugaguguucuuggcagcacugccaggucucccugggagcugcgcucuuugacccugugacguccugaggccugggccagaugcugcuuccuccagggaagauuuguucucccucccaguagcuccccagggaccucccacaccacugcccugggcccuguguguauaggcccagauuuuucucuguguccuuuauuaccagcucuguuuacagaucccuggagucaggggaaggggugagcucagaucugaggccaagaggccauuucccagcuggcugcagcugagccugguggcugugucugagcgucguggagccaggguccacggcacccagguggcggggggcaggcgcccugaccagccacggccucaaagugacucuccugcucugcuccagccacaccugcaugcuguggcgggcgcuggcgguggagccucgccuagcugcccagguccuggggcugcugcuggagaagaugaguagggacgucccuuucaaggagagccgggccuuccugcugggccgcaccccagaccgcguggccacgcugcugccucucucggugagucgggcucucggggccaccuugacacgcugucccugccccgcuugccugggugcccgggggcaggccuuuugaugagguggcccggacgccaccccacaggcaccuggaggcagcaccgggcugggagcucugagcucaggcucguaaaggccucacaggugugggcccccaggggaggccacuucauguuuuauccugcggaaaaaaaauaaacccagcuuggcaguguuuuaagcaguaaagcagcugugagaauucccuccuccuccuuucugaggagcugagaacagauggccugaggucuguccugugaaggcugacugccccucugucccugucuccugccucuaccccugagggccaagccaugcaguggugcgccucgcccuuccugcgcugcagcugggaucugagaccuccgagcacacgaugcaggcgaagggggaugcagucucauugggugcagggcucagaucuccugcggccuggagggaggcauggcccugugaugacuucucccccaggcuaccugugcacuguuugaggucauguccacgccugcagcggggcccgcggugcucgagcucuacccccagcuguuuguggugcuucugcugcgcgucagcugcaccguggguguccagcugccccggaaccugcaggcccaggaaaggaggggugccaguccagcccuagccaccaggaaccuggaacccugcagguaucuggguccccacuucccaccuccaguacugauucggaagcacaggcaugcgugugcacgcgcguggugggggcggacggcagaucugaaccacggggagugugggagugacuuugcuuccagggagcuggcgccucacccaggugcagggcugagcugucaguggugacauccauggccacccuucucacacuggcugugaaggccucccuccucgccucugcgggcggucugcacgguggugcugaacacaggcag

SEQ ID NO: 17834 - RNA, 430 nt, Homo sapiens
agaggucacuggacagcacuuuauugacacccucggacccggggcagggucagcaagacucccagcuggcaucagacugugucuggccugcugucgccaucccugaggggugcaggacagagccccauaggggcagagaggccucccugggaccagaggaggaugcugugcagccaggcccauccccagcacucgaggccuaggaggagaggugggcucuggcagcgggugugagguggcagugagaagccaggcccucaggugcagcucaggccucugccgcuggggccucauaguugagcacguaguagucguggacguacaugaggacggcuauuggcuguccgaugaugagcgacagccacacagcugcguugccauaguugcccuggaaaaagcggcccacgaaccaggccagugggaucuaggg

SEQ ID NO: 17835 - RNA, 6499 nt, Homo sapiens
cuccaaauucuaucaagaguggcauuuauucuccuuguggaggugcggugcuccggggagcuggugcuauugugcuuaggaaggaggucuguccguccguccgucuguccggccggccuggccccaaaugggggcggaagaggggcacggcccgaguaaaaaucccggccuauuccgggugggaauauguacaaggcggcggggcacaggcgggggugggggcgggcgggccggcggccgcagcccccacccgagggcccccgcaccucgggcccuacuuguagaaucaguacaaaauaggugcuaccuaaacguuccuucuaccugaauucgcuaagucgguuauugugcugcuuaguuaugggggcgggagggggcccauggcuuuccacggcggcgggguguagggggaagcaggagacccugacgggcccacagcccuccagcuuucuccuuagguagguagacaggaguaugggguggggugaggugggggcgccugugugugcgugugcaugcggcacaggugggcaggccccagcuugggagcugugcaggcaccacaccugguuguguaggguguuuggaugugggcacugcugugcagagcggugggucauccuugugggggcagccacgcuugcugcugggggugaggcuggccacaccauaggcuacagcuggcaccuucuucuccagccauggcucugccccuggcuggacauggcagauguguguuggccagaggaucagagaaguggccaccugugugggggcccaggagcccuggaucugucccccucagcuggagucaaaaggccuaacucaaagguagagcccaguugugcccagcagggacugguugagguggggaggaguguagggggcaugugaaccuagggaccuggucucucugcaucugccguucuucccuggcccacccaagccgguuggaccccuguccugcaaacacaccucccagcagguggcugcgcuccuggcggacucagcaauuggccuggcacauaguaggugcucaaugaacggucagugaaugauuaaugccugaaggaggggucuugggggcaaccaccccacccccgcccauggaaccauuacagccgccgggcucugccgugggggucggggagggguggggagaaagucugcgcggccggccccgcgcagcgucccugaucuaggggccuaugggguggguagggcgaggggauaccugauucucaguaacucuagaggcggcggcagcuucgcaugcagugcgcauuauugcucuauagucggcuucggacuaccuaagagggagggggagcgggcagccccggguaggaucgggaggagggguggggcugcaugcagugacgucacaaaggcggcggccaauggggcgggcccuuggggcggggucgccgccgaggcuuuggcauagacgggcgaaaguuggcaaccgagugggggcggggccugggucucaggggcggggccugggucucaggggaggggccugccucggagaggcggggccugaggcucccuagaggcucccagcuaggggcgggccucggggcguggaaaguaaucccggacaucccaggcccccggcgucggcgggcaagauggggguucagcgcccccucccugacccgagugcaauccguucauaaauaaaacguacaaauacagaaaaagaaacccgacgcguccgcaacccccccagggggcuuuacccgcaaagcgaagacagagguguguagagggcagcgcccaggccugccugccggccccgggaauccguccuccaacacgaaugccugggguacgggggggggggugggggcccggggcagggcggaagcggggucugaggaggucggauaaguccaugcgauucgauaugugucauuauuauucgauauggaggacagagcccgggaagcugggcuggaagaauucggauuuggcagaggaugcgaggcgaggguaggagggcggcuccgacugaggccccagaagcaacccgagggagggggugccgccguccgccccucuccccgacccacaacgcgucuaacacugccgggaguuccgcgaaggcugcuaggcaggggcgucccugcaggcccgcccgcuccugcuccgccccggccugcugccggggaggggccggcucccuggacgucugggccgcaggcccugcgcuagaaggcuugggaagggguggggaagaccugagucccugcgacgcgauccaggggcgcagaggcgggagaaggagggcgcucccuaccucaccucacccccgucuucagagacccaacucggagaugagguucgguucuaggucucgucgacccuauugcugggagaaagccgggggcacccuggaggggaggggagggggcucggggugggucuccccucgggacccuauugcuugaaggggccggcaaggccccuggcgggcggggcggggugggaccgggccccccucccccuauugcugugaggaggggcccgcccuccggccccuccacccggacgccagcgaagacuucccuggggggccguauugcugagagccgaccuggcugggggaggccccgccgcccuaggccugcacagggcugagcuguggcggcgcaggagccgcggggccuccggcgccgcccuugaagcaggccgacucguagugcuuguugagauaggacuugagcgcgaagcucuucuugcagcgcuugcacuggaagugcuugaaggccgaaugcgucugcaugugcgcgcgcagguuggagcggucggcgaaggccuugccgcagugcgcgcagccgaaggguuucucgccggugugcgagcgcauguggcccugcagcagccagggccgcgagaaggcuuugccgcacacgccgcacuuguggcgcaggucgugcgugagcaggugcauggccauggccggcauggacacguacaccuugccgcacgucgggcagcgccgcgccagcuggcuguccaggcugcggugcgucugcuuguggcggcucagguucgacgacguggcguauguuuugccgcacucgccgcacgcgugccggccgccagcaccugcggccccuggccccgcgcgcgccucggugccugcccccgcgcgcgugccgccccggccccccggcccggaucccaagcugcgcccgcccgccccgcccccgccuccggcgucgccgucgggggccgccgccgaggcuguggagggagcggcggcagagccggcauuggaagccuuacgccgcgagcgcccgucggugaugaagaaggcguccgccgcguagcccucgcugacggccgcgucgccguugauguagccgcccgcagcgguggccagcuccgggcgcggggugggcggcggcgcagacccugcagccgccggacccagcucuccacgcacagcugcugcguacaugggcuccggcgacggcccuuugagcagcgcagccucggcgucgccaucguagacggacgagggccccacguagucgcugagguacccugcgggcggaggcggacggacagcgggaagggaauggggcggcggcaggacacacacgggggaugggggggcgggagacagcagacgcggaccgggagacccggguccgggagagaggcgaacagggaggaggacaaaggagaggaggccgagggaccgccgggcagggaggauggagacagcagggaggggaagagaggggaggagaggaugagacagggccgggccacgcuccgcccccgccgccccacccucgcagagaggaggagagaggcgcgucuucgggcgcggcugccccccuuccgcggagccucaaggucaggggggaggggcggcgcuucccucucccuccucccccacccacccuccccucccccucggguucuccccacuucagcaguuuucccugauuaugcaacacacugcagacccgcggcgcacaaagccaggacugccggcccagggaccccgucugucccaccucuccgggguccuggccggcucucccucuggccugcagaacgugcgcuccauuuugauguugacccccucuggccuucugguuccuccaacaagcccugaagacgucucccucccccaguucccuccggccucaccagcaccucccucagcucuccggccacccacuggacuugacccugcccucccugcuccuccaugcacucugcuucuccuccgaacucccucucaccauccugcacccuuggguccuacccuguucaacauugcccucuccugcucacacccuaaccccuuucagggccuucccaagccccugaacugugcagagagggccagggcguccacuuucacagggacgagcugcaggagggcagcaucacuuauaccgguagcugcaguugcuccccaggcacaagauggaucucauaaccucaaagucacaaaugcacgccccucgcgacgcucugccuccuucagggcuacacccagucucccagcaugaucagcccuugugugcccucacagggugggcugcacacugaugugccgaacucaccaccuccucacucacgcagggucacacaugcagucaccccggacacacucucaagucacauggugcacagcggccucagagucacauggucccauguaguggcacacaggcaagcacacacacacacagggucacacacaagcgcacacggucacauggccacacacagucacauggacccacacaggcucacacuccugcaggucacacuugcucugccaccccaugcugcuggcacuccugucccccucuccugcaugcugacaguuguccuugaacuugggcacccuuacacaaagagccucccccugccucccacaccuugggcgucccuugcucacagccuccucccugcuuccucucccugacccaggcuucagggaagagacugcugcugccucugcuggcccucugcucugacaggugggcggcccuguuggacccccugccuacucccuggagcucccugcauuccccagcuaacccuagcagguguccuggugcagucaaggaagaggagaggguggcgaggcggcccuggucucuugaguguaggucugugugugccggcauggcugggucccgucauggcagcgcccaugcggcugugucugucccagcaugggucaggauguggguccaugugugcguuuggguaccucaguuccugauccucuuccccacccucuguccaacgucgacacucucccugcccagccuuggccucuguguuccccuuccuccccucuaccguccaggcuccagccacagacucuugccguuucugguucccuucagucuguuuccccgggcccugcccuccgcccccacacucuggcccuccaccgcuuccagcaaagccccaggccccgcgcccuggucucagaccagcgcucaccuuuaucgugcaguggcgcgccgaggucgcugcgggcgcguccguaggcgcucuccaggucggccgaagagaacgcgucaaguuugaccuucuugaccaggaaggaccugggcaugauuccugcggggcuccggcgcugugggccugcggagccggggcuugggggggcugcggcggcagggccccgucaccauccgaggagcggcggaggcagcgcggguccccacucuggccuuuggaugcugccgcgcgagugguguccucucuccuugcugcccugcgucuccuccguugccccuccggaucccucuucuuccuccuuccuucaauccuuccuuccuuccuucaauccuuccuuccuucucuccucuucucuccucuccucuuccuuccuucccuccucuggucccggcuucccagcccgcagugccgccccuggacaggcgggggaggaggcugggggggcggagagggggggagcggcuccgucccgggccuggaggcugcgagugggugcagggcuggcccggcucgguggcccccuuccccuccccccccccgccgccgcggcggagccucagucagcggccccccaugcccccgggggcggcggcgccgggcccggagaacgcgguggcagcggcagcgccggcagcuucagcaccgcggccagcgccggccugggcagcaccgcggccagcgcccgggcgcgcucaaccggcgcgggcggagaggggcgguccgcggggguuuggccgccgggcagggguccucggcgggggucucugggaggcuugcuuuauuguucugcagccggagcgagcggcaguggcgacggcggcggcggcggcggcggcggcggcgggcggggggcggggguccuggggggaggggugcgcagggagggcgggccgagggagggagggagggagggacaggggcuccgggggcggggcucggcgcucggacugcuccugggcccggccuccagagcccgcagccg

SEQ ID NO: 17836 - RNA, 2281 nt, Homo sapiens
gggccgcacaauggccgcgcgcgggugccucuguccccaauuagggccuggcgccgccauuguccccucacccgccccgcccggugguccgggucuacgggcuccgagcgcgcucccacgcgccccgcugccgcuggggaccaaggucgcgggggcggccccggggagcguccgggcgcgggugugccgggagcgcgugcgauacuggagcgcgcucguugcggcgcaaaaugaccuugcgcggggcggacccgcggacagcggcugggagcgcgcggcgggcgggccccggggaaggcggccugcgggggcgcgcugcacuugcugagcucagcgccccgcccccggccgcccggccccgcgcggagcccgggugggugugacccggcccgcccgcgcggggggugcggcggagaccacggacccgcuuugugccagccgccccggccccggcagcggcgggacauucaucuugcguggcaggcgcucccgaggggugggggcggggcgcggccgcccccuuaucuccgagcggcagccggcuaggcucgcggugggggcgggggcgggaucccccucggccgcgccgcgcggguccuggcucccucccaggggggggccgggccaaggcacagccggaggcguggggccaauuaacauuuugauugcgggacuggggggccaucuggaccgaggccuaauuacccggcagacccucggggcgccggcgggacgugccaggcgcgauccccucaugacccagcgcucaccgccuucucccggacccuguccccgcccucaacucuguccuucgacuccauccuuggccuccuccguucguccuaguauucuugccucucuguccccacucuccggguccuccgacccccaacucuguccccuucccccauucuuccguucgucugcccuguccccccaccccccguuucucuccucugcuccucccacuucgucccuucuccccgcgccauuccugucgcccugcacucaccccguuuccuugucccuccauccacccucucagccccuuccucuccugccucugugcacauaccugccucucucugucaagcuccucgccccuuuugcccccaguccccuugacggaagaggcaucacagcggcacacaugugucccguggccaggcgcucccgcgggaaccauuggggcggcucuugcucccgcucggguggagcccgcagccccccgggaccccuggcggggagggacagcuggguccaggcuuuggccaucagucugcaccgaccggggugcggagcgcacaugcgacccgggcgcaauuacuugggccuccucgccccgcccccccaccagcauccugauccccccccuucccccucacccccagcaucaggaggucgcuguggugccccaguccugggccccagcuaggagaggcugaaggaggacaguggacgauucucacgcuuuggaaaagugucagcccuccugcaugggaggccuccccgagucucuuacugagagcuggggccuugggaggcuuuguugcaggagaggagauggucaggguucccaggcaaggcugccuugguccccagccaauuaaaguccuggucccccuagccacucucugcagagccccucuuggggagucucuuccugccgcccugaugcaagccccaguucugcccccuugucccuucgggugggugcaguguuggcucugaacccuccgugcccucugcugcuggccgcaccucucccugccccucccaggccccauguuguggaaaggucagccauaagggucagggguccccacucuugugucuccagcaccccacccucagcaaagccagagccccuggugugcccacccucagauccugcaguugcauucucacccaccccugcccuauugaggcuccaacccaggaaauaaguggacagcccagauccgaggguccacccugcuggacagaagcgaugggcagagaauaggguguugaauggaggugacagguaugggaugcaguuacugguggugauggagcacaguuggguuagaagaugaggacauugacuuggagaagagaucaaggcuuggaagggacaggcagucugcagugguucauccacgagaacauuagaccaccaggaauucaggcagcgauggguggggacgaagccauagugagagcugcugcugggugguugguggccaaugacacgugcuccagcugggacgcucaaggagaggagggaauuggggucugc

SEQ ID NO: 17837 - RNA, 3037 nt, Homo sapiens
uuuuauuuuaacaaaaugcucaaauaucugaaauugggcaaagguggagggugggcaagcuggcugaggugucccaggucuguggcugccuagcugggugaggggcuggugagcagcugcuccagacaccacuggacuuccuccaggccccgguaggcccgcuucagaccccggggaaggcagcggcaggacuccagguugagguagagcaggcccgggcagcugcugaucacagagcuguggggagggcagaccacaggaaguugagcuguugccucagaagggcugggccaggcuagggagcugugccugcugguguucgacaccuggcucugccacccauagccaccaaggccaagcccaguuccccugguguccucaggcccaccccacgcaggggcuuggacaguaugcaugccccucugaccccuggaggucucaggccaggcaggacacaacuuccaggccccaggcagacacagugacagccacacuggcuccagggacugggguaggggaugcugaccugacagugcuuggugugacccgggugccccugagguuaagagagcacagggcugggugugagcccccaggggugcuuaagaaggcagccagggccugcuccagguccuucucacugaaccccuggccacucaaguccaguucucgcaguguauggcaccacuucugggucaaaaaggggcugcccuccuuggcuagagucagccggucugacgugccauacaggcccagaugaagcugcuccagcucugcagugaaaggagugagcauaagcuacaaggugacaagggcccccacaccucacccgcccggccaccacccaggacugcugaccccgacauggcagauccugaaggccagccggcgugaugcgcgcacagccacgaagauccaguaagcgcagguugggagagccguggaguaggcggcccaggaccucguugcucacaaaguugcagguugagcucgccaggcagagcuccucuaggcuagggaagccugguccgggagccaccccucgucccggaggcuugggcagccacaucagguucaacagccgcagcaccugggggcaagguccaggcuguagaugggggagggugugacaggugggagaggcagggcgccagguaccuggagcugagggcagccuuucugcagagccucgacaggcagcugaaggggaaugcuauuacgguugaugccggugcucaccuccaggaccuggagcugggggcagcagcugcccugcagagauggggggaggggguaggucacagggucaguggccuggcaguccccagcucagcaucugccucugcucccaccaaugccaacuuaccagcagugcgcccaggauggcugucgucugggagcuguaggucagccacaacuugcgcauucgggacccugccuccuccaagaagcucaccacagcuguggacuccaccuggggccccaauacaagagcacccgucaccccggccuggguuuuuucagggccccuugggacacagggcucaccauggagugcuguagguccaggcuauggagcuggcagcaggcuuuggcuagcaugaccagagcgucagcagucacaccguggcagccggagagcuugaggaaagugagccgaggacagcacucaccuaccagcugcggggagacagaggggcagcugggguugggagacgacaggcuaagauccacaagggaaacagacaaguggcuggugccaaccccacucuaccgccuuagcugugaccuccuuucugcccaugccaggccuacuuggguguccccgccucugauaccucccugcuggaggaaacagcaggaaaagagaaccaggcaggcaagcagacauccccacggagcagcguugggcccccaaggugccugacccacuuccuagaguacugaacagucccagagugucacagcugaugugcaggacagccuggagcucucaccuucaacacgggguguaccugagacuuccaguggaugagggucagccucuggagcugugaaaaccugggccgacagcggaggcagagcugcacuaauguucccacacgaguccuucccacccaacaccuuggugcagggagacggaaggagccuggagccagggguaaggaagagagggaaccccucaccgauugggcauaagccacuccagggaagcaaggagcuucuucuccgccuugaccccgcccuuggcaggccggccgaccagcggggacgacagggucacggugugccagagcgcggguugggaagcggccuccugccagcggcggcacacgcgcgcagcccugggaggacagcgugcugagggugccggccccuccguaggcgaugccccccucucgcagcgcaguagacaccccggcucaaagccgggcuccugggacuccaacugggcgccuaaggggcugcgcucucggacugagcggugcgcgcuccgaugcuuucgcccuccgcccccgcccgggccaccgcucggaccacgucuggcccaagccgcuacgcucggcggcgggcccggcaccagcguuaccugcccaggaagggcauggggccguccgccgccaccaacaacccgaaaaucugcaccaggauuuccaagggaaugcggucuccccagcccgcgucgggcccuuccucgggcgugggcgugggugccggugcgggugcgggcgcggccgccgccucggaccugagcccggccuugggcuuggccgcggcgcuggggccccggggcggcugccggggagugcggcgggaagcgcgccgcugugcgcggggccgggcggggccggguucggacagcaccagcagcaugcugucggacugcagcaggugguaccccgagccccucggcgccagccggucccaccaccaguccucggccgagcggggccgcggcgcugcccgggcucugcgucggaccugccgggaggcuggggcagccaugaccaccgacggcgcucggggaagccccagg

SEQ ID NO: 17838 - RNA, 3037 nt, Homo sapiens
ccuggggcuuccccgagcgccgucgguggucauggcugccccagccucccggcagguccgacgcagagcccgggcagcgccgcggccccgcucggccgaggacugguggugggaccggcuggcgccgaggggcucgggguaccaccugcugcaguccgacagcaugcugcuggugcuguccgaacccggccccgcccggccccgcgcacagcggcgcgcuucccgccgcacuccccggcagccgccccggggccccagcgccgcggccaagcccaaggccgggcucagguccgaggcggcggccgcgcccgcacccgcaccggcacccacgcccacgcccgaggaagggcccgacgcgggcuggggagaccgcauucccuuggaaauccuggugcagauuuucggguuguugguggcggcggacggccccaugcccuuccugggcagguaacgcuggugccgggcccgccgccgagcguagcggcuugggccagacgugguccgagcgguggcccgggcgggggcggagggcgaaagcaucggagcgcgcaccgcucaguccgagagcgcagccccuuaggcgcccaguuggagucccaggagcccggcuuugagccggggugucuacugcgcugcgagaggggggcaucgccuacggaggggccggcacccucagcacgcuguccucccagggcugcgcgcgugugccgccgcuggcaggaggccgcuucccaacccgcgcucuggcacaccgugacccugucguccccgcuggucggccggccugccaagggcggggucaaggcggagaagaagcuccuugcuucccuggaguggcuuaugcccaaucggugagggguucccucucuuccuuaccccuggcuccaggcuccuuccgucucccugcaccaagguguugggugggaaggacucgugugggaacauuagugcagcucugccuccgcugucggcccagguuuucacagcuccagaggcugacccucauccacuggaagucucagguacaccccguguugaaggugagagcuccaggcuguccugcacaucagcugugacacucugggacuguucaguacucuaggaagugggucaggcaccuugggggcccaacgcugcuccguggggaugucugcuugccugccugguucucuuuuccugcuguuuccuccagcagggagguaucagaggcggggacacccaaguaggccuggcaugggcagaaaggaggucacagcuaaggcgguagagugggguuggcaccagccacuugucuguuucccuuguggaucuuagccugucgucucccaaccccagcugccccucugucuccccgcagcugguaggugagugcuguccucggcucacuuuccucaagcucuccggcugccacggugugacugcugacgcucuggucaugcuagccaaagccugcugccagcuccauagccuggaccuacagcacuccauggugagcccugugucccaaggggcccugaaaaaacccaggccggggugacgggugcucuuguauuggggccccagguggaguccacagcuguggugagcuucuuggaggaggcagggucccgaaugcgcaaguuguggcugaccuacagcucccagacgacagccauccugggcgcacugcugguaaguuggcauuggugggagcagaggcagaugcugagcuggggacugccaggccacugacccugugaccuacccccuccccccaucucugcagggcagcugcugcccccagcuccagguccuggaggugagcaccggcaucaaccguaauagcauuccccuucagcugccugucgaggcucugcagaaaggcugcccucagcuccagguaccuggcgcccugccucucccaccugucacacccucccccaucuacagccuggaccuugcccccaggugcugcggcuguugaaccugauguggcugcccaagccuccgggacgagggguggcucccggaccaggcuucccuagccuagaggagcucugccuggcgagcucaaccugcaacuuugugagcaacgagguccugggccgccuacuccacggcucucccaaccugcgcuuacuggaucuucguggcugugcgcgcaucacgccggcuggccuucaggaucugccaugucggggucagcaguccugggugguggccgggcgggugaggugugggggcccuugucaccuuguagcuuaugcucacuccuuucacugcagagcuggagcagcuucaucugggccuguauggcacgucagaccggcugacucuagccaaggagggcagccccuuuuugacccagaaguggugccauacacugcgagaacuggacuugaguggccagggguucagugagaaggaccuggagcaggcccuggcugccuucuuaagcaccccugggggcucacacccagcccugugcucucuuaaccucaggggcacccgggucacaccaagcacugucaggucagcauccccuaccccagucccuggagccaguguggcugucacugugucugccuggggccuggaaguuguguccugccuggccugagaccuccaggggucagaggggcaugcauacuguccaagccccugcguggggugggccugaggacaccaggggaacugggcuuggccuugguggcuauggguggcagagccaggugucgaacaccagcaggcacagcucccuagccuggcccagcccuucugaggcaacagcucaacuuccuguggucugcccuccccacagcucugugaucagcagcugcccgggccugcucuaccucaaccuggaguccugccgcugccuuccccggggucugaagcgggccuaccggggccuggaggaaguccaguggugucuggagcagcugcucaccagccccucacccagcuaggcagccacagaccugggacaccucagccagcuugcccacccuccaccuuugcccaauuucagauauuugagcauuuuguuaaaauaaaa

SEQ ID NO: 17839 - RNA, 5282 nt, Homo sapiens
caugaugcagcaggcaccuuuucaguuucuuugacuccaucgcaguccccaacagggaccacagcccaggacccaggaggagggagguccauguccccacccccaacaggggccaccgagggugucugggcagccucuguugggaggggcagaggcagggaccugggagcucucaggcucugggggcaucugugcaccucugcccugugucccccagcuuggaggcagcccccagauggacagccagaaggggacaccccagcccugccccacagcuuggggggcagcaggcagaggacagaagcccacccaggcuggccuggcguggugagccacgccgguaaucccagcacuuugggaggccaaggcgggcgaaucaccugagguugggaguucaagaccagccugaccaacauggagaaacacugucucuacuaaaaauacaaaaguaaccgggcgugguggcgcugccuguaaucccagcuacucgggaggcugaggcaggagaagcacuugaacccgggaggcggagguugccgugagccaagaucacgccauugcacuccagccugggcagcaagagcaaaacuccaacucgaaaaaaaaaagaccaccgaggcugccuguccaggggaaggggcccagcccucgacccccacaggcaguggcuccaggcuguuggggaggaucugccacuggaaugguuaacccaggcaucuccagcagccaaucacagagcucugcaggaauaccugggagagguccucaugcagcccgggcggguccuagcccagccccagucuggcccuggacaaccccagcaaagccgcccucagccagcccagaagcacugggccuuggccacagcaacacccacugagcacgcugggagcugaguauggcgucccuggucucgcuggagcuggggcugcuucuggcugugcugguggugacggcgacggcguccccgccugcuggucugcugagccugcucaccucuggccagggcgcucuggaucaagaggcucugggcggccuguuaaauacgcuggcggaccgugugcacugcgccaacgggccguguggaaagguaacagccccacccgacgggucccccagcccuggccucuucccgccagcuccgcccugccagccggcagcaaagggcccugggcaaacuccaggaggcggaggaggcuaguggcaguaccugggcacccugacccuccccacaggccagagcccacccuccugcucaugagggcagacaggccuuuccagggacacagucccucuucuccccaggaccccagggccaacucccccugccggcccucugccaucaaauuggcaguggcuccaggggaguccccuggggaugggggaccacuguuggggaccccucugcgugcaccccuguaguuggggaagcaggacaggggccuggggagacggaagggcgccagggguugagagaggaugguggacguuguuggacuugaaagggaaacaggcccucggggaagccccuggccaggccugccucuccccucccuggugggcccagcgccccugcucacuugucucugcccacagugccugucuguggaggacgcccugggccugggcgagccugaggggucagggcugcccccgggcccgguccuggaggccagguacgucgcccgccucagugccgccgccguccuguaccucagcaaccccgagggcaccugugaggacgcucgggcuggccucugggccucucaugcagaccaccuccuggcccugcucgagagccccaaggcccugaccccgggccugagcuggcugcugcagaggaugcaggcccgggcugccggccagacccccaagacggugagggagaguccaggcagaccaggggagugggugaggagggucccacggcccaugggacccggccuggcugcaaagccuucggggagccugggggccuggggagacgcccaggagucggccugcggcuggggauucacaacguggggcucacuacugggcaguugggagccuguaggagccccgggagggaccucaugagggaggaacccagaggccugagugggagccugaagcagcugggcccggcagggagggcuguggcuccagggaggggcggggcuggugggggcagauccuguaguuggggugggagaugcauccaggggcagcgggguggauggcagaaggucacaccaaaggcugaggcggaggcccccucuuccccaggccugcguagauaucccucagcugcuggaggaggcggugggggcgggggcuccgggcagugcuggcggcguccuggcugcccugcuggaccaugucaggagcgggucuugcuuccacgccuugccgagcccucaguacuucguggacuuuguguuccagcagcacagcagcgaggucccuaugacgcuggccggugaggccugggcugggcuguggaggggggcacccccgaguccccagccuccacgucccuggggggcagggccggagcccacacagacucgcggugccaacucuucucccugccagagcugucagccuugaugcagcgccugggggugggcagggaggcccacagugaccacagucaucggcacaggggagccagcagcugggacccugugccccucaucagcuccagcaacagcuccagugugugggacacggugagcugcgcccugggguaagauggggccucaccggggucugcuugggccccugagccuguccugccaccccccagguaugccugagugccagggacgugauggcugcauauggacugucggaacaggcuggggugaccccggaggccugggcccaacugagcccugcccugcuccaacagcagcugaguggagccugcaccucccaguccaggccccccguccaggaccagcucagccagucagagagugagugcccacgccgacauugugcuggcagcacagagguggagcccguguaggaaggaaggaguggcugcccaggaugagggauggagagagugagcaggggcuggaaguagaaacaacagacacaggggaagguggcgucgccaggagaguggggcuuugaggcaggagggucagccugagugagggccuggcccacacugacggccugcagcucuggugagcagcgcccgggaagcaggggcugagucuggaagaaaagcucucacagccgccucacccgcccccaggguaucuguacggcucccuggccacgcugcucaucugccucugcgcggucuuuggccuccugcugcugaccugcacuggcugcaggggggucacccacuacauccugcagaccuuccugagccuggcagugggugcacucacuggggacgcuguccugcaucugacgcccaaggucugcccccacaaacccgcgacccuggcccuccguuccccaccauggacucccaggccaugcccucccagggaccuuacccaccccaccuccugaccccucucccugggucuuggugggaggcacccugggaccucccccccagcccagcgccccuacuccccaggugcuggggcugcauacacacagcgaagagggccucagcccacagcccaccuggcgccuccuggcuaugcuggccgggcucuacgccuucuuccuguuugagaaccucuucaaucuccugcugcccagggacccggaggucaggcuucuugggaagguacccggcgggugggugugcugggggccugguggacacugagcaccuacccucacaggaccuggaggacgggcccugcggccacagcagccauagccacgggggccacagccacggugugucccugcagcuggcacccagcgagcuccggcagcccaagcccccccacgagggcucccgcgcagaccuggugagugggcgccagaugccccaucccgcgcggagccccucccaccgaccccuucccacgcccacacucccagccccaccccaggccugcggcuccgccucccgcggugaucuggggccccgccccgccccaccgcguuccuccuccacuuccgggcgggacuuacucaaggcuccucccagguggcggaggagagcccggagcugcugaacccugagcccaggagacugagcccaggugagcccagggggcgaccccggaagggcugggggaucugggguuuguguggagcgcggguggggcccaaggcuuggcgguaggcgacaggccacgcgaacccacgggccucugcgcccgcagaguugaggcuacugcccuauaugaucacucugggcgacgccgugcacaacuucgccgacgggcuggccgugggcgccgccuucgcguccuccuggaagaccgggcuggccaccucgcuggccguguucugccacgaguugccacacgagcugggugagcgcaggcggggccuggaaggagaugggcggggccgcacggggcugggcggggagaccuggaacaggugggcggggccuggaagaugggcggggccgcaccuggcuggguggggagaccggaaacagguggggcggggccuggaaggugaugggcgggaucugacggcugggcggggagaccgggaacaggugggcggggccuggugguaagagggcgggaccgaaaggaggugggcggggcauguagcuaggagggcggagcuguuaauguggacucgcccgcaggggacuucgccgccuugcugcacgcggggcuguccgugcgccaagcacugcugcugaaccuggccuccgcgcucacggccuucgcuggucucuacguggcacucgcgguuggagucagcgaggagagcgaggccuggauccuggcaguggccaccggccuguuccucuacguagcacucugcgacauggucaggauggcgaggggaggggcugcucugggccgggagcugagcagaggagcugagcaggggcgcugacccggugcccacuugcuccucagcucccggcgauguugaaaguacgggacccgcggcccuggcuccucuuccugcugcacaacgugggccugcugggcggcuggaccguccugcugcugcugucccuguacgaggaugacaucaccuucugauacccugcccuagucccccaccuuugacuuaagaucccacaccucacaaaccuacagcccagaaaccagaagccccuauagaggccccagucccaacuccaguaaagacacucuuguccuuggagcauggcu

SEQ ID NO: 17840 - RNA, 18669 nt, Homo sapiens
agugcugugcagggcugcaggccuggugcagauugccacaggcugagggcagcaggggaggccagcagagcccagaaggcccagcugugugucugucuucugguaaggaaacacagacaaaacauggguuggaauauuuuuuuaaacuacaguuguuacauacagaaaauauccaaagagaacgcagaccacaaaagugacacauaagucauuuccaacaaugguaaaaacacuucuugcucugcucuuuaaaaaauuauuauuuuuuugagacggaaucucgcuuugucacccaggcugcagugcaguggcacaaucucagcucacugaaaccucugccuccuggguucaagcgauucuccugccucagccuccugaguagcugggauuacaggcgcgcgccaccacgcccagcuaauuuuuguauuuuuaguagagaugggguuucaccauguuggucaggcuggucucaaacuccuaaccucaggugauccgcccgccucggccucccaaagugcugggauuauaggcgugacccaccgugccuggccuauuuuuauaaaugagggauguggugcucaccaggggguggggaugagacaagggagggagaaggguggggccuggcuuaggcuaugccccccacaucugcggaguguggacccccacgcccccauccucagagaagacaaaggagcaggucgggacgucaagaugucucagggucuuggacacaagccguguguuuggcgguccugucauguguggcccacguuggcaacgccacgggaagcccgugcuccaguucccgguggccgaggacccaccgugguccucccaggugccuggcucccccaggccauaaggcucagcugcugcaugucauggucacagggcagaugccugcugaguacgcugggccgcacuugcagacuugaggcacccacaucccacaucuggaagggccuuguguggacacugcccuugcccucaggccagccccucccauccugaacucccacagggcugguugccccgggacugcggagguggggcugcaggagcucaaccagccccgggucuccuuucuccacguggccccccaaccugcagagacgucugccuccaggccccuggcgucccagccuggcuguccccaugaagaacaagccucccaccuuccccaccccagagacaugcuggggccugucccuccguugagucagucucucacacacacaaccaaacaggugacagggcaagcccgccccacccgugcgccccacaccaucaccuuggacccagaaacacuacgcuagagggcgucgggcuuccaaagagauguagagccauagcccaacccucugcgccuguggguggagcaugagggaggacagccccaaagcgcagcccugaggugcccaaguucacccugguggugccagagucagaggcagcugcucccaaggaugugcugggggcuggguggggucuuucuuuguggucagcagaaaaccaaacauggggccuucccaugcccuugguggccaggccacaucagcucugcaggagauaaggcuccggcagcgaggcacucccagcaggccacacgcccuggccugggaguagaaacccacagcauucucagaaacagcuccagaaaguuucagcccgugaggggcagugcggcggcccgggagggaagagcugacugggagggucaugcugggcugugccauggucagccgcccggaugauggcgcuuacauucugcccccaguuccucuccauuucucagcccucgacccgugaccagcaaagcacaggacaaugugggccaggccccagcagccagugggggcggguugggcugcugugaggcaaguuaaugcaccugacuggagcagaggaaaccaguucuuugguauugaagcaacaaaaagcuaucacggaagagccacaucuccuaagcaaaggugggggcgucaagcuguauccuucccaguagcccugggagucccaggggaagaaaggaccagggauuaccccuccaggcaggguuccuucccauccuguuaggccagcccugcucagccaccacggggcacaucagggggcggccagggugaggaugggaagggcccaccuccuccaggugagaagcugggcugcccaaccucugaccucugcagcgagcccugaaugcagggccagcagcaggaccccgagagcagcaugggggacacaccucagacucucacccagccaggcgcccaagcacugacccaagcuuuccacacagccuggggacgcugggcccucaaggcugaaucuacaguaaauagacucuuucucacuaaaauuguguaacuuauccaagagccugcaaggaguuuaaucuuuuuccugggaagagacaauuucacccugcuuucggaaaaugccugcugagcccugguggcugaguccugucucccugggagcggccgguuggccagggcagccccgacccuaccuggaucuuccugcccaagccucagucucaagaccccaugacagaguguagggggaggcagugucucugagucuuuccucgggggacgugugcgggcacacagaugggggcggggcaggcucugacccccaggccaaaccaaagcccccacgcuguccauucacagccaugccuuccccucgaacaaaacagaaaguacgaaacaaggcugccuuuuaauugcuaucagauauucggauaucccgucugaugucagcaaggcccccgcgccccgccggaacccgcagggauggagcagcaccgccgccugacugcacagaagggcuggggcagggucgcugugccucucggccuccuugcugccaccgucucugagccucggggcgccuggugcaccgucuccucuucgggucagcccagccucuggcggcccucggaaggaggggaggcaggggucgggggggugagccggaggcgggggccccgucgcgcacgcaugcagacuugcccuguguuggcuucguuuguucuccuccuuugcuaaagugaucagauaguccugugaagcagcugccagccagguggacagggcagcggugcugggaugccgcccgugggcuccucggacauccugaggccccgcccuacuucuguaucuggaacaggaagagccgcagguugauguucuuggcagccagcagcuuguugcacuccacggagucaaugaugggcaguggcacguaguccgucucguugcucucguuggugaagacaaagugguagaugacggggcugauccucacgucgucguaggggcccuugagcagcaggaaggagcacuccagcggugccgugaccuugcucuugaggaggagcuggaaggagagcguacgcuugcaggacagguugggguuacgcuccgagucguugacucgagccuucaggacccacgucugguucagcacugugaaccugggcgucucauaguacaggcgcgugaugaagucgucugugcgguacggccggaacuggaccucuguggagacagacagggccggaaagagccggcuguuagugugggcagggcugggcagcaacgccuucccugaccaggccgagggcaggcucagccggggaggaaggcaacuuacccggacaccgggcucugcuugucacaagcaagccaaacgcaacuauggcaaauggaggugcacacaagcuuugaggggaacaaccacaaacagaaucaacauggauuagcuggagaguccagaggcugcacgugucaggccacaccccaggcgugcccgacccacgcuggccucccucaccgccccgagccccgggugucccccagggcgggguaagcagacacacagacaggaugcgguuccgagaacaagugcacuuuauugguucugauacagaggagcugccagaaaagccagcaggcggcugcggcacccagcccugcccgaggggagcaccaggucugcaggcaccgggccugauccggagcugccaaucagcaggcagcccugccugcacaguccucuugggcagcccacagccuguggccggcaagucccuccguggaggcguggguucccagguggccagucuuuccugcgcgaauggggcuucucaccuggccacggccacagccacagugccccagccugccuagacuccacgaggccccgguaucuccaggacagcuaaggcugcuacucaccacgggcuguggcugccgcagagaccccaggcccucggccucucuggccugcucgggcccacaucccgcugggcacaguccaggcagcagggcgggacuggcugcccacgaccacccugcuugcgccacgccuggugcucugagcuggccgccuggugugggcugagaguagagggauggagcuuccuccaguggccccagcaucaacaggugcuucucgcuguccucugggccaggcucuggccuggcuccugcuccccgacacguucaaaggcgguggcagcggcccagagagccacgagauccagugugccugcgcacgcauccagccugggcgucuguggguguccacucccgguucuacaguuugagucgggcacccucagcuuguuguggagcccucucccugaauggcuucgugccagccuugagaggcccauggccggggcagugacugccugcagguaggaccucacucggcagggugcucuucuugccccaggguccgaggggcaggccccuagcucccaggcccccugagaccugcccacuuucugguuagacccugacugucuugaggcucuggagccccacagugagaugccaccuugcagggauggugaagccaggguggcgaggacaggugggcggggcugcugugagagccacacaggugugcaccuggggucugccucggccccuccuuccacucagucuccggccugucuucucgaccgagguguccaccuguccaccgggagcuuguccagagcccggcuguccggcgcugucagugcccagugcccagagccugcugcccccagacuccuggcugccagccccccaacccacaccuguguggcaugcagcaggcggcggggcgccucaccuguguagccaaucuucucgaagcugagcaggcugaagaugcuguuguacagcugcaucuccuugcgguggcucugguccaucccauccaggaucuccaucagcucacugccugucuuggucgggugggcgcacgcagccucgugcaccgucagcucauggaaggggccgugccaugggcagccgaugcguuuguacuugcacuggguuacccugggggaggcagguacaucacucacagacugagccccgaacaggaggcugcaacaagcuguccucccauauggcuuccauccagcuaagaaccccuuccugcaggacacacguaacugugagcccaccccccaggaugaggucagaguggcagcauguggagagaaaggagacaggcagaaaaagggagagagaggggaaggaagagugcaagcuugagccugugugccccgcaccauggcgugguucucuccucuguuuggcaguggugguccugcacagccucacugcaggagacuugguggcugccuccacuggauggguagccaugggcaguguacccucacaccaagcucccugagguccugcguuggacacgcuguccugggcccuucaaggggcucccccacagccacaaagagcacuggaaggcuaggcucauguccggauaacaacugggugcaaaacccaccuguccccauccugugcaggcacccucccacagggccgucacugggcuacacaggugguccccaaggcccagacagcagagacagccagaccacccugcacagggcccugcugcaccagggugggcucccagcaguccugggccccgccuguaaggcuaagccccugacccucaguuaccuguccuggcauuccucuuucuggugccucuccaggagggagcggggaaacuggcgcaggcagaagccacacucugaaggcagcucgcucacggcuuucuccacggccagguuccggcagcagaggcucuuacugaucucacaacgacaauuggggcacguggccugcuccuccuucagccgggcaucugcuaguagguggauaaaacagccagcgcacaucaagugaccauuaguacacugcgaagaaggaaagggagacgaagcucacagaccugcgggcucaugcucgcacacacccgcccaugcccaucagcuccagccagguguccugagggacuccagcuggugcagaggggcgcacgugccugucccgagucgugcuggaguguggugaacacugcgagcugcucaggagaaacaggcagagccagcuuggguucuugcagagauuagagguccuaaaagcaaggccucaucagcucacagaggugacagcucgcccuggcagugacggguucagccaccuggggccgagggucacgcuuuucccuuagggaccagcgacugcccugaccccccuacagguccagaguuugggagcccuccaggaacacugggcucuuggccaucacugucagguggggagcggaugcagcucccacacuggggcaggcaugcucucugggccuucagaaaggccauuuauccuggguugagaggacuuggcucagggugagcccaggugagaggaggcagcugcccccucguccagggagguuggcuaccugcagagaccuccucagagcugggaggcaggagccaagcuggcccaggacaaggacaagggcagguaggcacacagggagugccuggggagcagaaaugggggcucugagugggugccgagccugcugggguaaccggggcuggcaggagcagggcaccucccgcugggcucccugccugugugggcucccagcacgcccaguggccuauccuggcucucacucccucaacauaagccucgagcguccacuuggugccacugagagacacauggcaagcugcggucccagcccgugggggcucacagcaugggaggugggaagcccagaccagaaccaagagguccaagaacaaacaaagccuuuuguaccugagcagacacaguucccacagcccuggcuggaguggggugugugggcugaggcauuccagggccagccaggagugacagggaugugaugugccucccacccaaagacucuuagagcucgcugaggggagcagucagcagaguugcuccuguccugaugccucuccagcagccggcccaggcuugccagccaugcaaaccuccagaaagccacugggcuacaggcuuccuuugggaccugggacccucuugagaaugggauguggugcagcagagcagccugcccaggcccagccucucuacaaggugugugucagggaggggacacucacagggcccugccugguggcgcugggaggccggcccugccugguggugcugggaggccagcccugcacacguggggcccugggaagucugagcugccauccuacugcuucagcugccugugcaccccaagcuaaggagcugucagacgcuggggcuguucacucagcaccuguggacuaggccuaaggccugcugagucaaaggaccuacauguggagaaccgacagugaggacaaagcccucuuucauggaauccacauccacaugaacaccacccguuaccugcauucaauccucaaguucucaguuugguuaaaaauuaaaauuacaggcgguggcucaugccuguaaucccagcacuuuggaaggccgaggcaggcaggucaccugagguuaggaguucaugaccagccuggccaacauggugaaaccccaucucuacuaaaaauacaaaaauuagccaugcaugguggcgagcgccuguaaucucagcuucucaggaggcugaggcaggagaauggcucgaacccgggaggcggagguugcagugagccgaaauggugccacuacacuccagccugggagacagagugagacucuaucucaugaauacauaaauaaauaaaaauuaaaacauacacaguugccugaggcagggagugagacuggcucugacuggguuggggacaagcugagaccugcccccaggagaaggugugaaaauccgccagccaaguccaggggucagugguggguggacuacaggcaggagggggcacagaugcuauugaagcagcuguccugugggaggcacagaccaagggcccacaccacuguccucucacagccccccgccccccggagguaugccacuccacguggccagcucuaaacaccuccuggugagacugccgggggccuuggacgagguucuggguccagcucugcacguacaguggccuuagcacaggcaaaacagcacucuucuuggcuguggcccgacccccaagggaguuccaggcagggcuggagcaucuaaugccacccaccaaggccaccuggccucucuuccuggcucugcauagcccaggaagauucgaggugggguccuagacccuccuaagggagcacugaggcugccaagcacaucaccacuuaccucccagcacugcgggccucucccccgaaagccaccccagcuccugggccggccccuggccacaggccucauuccuuuggggccuccagaucccagcaugggcucagucaauuccauaccaugaggaggcagcagugacccugcccuccucuggcucucucugggccuccaagaggaccugcaagcuccgaggagacacagggccauugccccuucagccccaauagcuccauucaagucagaacacagggagucccuagagugcccuggacuacacuggcccaguagccaagggacacagccacacucacccccagacccuccccacuggucaaaggacaucucuaggugcauggcccggucccgaccaacacucagcccaggaggucuguccacagcaggacggucccuggucacaugcuccggagccuccccaccaucuggguccccucagccccugcgcaagacucuggcucuacaccaaggccaggccacaggcagcugcauccuuggcccuggcagcaucuggccagaugcacuugauucugacuugugcccaacacccaacagaagcugggcccuggagggcgccgcacaguccaggggauggcgugggccaaggcccccaagagcccgggcaccuuccagagcagcugcuguggcacccaggccaggccaccucuccccaccagccaggaagaccccaagggaggggagaggaggggauccacaaccccccacgaccaagaaugacgccaugggggaugacaucaugggcgagacaucacagaggaugaugucagaggggugacaucgugggaaauugacaucacauggggaaugacaucaugggggagacaucacgggaaugauaucacgggaugaugucacaugaaugacaucacaggggggacaucaugggagacuggcaucacauggggggaugacaucaccgggggaugacaucacaggggcaugacauugcaggggaauugcaucauggggggugacaucacggaaugacaucacagagaugacaucacacuggcaucaugagggaaugacaucacaggggaugacauuacggggaugacaucaaagggaguauugacauuacaggggaugacauugugggaaauugacaucaugggggacugacaucauggggggauggcaucauggggggaaugacaccauggggaugacauuaaaagagguauugacaucacagaggugauaccacaggggaugacaucauguggugacagcacgggaaugacgucacauguaugacaucacaggggaaugaugucaugggggaaugacaucacgggggaaugacaucacagggccuccugggcccuccuagggcagaugugggcuugaagccacagugcugggcucagacgccagcccacagauccccaguaauaugaccuugggcuccccucuuggggccucaguuuccucaugugcacaggugaugaguauaggaccagcuucauucugugcugaugaggugggaugggacaggguggcacugccccacacccaacaggcagacaggaaauaucaccaccuugggcagccauggcagagccccuggggcugccaaccccaggagccagaccccaggccccucugcagaugcugauacacacagguggcccagaaauggccauuugcaccugcauccucaggacagcacccagcccuccccccugcuggcuacaggcagcucacgugacccccaugcagacccagggucuccaccugagcuacuucuucccugggguuaaaggggagcuagaugggcggaacaggcucaaggagcccugaccccauccccuggcugagggcccccacgauuuccugguggucccaaggucucuauggucagcugaccuuguaggaccccuuucacaccuggacugcaugguucucucagacccuggggaccuccuguuugccacuggaggauggcacagugcccaggcccaugggagcagugcccucgcucacccaggggucagggacccacaggcccuugacagaggucgucagagccaaaaugcagccaaagggcuucccuguggcacaaaccccaaaagcgcugcucagccaguuggaggucccccuuccucugccaucugcaugcaggcaaggccucaccagggccaguggugcuucagggcacaccccaugcaccccgcgugcucggccccuaaccucccgaaucaaacaugggucugagagggacuggcacguuguccaaggccgcacagcuguuaagcaugaagccaggacucgaacccuccacccaggcuggauuugaagucccucaccugcuacugcugucagaccucaaacgguggccaaucaauccccagagucgggcccacauucagaacaaggcugcuuagaucuaaaaguaacucaaaugauaaccaccacagaaaacaaaaauuccaacuagccagagauuccagaacaucuuccuugcuccuguguuuuagauaccuaagcagacguauuuacaaagauguuuucugccacuuuccucaccucaaagaacgagucagcugcaguccuguacugcugcccaggagacuggggaagaggggcccgaagcuccuuggacauguggauggugacuccacccccccaggacugcacacuguuggccugguuggggguguggggcucgggcagagaggagccaucucugcuuccugggcuguuaucaauggacugucaacauguggcauagagacaugggcgcuacaggcgggagggccacggcacacaccaacccacccacagaacagaguggacacacccuggucagauggggcaggaggggauccuuguagcaaggagagaacaaagucucaaagugggggcgcugccucugccgggcccaagaggugggcaggggcagggagaggacaccucaggcaggagagcaugggaauggcagggcacugugcagggccgaguuagagggagcggcuggaccacaucugugagaggccccugcccggcacuuacacccgagugagcccguuuuugccuuaagaaugccccaugaggggugggaacaaugcgcagucccuuccuccaggugccagcaccaaggcccagggccucaucugacagcagcaggaagggucagggccaggucugucuuacgcagcaucacacugggccucgucugaagggccaaaauggagggagagaagucagggaugaggcugcggcugcaacgucccgggcaccgcugaggcugucucuucccagaggaggugccccaugggcagaggugccaacaggccacacugcccucgggccgcagagcagggagccggcaggaacgaccugaccaccugcgcggccuggucaggccagaagcuccugcacagguguaacugcugccccaccagcccuccugccacccaccugagacuccagaagguggcugcacaccuugucaggccagucccccagaacauaucuaacacccacacagagaacauaaaagcugagucuugcuguacuggcugcagccccaaccugacgugaggcaggacucggcgguggcggaaaccuuuugcaugagggccucagucugacacccaagcagguuucccagccugugaggcaucaucguacgggcacaggcccaugggucagcuggcccugcaggcccaaaggcucagaccuggggcaccacccgaggcuucccugccagcacugguggcaucugguaucuggaugacaagcucucgaguuacugaggacccagccaauuccagaggcccauggaguugucccccacagccccagugccagggagaacacacaaagcucagcauggccacuccccucuucucaccagagucagggacugucuaagucagcccccagcuuggcuggugcccacccugagccauguguucugcuggggucaggaaaagcguucuagcaggaacagaggguggaaccugcugcauuccugacacuggcuggcucgagacagccaaucaacguggucaccaaggaaagcuaguagaauaugguagacugaacccaagcuggggugauggccagcaugggcccaaccagggacacgcagaaggcagcaugugggggcccacaccaucugugcccagauucuccagggagcagagcaggccagagcccaggucuccaggucuguguugaccuuccaggggcaccacucacagccgagagccacccgccggagguguucuucgcagcauucagggaggccugugcccacagcacuccucgcucagcugcucuguucccagggaagucacugaacagagcccccaggccagggagggccaccagccagggcagccccagcgccuucggucuccauuacaccuguucagcucccugccucuggccgcccagagcagaacuccacucugcacagugcaggccgguuugaaccagcuaggcucagaggccuggucaccaggagcuccggucagaagcagagccaucacucugugccgggccagucuagaugggggaugcagugcaccagggaccaguaccauguggcccaucaccaccagguccagcuacagcuccagcccacccaccaauggggagacaaggagacuucccuguucccccguggccucacaccauuggcuuggcuuguuggagucucccucgagauccaagaaaaaguucuggccaagcgcaguggcucaugccuguaaucucagcacuucagaaggccgaggcaggcggaucacccaacgucaggaguucgagaccagccuggccaacauggcgaaaccccgucucuacuaaaaaauacaaaaacagccgggcaugguggcaggcgccuguaaucccagcuacucgggaggcugagguagggagaauugcuugaacucgggaggcggagguugcagugagcagagaucguggcacuucacuccagccugggugacagagugagacuccgucucaaaaaaaaggagaguucuuccgccugggaggaucgaagguugugagccaggaaaaaggagcuggagagugggcacaucuuggaagcugaggcacugccaaagccaaggaguaacugcuaacucugggagccaguggcucugaaaagugcuccccuagcuggcccuggugccugacacccaggaggguggguuagagccagugcccucuccccacccaggcacacugggguccucccgacaaggucaugccacagcaagaaggacuuggagauccagaguuuggagaaauggcaaccuagacuagcccuacaccaccugcuacaaaaguagcuccucauccaggcccccaauucaaacacaagcagggaaacaaggccccauuagcuacuuccagcuccuguaaguguaaagaaagcugacagagaaccugcuucauuucucacagggacuggggaguugaaagagagggaaagacacagggaagguggggacacuguacucugccucugggugucaaccaguuugucccugcugcuaccugggaaagggcaugucaaacccaccugggccagguacccuaacagcccuaggcugcuuaagggcugagucccacugccaugcggaugugaagaugggggaggaggggugggccggcuccuggagcacuggcugccuaggaagccuggccuggccugggugaggugggcaggagccuagcguggggcauggcaaguccaguuggaugugggguuuggcugggacuggagaagguacccaaacuguggggcuuguugcaaaugguucaucccgacaaacagcaauccccucuccuuacuguucuucaggaugaacuggaaauggaccaagagaaaggauucuuccacccaggaggguagaaaaggaggcguccauaggauguucaggaguggagggacaaacucggggguguggcugccggaagaauggggaaggagcucucgagcacaggacucugagcccagggagcuugggaccggguggguugcggggagcaguugcgggcuaaggaucaguuugaggcuguggguugggagaguguucaggggaccguggggaagucuagaaaaaagaagggagagguaagcggaagacaagcgauucagaucgggaaguaccguggaucagaaaacagaaaaggggggucccgagcggaaaauaaagcccugagagaaagacaacgaggagcuucggagcagccgcuggagccccgcugggcgaggaaguggcuguaagggccagagaggguucccggccgccgggccccgcaggccuggccuccgaggagacgcggauccuggggccccgcggcgggggcugcagccccgggcugggccgggucggggucggccggcggcccuaccugguacacggaggccuugggcagguccaggcacacggugcagcacagcaccgaguagagccgcuccuccaguuucccgcugccggccgccgccgccgccgccgccgccucggccgccucggcugcccgcagccgcuucuugggcggcgcgucggggucgccggccgccuccugcagcuguagcugccgggcgcccgccaagcccgccucguccgggagcccaggccccgccgccucgcccagagccgccgccgccgccugcccggcggccgccccgggcccggcuccgaccccgaccccgaccccggccggcacggagcccgcgggccccgcggccgggccgcccccgccggccuccucggcgccggacauagcggccggccggcccggcgggcggaugccggcgcgcucccccgacuagaaguuaggggcgccgcgcgcucccgccgcucuccugccgccgccgccgcgaacccgcagccccgcucccugcgccgccgccucagugggcccggcccgcgcguagccccacagccgccgcggccaccgaccccggcacggccgccaucuuuguuuucgcugugcgcuuccccccgccccgccgccaccacccccucgucuuccccgucacgugagccccacgcggggccaaugggagcgccgcuuggggcaagaaagcgcagggacuagagccaaugggagagcgagggcccccgaaggcccgccccugcagaaggugggcggggagggggcgcggccugcgagagucgcggagggacucgcaccugggggcagggaggcccacgcgagcuguggcgccggcgcggcacccacgcuccacgagccaguggcggccgccgaccccuacggcggggugugccugugucucugucccccaagacucaggcuuguguuaggggcucucgcccccuuccccgcaggggaaggacacaagugaaaaaucccgccggccaccccucucugucgggugcgggaccccuuaggucuccacaggagcaagcggagagacuuccaggagaggggacuccagaccccuaacccaccggaaucuaauccucugcucguccgaacccccucuaacccugggguuggagacugaagggguccacugaggaaaacgaagguauuagggaauagggcuggcuuccacaggccggagguacacaggagggcgaaucagcucugggaaggaugugcguuucucgaaacgccugugguacagcccuccccugccuccacccuacucuucaguucuugaaggucacugccccagagggccaccugccaggccaggccaggauaucuggaacuccaccaugucccuggagaguaagggcccagggcuaugucuucucagcccaggggucuuccugacaauagucaaaaggaggccgggcugcaugagaccccauccuaguuccagcacauacccugucaggguaacugacuacuguccugaggggccuuaggaagcucacugaaagaucccucaaucccucucaaaaaugggcaguuuucauauuccugcaaaauuccuaagauuuauuggagacuaggccucuucucuggauccacaaccguguccagcccagaaucaggacccccaaacgugucugggacccugucccuuucauucuggucuagacaaguccccacacguggccaaaggacagcacccagacucugccccugaccagucaaugugcagcaaacccacuucaguaggcagaagagucuaccccuagggagaaggcgccaggagcaggcaggugggagggaaaguguucggcagggcagaaacccugccuggcuguauccaacugucacucccacuggaggcgcuguguaugcagggcccggcaguaagcccagcugccuacagccaaggcccagcgacagacauccuccuucgguagcagcagcagccuguccuccuccagccggcucaggaggccugccacacccagcaucgcccccccccacaucccauaaguguuggccgugaagacagcuacaaugaggauggucacugcgaccaccaacagcauugccugaccagccacagagcggcccucagggccgagguggccgccagccacugccagcaccaugccuccucccaggagcagguuggcagaggagcgguccccauucacccaguggaaaucgaaggccagaaggggaaggccgaugacgguggccacccaggcuccagcaaggcagucuucgugugugcucagcccuggggccagcguggugguggcagccaagaccuggagcaggaagccagcagcagccccucgacuugccugucaacacagggaagggagaacacgugggaaaaagaggccggggucacccuuuuaaacaggaaaggguuuggggcuuccauggagaccuggucuuagacgcacuucccaccaaccucucucuaauucaggaaacuagguccuugggguuugggagguauggggaugcgccccugcucagccccaguguacucaccucggcugugcucacggcugcgugcagagacaccacucccagcaccagaugggacagggcugugcuccacucggcccccggcuugggggccauggcaccucaggcggcaguauguacgaggacacagauaggagauacucaacuuuggagaggaaggaagcgcagaagccagcgaccuggagcccuacgcgcggcacucuaguaagcccagguuccagguccccauuacuggauguuaggagaaguucaguccuagacuuuccggaucccugaggccacugcacacaccuguggagaagaagaaccuaauucagccgggaaacgggggaaaacgacucagggucuaagcuggggggaacgucagcccuggggcccuggagcccaagugggagugcgggccuggggaagagagagcggcgaggcgcugcaggcccacgcggcggccucggccugcucccugcguuccgggaggcguuguccugggaacccggguccaggaggagcgacggcgcaggacuccgggaggccagccgugcgcaguuaccgggcugcgcggucccaacgcagcggcgagcgggaggcccgagccugcgcaacgcaccgcccaccgccgucggcccugccuccucugccgugcccccaguugcgggagcgagcgcggucgggaaccuccaccagcgagaggagcggaggcuagagcggccgggcggggcuagagcggcuggggggggagggucgaggccugggggagagggucgagaccuggggggggccgguuggaggccguaggagcggguggggucgggaggagcucggggaccagaaaacgcucuguuugggugggugcgugcgugggcauagugguuuggaaggagcgugaugaggggagaagggccggggcggggcugcgaggggcggggucugggcggggcugcgaggggcggggggucugggcggggcugagggagauaagguuuaggcggggcugagagcggcgggucugagagggagggggccuggguggggcggggccugggcgaggaugcgaugggggggucugggcguggcugcgaggggcgg

SEQ ID NO: 17841 - RNA, 18669 nt, Homo sapiens
ccgccccucgcagccacgcccagacccccccaucgcauccucgcccaggccccgccccacccaggcccccucccucucagacccgccgcucucagccccgccuaaaccuuaucucccucagccccgcccagaccccccgccccucgcagccccgcccagaccccgccccucgcagccccgccccggcccuucuccccucaucacgcuccuuccaaaccacuaugcccacgcacgcacccacccaaacagagcguuuucugguccccgagcuccucccgaccccacccgcuccuacggccuccaaccggccccccccaggucucgacccucucccccaggccucgacccuccccccccagccgcucuagccccgcccggccgcucuagccuccgcuccucucgcugguggagguucccgaccgcgcucgcucccgcaacugggggcacggcagaggaggcagggccgacggcggugggcggugcguugcgcaggcucgggccucccgcucgccgcugcguugggaccgcgcagcccgguaacugcgcacggcuggccucccggaguccugcgccgucgcuccuccuggacccggguucccaggacaacgccucccggaacgcagggagcaggccgaggccgccgcgugggccugcagcgccucgccgcucucucuuccccaggcccgcacucccacuugggcuccagggccccagggcugacguuccccccagcuuagacccugagucguuuucccccguuucccggcugaauuagguucuucuucuccacaggugugugcaguggccucagggauccggaaagucuaggacugaacuucuccuaacauccaguaauggggaccuggaaccugggcuuacuagagugccgcgcguagggcuccaggucgcuggcuucugcgcuuccuuccucuccaaaguugaguaucuccuaucuguguccucguacauacugccgccugaggugccauggcccccaagccgggggccgaguggagcacagcccugucccaucuggugcugggaguggugucucugcacgcagccgugagcacagccgaggugaguacacuggggcugagcaggggcgcauccccauaccucccaaaccccaaggaccuaguuuccugaauuagagagagguuggugggaagugcgucuaagaccaggucuccauggaagccccaaacccuuuccuguuuaaaagggugaccccggccucuuuuucccacguguucucccuucccuguguugacaggcaagucgaggggcugcugcuggcuuccugcuccaggucuuggcugccaccaccacgcuggccccagggcugagcacacacgaagacugccuugcuggagccuggguggccaccgucaucggccuuccccuucuggccuucgauuuccacugggugaauggggaccgcuccucugccaaccugcuccugggaggaggcauggugcuggcaguggcuggcggccaccucggcccugagggccgcucuguggcuggucaggcaaugcuguugguggucgcagugaccauccucauuguagcugucuucacggccaacacuuaugggaugugggggggggcgaugcuggguguggcaggccuccugagccggcuggaggaggacaggcugcugcugcuaccgaaggaggaugucugucgcugggccuuggcuguaggcagcugggcuuacugccgggcccugcauacacagcgccuccagugggagugacaguuggauacagccaggcaggguuucugcccugccgaacacuuucccucccaccugccugcuccuggcgccuucucccuagggguagacucuucugccuacugaaguggguuugcugcacauugacuggucaggggcagagucugggugcuguccuuuggccacguguggggacuugucuagaccagaaugaaagggacagggucccagacacguuuggggguccugauucugggcuggacacgguuguggauccagagaagaggccuagucuccaauaaaucuuaggaauuuugcaggaauaugaaaacugcccauuuuugagagggauugagggaucuuucagugagcuuccuaaggccccucaggacaguagucaguuacccugacaggguaugugcuggaacuaggauggggucucaugcagcccggccuccuuuugacuauugucaggaagaccccugggcugagaagacauagcccugggcccuuacucuccagggacaugguggaguuccagauauccuggccuggccuggcagguggcccucuggggcagugaccuucaagaacugaagaguaggguggaggcaggggagggcuguaccacaggcguuucgagaaacgcacauccuucccagagcugauucgcccuccuguguaccuccggccuguggaagccagcccuauucccuaauaccuucguuuuccucaguggaccccuucagucuccaaccccaggguuagaggggguucggacgagcagaggauuagauuccgguggguuaggggucuggaguccccucuccuggaagucucuccgcuugcuccuguggagaccuaaggggucccgcacccgacagagagggguggccggcgggauuuuucacuuguguccuuccccugcggggaagggggcgagagccccuaacacaagccugagucuugggggacagagacacaggcacaccccgccguaggggucggcggccgccacuggcucguggagcgugggugccgcgccggcgccacagcucgcgugggccucccugcccccaggugcgagucccuccgcgacucucgcaggccgcgcccccuccccgcccaccuucugcaggggcgggccuucgggggcccucgcucucccauuggcucuagucccugcgcuuucuugccccaagcggcgcucccauuggccccgcguggggcucacgugacggggaagacgagggggugguggcggcggggcggggggaagcgcacagcgaaaacaaagauggcggccgugccggggucgguggccgcggcggcuguggggcuacgcgcgggccgggcccacugaggcggcggcgcagggagcggggcugcggguucgcggcggcggcggcaggagagcggcgggagcgcgcggcgccccuaacuucuagucgggggagcgcgccggcauccgcccgccgggccggccggccgcuauguccggcgccgaggaggccggcgggggcggcccggccgcggggcccgcgggcuccgugccggccggggucggggucggggucggagccgggcccggggcggccgccgggcaggcggcggcggcggcucugggcgaggcggcggggccugggcucccggacgaggcgggcuuggcgggcgcccggcagcuacagcugcaggaggcggccggcgaccccgacgcgccgcccaagaagcggcugcgggcagccgaggcggccgaggcggcggcggcggcggcggcggccggcagcgggaaacuggaggagcggcucuacucggugcugugcugcaccgugugccuggaccugcccaaggccuccguguaccagguagggccgccggccgaccccgacccggcccagcccggggcugcagcccccgccgcggggccccaggauccgcgucuccucggaggccaggccugcggggcccggcggccgggaacccucucuggcccuuacagccacuuccucgcccagcggggcuccagcggcugcuccgaagcuccucguugucuuucucucagggcuuuauuuuccgcucgggaccccccuuuucuguuuucugauccacgguacuucccgaucugaaucgcuugucuuccgcuuaccucucccuucuuuuuucuagacuuccccacgguccccugaacacucucccaacccacagccucaaacugauccuuagcccgcaacugcuccccgcaacccacccggucccaagcucccugggcucagaguccugugcucgagagcuccuuccccauucuuccggcagccacacccccgaguuugucccuccacuccugaacauccuauggacgccuccuuuucuacccuccuggguggaagaauccuuucucuugguccauuuccaguucauccugaagaacaguaaggagaggggauugcuguuugucgggaugaaccauuugcaacaagccccacaguuuggguaccuucuccagucccagccaaaccccacauccaacuggacuugccaugccccacgcuaggcuccugcccaccucacccaggccaggccaggcuuccuaggcagccagugcuccaggagccggcccaccccuccucccccaucuucacauccgcauggcagugggacucagcccuuaagcagccuagggcuguuaggguaccuggcccagguggguuugacaugcccuuucccagguagcagcagggacaaacugguugacacccagaggcagaguacaguguccccaccuucccugugucuuucccucucuuucaacuccccagucccugugagaaaugaagcagguucucugucagcuuucuuuacacuuacaggagcuggaaguagcuaauggggccuuguuucccugcuuguguuugaauugggggccuggaugaggagcuacuuuuguagcaggugguguagggcuagucuagguugccauuucuccaaacucuggaucuccaaguccuucuugcuguggcaugaccuugucgggaggaccccagugugccuggguggggagagggcacuggcucuaacccacccuccugggugucaggcaccagggccagcuaggggagcacuuuucagagccacuggcucccagaguuagcaguuacuccuuggcuuuggcagugccucagcuuccaagaugugcccacucuccagcuccuuuuuccuggcucacaaccuucgauccucccaggcggaagaacucuccuuuuuuuugagacggagucucacucugucacccaggcuggagugaagugccacgaucucugcucacugcaaccuccgccucccgaguucaagcaauucucccuaccucagccucccgaguagcugggauuacaggcgccugccaccaugcccggcuguuuuuguauuuuuuaguagagacgggguuucgccauguuggccaggcuggucucgaacuccugacguugggugauccgccugccucggccuucugaagugcugagauuacaggcaugagccacugcgcuuggccagaacuuuuucuuggaucucgagggagacuccaacaagccaagccaauggugugaggccacgggggaacagggaagucuccuugucuccccauuggugggugggcuggagcuguagcuggaccugguggugaugggccacaugguacuggucccuggugcacugcaucccccaucuagacuggcccggcacagagugauggcucugcuucugaccggagcuccuggugaccaggccucugagccuagcugguucaaaccggccugcacugugcagaguggaguucugcucugggcggccagaggcagggagcugaacagguguaauggagaccgaaggcgcuggggcugcccuggcugguggcccucccuggccugggggcucuguucagugacuucccugggaacagagcagcugagcgaggagugcugugggcacaggccucccugaaugcugcgaagaacaccuccggcggguggcucucggcugugaguggugccccuggaaggucaacacagaccuggagaccugggcucuggccugcucugcucccuggagaaucugggcacagauggugugggcccccacaugcugccuucugcgugucccugguugggcccaugcuggccaucaccccagcuuggguucagucuaccauauucuacuagcuuuccuuggugaccacguugauuggcugucucgagccagccagugucaggaaugcagcagguuccacccucuguuccugcuagaacgcuuuuccugaccccagcagaacacauggcucagggugggcaccagccaagcugggggcugacuuagacagucccugacucuggugagaagaggggaguggccaugcugagcuuuguguguucucccuggcacuggggcugugggggacaacuccaugggccucuggaauuggcuggguccucaguaacucgagagcuugucauccagauaccagaugccaccagugcuggcagggaagccucggguggugccccaggucugagccuuugggccugcagggccagcugacccaugggccugugcccguacgaugaugccucacaggcugggaaaccugcuugggugucagacugaggcccucaugcaaaagguuuccgccaccgccgaguccugccucacgucagguuggggcugcagccaguacagcaagacucagcuuuuauguucucuguguggguguuagauauguucugggggacuggccugacaaggugugcagccaccuucuggagucucagguggguggcaggagggcugguggggcagcaguuacaccugugcaggagcuucuggccugaccaggccgcgcagguggucaggucguuccugccggcucccugcucugcggcccgagggcaguguggccuguuggcaccucugcccauggggcaccuccucugggaagagacagccucagcggugcccgggacguugcagccgcagccucaucccugacuucucucccuccauuuuggcccuucagacgaggcccagugugaugcugcguaagacagaccuggcccugacccuuccugcugcugucagaugaggcccugggccuuggugcuggcaccuggaggaagggacugcgcauuguucccaccccucauggggcauucuuaaggcaaaaacgggcucacucggguguaagugccgggcaggggccucucacagaugugguccagccgcucccucuaacucggcccugcacagugcccugccauucccaugcucuccugccugagguguccucucccugccccugcccaccucuugggcccggcagaggcagcgcccccacuuugagacuuuguucucuccuugcuacaaggauccccuccugccccaucugaccaggguguguccacucuguucuguggguggguuggugugugccguggcccucccgccuguagcgcccaugucucuaugccacauguugacaguccauugauaacagcccaggaagcagagauggcuccucucugcccgagccccacacccccaaccaggccaacagugugcaguccuggggggguggagucaccauccacauguccaaggagcuucgggccccucuuccccagucuccugggcagcaguacaggacugcagcugacucguucuuugaggugaggaaaguggcagaaaacaucuuuguaaauacgucugcuuagguaucuaaaacacaggagcaaggaagauguucuggaaucucuggcuaguuggaauuuuuguuuucuguggugguuaucauuugaguuacuuuuagaucuaagcagccuuguucugaaugugggcccgacucuggggauugauuggccaccguuugaggucugacagcaguagcaggugagggacuucaaauccagccuggguggaggguucgaguccuggcuucaugcuuaacagcugugcggccuuggacaacgugccagucccucucagacccauguuugauucgggagguuaggggccgagcacgcggggugcauggggugugcccugaagcaccacuggcccuggugaggccuugccugcaugcagauggcagaggaagggggaccuccaacuggcugagcagcgcuuuugggguuugugccacagggaagcccuuuggcugcauuuuggcucugacgaccucugucaagggccugugggucccugaccccugggugagcgagggcacugcucccaugggccugggcacugugccauccuccaguggcaaacaggagguccccagggucugagagaaccaugcaguccaggugugaaagggguccuacaaggucagcugaccauagagaccuugggaccaccaggaaaucgugggggcccucagccaggggauggggucagggcuccuugagccuguuccgcccaucuagcuccccuuuaaccccagggaagaaguagcucagguggagacccugggucugcaugggggucacgugagcugccuguagccagcaggggggagggcugggugcuguccugaggaugcaggugcaaauggccauuucugggccaccuguguguaucagcaucugcagaggggccuggggucuggcuccugggguuggcagccccaggggcucugccauggcugcccaagguggugauauuuccugucugccuguuggguguggggcagugccacccugucccaucccaccucaucagcacagaaugaagcugguccuauacucaucaccugugcacaugaggaaacugaggccccaagaggggagcccaaggucauauuacuggggaucugugggcuggcgucugagcccagcacuguggcuucaagcccacaucugcccuaggagggcccaggaggcccugugaugucauucccccgugaugucauucccccaugacaucauuccccugugaugucauacaugugacgucauucccgugcugucaccacaugaugucauccccugugguaucaccucugugaugucaauaccucuuuuaaugucauccccauggugucauuccccccaugaugccauccccccaugaugucagucccccaugaugucaauuucccacaaugucauccccuguaaugucaauacucccuuugaugucauccccguaaugucauccccugugaugucauucccucaugaugccagugugaugucaucucugugaugucauuccgugaugucaccccccaugaugcaauuccccugcaaugucaugccccugugaugucaucccccggugaugucauccccccaugugaugccagucucccaugauguccccccugugaugucauucaugugacaucaucccgugauaucauucccgugaugucucccccaugaugucauuccccaugugaugucaauuucccacgaugucaccccucugacaucauccucugugaugucucgcccaugaugucaucccccauggcgucauucuuggucgugggggguuguggauccccuccucuccccucccuuggggucuuccuggcugguggggagagguggccuggccugggugccacagcagcugcucuggaaggugcccgggcucuugggggccuuggcccacgccauccccuggacugugcggcgcccuccagggcccagcuucuguuggguguugggcacaagucagaaucaagugcaucuggccagaugcugccagggccaaggaugcagcugccuguggccuggccuugguguagagccagagucuugcgcaggggcugaggggacccagaugguggggaggcuccggagcaugugaccagggaccguccugcuguggacagaccuccugggcugaguguuggucgggaccgggccaugcaccuagagauguccuuugaccaguggggagggucugggggugaguguggcugugucccuuggcuacugggccaguguaguccagggcacucuagggacucccuguguucugacuugaauggagcuauuggggcugaaggggcaauggcccugugucuccucggagcuugcagguccucuuggaggcccagagagagccagaggagggcagggucacugcugccuccucaugguauggaauugacugagcccaugcugggaucuggaggccccaaaggaaugaggccuguggccaggggccggcccaggagcugggguggcuuucgggggagaggcccgcagugcugggagguaaguggugaugugcuuggcagccucagugcucccuuaggagggucuaggaccccaccucgaaucuuccugggcuaugcagagccaggaagagaggccagguggccuugguggguggcauuagaugcuccagcccugccuggaacucccuugggggucgggccacagccaagaagagugcuguuuugccugugcuaaggccacuguacgugcagagcuggacccagaaccucguccaaggcccccggcagucucaccaggagguguuuagagcuggccacguggaguggcauaccuccggggggcggggggcugugagaggacaguggugugggcccuuggucugugccucccacaggacagcugcuucaauagcaucugugcccccuccugccuguaguccacccaccacugaccccuggacuuggcuggcggauuuucacaccuucuccugggggcaggucucagcuuguccccaacccagucagagccagucucacucccugccucaggcaacuguguauguuuuaauuuuuauuuauuuauguauucaugagauagagucucacucugucucccaggcuggaguguaguggcaccauuucggcucacugcaaccuccgccucccggguucgagccauucuccugccucagccuccugagaagcugagauuacaggcgcucgccaccaugcauggcuaauuuuuguauuuuuaguagagaugggguuucaccauguuggccaggcuggucaugaacuccuaaccucaggugaccugccugccucggccuuccaaagugcugggauuacaggcaugagccaccgccuguaauuuuaauuuuuaaccaaacugagaacuugaggauugaaugcagguaacgggugguguucauguggauguggauuccaugaaagagggcuuuguccucacugucgguucuccacauguagguccuuugacucagcaggccuuaggccuaguccacaggugcugagugaacagccccagcgucugacagcuccuuagcuuggggugcacaggcagcugaagcaguaggauggcagcucagacuucccagggccccacgugugcagggcuggccucccagcaccaccaggcagggccggccucccagcgccaccaggcagggcccugugaguguccccucccugacacacaccuuguagagaggcugggccugggcaggcugcucugcugcaccacaucccauucucaagagggucccaggucccaaaggaagccuguagcccaguggcuuucuggagguuugcauggcuggcaagccugggccggcugcuggagaggcaucaggacaggagcaacucugcugacugcuccccucagcgagcucuaagagucuuugggugggaggcacaucacaucccugucacuccuggcuggcccuggaaugccucagcccacacaccccacuccagccagggcugugggaacugugucugcucagguacaaaaggcuuuguuuguucuuggaccucuugguucuggucugggcuucccaccucccaugcugugagcccccacgggcugggaccgcagcuugccaugugucucucaguggcaccaaguggacgcucgaggcuuauguugagggagugagagccaggauaggccacugggcgugcugggagcccacacaggcagggagcccagcgggaggugcccugcuccugccagccccgguuaccccagcaggcucggcacccacucagagcccccauuucugcuccccaggcacucccugugugccuaccugcccuuguccuuguccugggccagcuuggcuccugccucccagcucugaggaggucucugcagguagccaaccucccuggacgagggggcagcugccuccucucaccugggcucacccugagccaaguccucucaacccaggauaaauggccuuucugaaggcccagagagcaugccugccccagugugggagcugcauccgcuccccaccugacagugauggccaagagcccaguguuccuggagggcucccaaacucuggaccuguaggggggucagggcagucgcuggucccuaagggaaaagcgugacccucggccccagguggcugaacccgucacugccagggcgagcugucaccucugugagcugaugaggccuugcuuuuaggaccucuaaucucugcaagaacccaagcuggcucugccuguuucuccugagcagcucgcaguguucaccacacuccagcacgacucgggacaggcacgugcgccccucugcaccagcuggagucccucaggacaccuggcuggagcugaugggcaugggcgggugugugcgagcaugagcccgcaggucugugagcuucgucucccuuuccuucuucgcaguguacuaauggucacuugaugugcgcuggcuguuuuauccaccuacuagcagaugcccggcugaaggaggagcaggccacgugccccaauugucguugugagaucaguaagagccucugcugccggaaccuggccguggagaaagccgugagcgagcugccuucagaguguggcuucugccugcgccaguuuccccgcucccuccuggagaggcaccagaaagaggaaugccaggacagguaacugagggucaggggcuuagccuuacaggcggggcccaggacugcugggagcccacccuggugcagcagggcccugugcaggguggucuggcugucucugcugucugggccuuggggaccaccuguguagcccagugacggcccugugggagggugccugcacaggauggggacagguggguuuugcacccaguuguuauccggacaugagccuagccuuccagugcucuuuguggcugugggggagccccuugaagggcccaggacagcguguccaacgcaggaccucagggagcuuggugugaggguacacugcccauggcuacccauccaguggaggcagccaccaagucuccugcagugaggcugugcaggaccaccacugccaaacagaggagagaaccacgccauggugcggggcacacaggcucaagcuugcacucuuccuuccccucucucucccuuuuucugccugucuccuuucucuccacaugcugccacucugaccucauccuggggggugggcucacaguuacguguguccugcaggaagggguucuuagcuggauggaagccauaugggaggacagcuuguugcagccuccuguucggggcucagucugugagugauguaccugccucccccaggguaacccagugcaaguacaaacgcaucggcugcccauggcacggccccuuccaugagcugacggugcacgaggcugcgugcgcccacccgaccaagacaggcagugagcugauggagauccuggaugggauggaccagagccaccgcaaggagaugcagcuguacaacagcaucuucagccugcucagcuucgagaagauuggcuacacaggugaggcgccccgccgccugcugcaugccacacagguguggguuggggggcuggcagccaggagucugggggcagcaggcucugggcacugggcacugacagcgccggacagccgggcucuggacaagcucccgguggacagguggacaccucggucgagaagacaggccggagacugaguggaaggaggggccgaggcagaccccaggugcacaccuguguggcucucacagcagccccgcccaccuguccucgccacccuggcuucaccaucccugcaagguggcaucucacuguggggcuccagagccucaagacagucagggucuaaccagaaagugggcaggucucagggggccugggagcuaggggccugccccucggacccuggggcaagaagagcacccugccgagugagguccuaccugcaggcagucacugccccggccaugggccucucaaggcuggcacgaagccauucagggagagggcuccacaacaagcugagggugcccgacucaaacuguagaaccgggaguggacacccacagacgcccaggcuggaugcgugcgcaggcacacuggaucucguggcucucugggccgcugccaccgccuuugaacgugucggggagcaggagccaggccagagccuggcccagaggacagcgagaagcaccuguugaugcuggggccacuggaggaagcuccaucccucuacucucagcccacaccaggcggccagcucagagcaccaggcguggcgcaagcaggguggucgugggcagccagucccgcccugcugccuggacugugcccagcgggaugugggcccgagcaggccagagaggccgagggccuggggucucugcggcagccacagcccguggugaguagcagccuuagcuguccuggagauaccggggccucguggagucuaggcaggcuggggcacuguggcuguggccguggccaggugagaagccccauucgcgcaggaaagacuggccaccugggaacccacgccuccacggagggacuugccggccacaggcugugggcugcccaagaggacugugcaggcagggcugccugcugauuggcagcuccggaucaggcccggugccugcagaccuggugcuccccucgggcagggcugggugccgcagccgccugcuggcuuuucuggcagcuccucuguaucagaaccaauaaagugcacuuguucucggaaccgcauccugucugugugucugcuuaccccgcccugggggacacccggggcucggggcggugagggaggccagcgugggucgggcacgccugggguguggccugacacgugcagccucuggacucuccagcuaauccauguugauucuguuugugguuguuccccucaaagcuugugugcaccuccauuugccauaguugcguuuggcuugcuugugacaagcagagcccgguguccggguaaguugccuuccuccccggcugagccugcccucggccuggucagggaaggcguugcugcccagcccugcccacacuaacagccggcucuuuccggcccugucugucuccacagagguccaguuccggccguaccgcacagacgacuucaucacgcgccuguacuaugagacgcccagguucacagugcugaaccagacguggguccugaaggcucgagucaacgacucggagcguaaccccaaccuguccugcaagcguacgcucuccuuccagcuccuccucaagagcaaggucacggcaccgcuggagugcuccuuccugcugcucaagggccccuacgacgacgugaggaucagccccgucaucuaccacuuugucuucaccaacgagagcaacgagacggacuacgugccacugcccaucauugacuccguggagugcaacaagcugcuggcugccaagaacaucaaccugcggcucuuccuguuccagauacagaaguagggcggggccucaggauguccgaggagcccacgggcggcaucccagcaccgcugcccuguccaccuggcuggcagcugcuucacaggacuaucugaucacuuuagcaaaggaggagaacaaacgaagccaacacagggcaagucugcaugcgugcgcgacggggcccccgccuccggcucacccccccgaccccugccuccccuccuuccgagggccgccagaggcugggcugacccgaagaggagacggugcaccaggcgccccgaggcucagagacgguggcagcaaggaggccgagaggcacagcgacccugccccagcccuucugugcagucaggcggcggugcugcuccaucccugcggguuccggcggggcgcgggggccuugcugacaucagacgggauauccgaauaucugauagcaauuaaaaggcagccuuguuucguacuuucuguuuuguucgaggggaaggcauggcugugaauggacagcgugggggcuuugguuuggccugggggucagagccugccccgcccccaucugugugcccgcacacgucccccgaggaaagacucagagacacugccucccccuacacucugucauggggucuugagacugaggcuugggcaggaagauccagguagggucggggcugcccuggccaaccggccgcucccagggagacaggacucagccaccagggcucagcaggcauuuuccgaaagcagggugaaauugucucuucccaggaaaaagauuaaacuccuugcaggcucuuggauaaguuacacaauuuuagugagaaagagucuauuuacuguagauucagccuugagggcccagcguccccaggcuguguggaaagcuugggucagugcuugggcgccuggcugggugagagucugaggugugucccccaugcugcucucgggguccugcugcuggcccugcauucagggcucgcugcagaggucagagguugggcagcccagcuucucaccuggaggaggugggcccuucccauccucacccuggccgcccccugaugugccccgugguggcugagcagggcuggccuaacaggaugggaaggaacccugccuggagggguaaucccugguccuuucuuccccugggacucccagggcuacugggaaggauacagcuugacgcccccaccuuugcuuaggagauguggcucuuccgugauagcuuuuuguugcuucaauaccaaagaacugguuuccucugcuccagucaggugcauuaacuugccucacagcagcccaacccgcccccacuggcugcuggggccuggcccacauuguccugugcuuugcuggucacgggucgagggcugagaaauggagaggaacugggggcagaauguaagcgccaucauccgggcggcugaccauggcacagcccagcaugacccucccagucagcucuucccucccgggccgccgcacugccccucacgggcugaaacuuucuggagcuguuucugagaaugcuguggguuucuacucccaggccagggcguguggccugcugggagugccucgcugccggagccuuaucuccugcagagcugauguggccuggccaccaagggcaugggaaggccccauguuugguuuucugcugaccacaaagaaagaccccacccagcccccagcacauccuugggagcagcugccucugacucuggcaccaccagggugaacuugggcaccucagggcugcgcuuuggggcuguccucccucaugcuccacccacaggcgcagaggguugggcuauggcucuacaucucuuuggaagcccgacgcccucuagcguaguguuucuggguccaaggugaugguguggggcgcacggguggggcgggcuugcccugucaccuguuugguugugugugugagagacugacucaacggagggacaggccccagcaugucucugggguggggaaggugggaggcuuguucuucauggggacagccaggcugggacgccaggggccuggaggcagacgucucugcagguuggggggccacguggagaaaggagacccggggcugguugagcuccugcagccccaccuccgcagucccggggcaaccagcccugugggaguucaggaugggaggggcuggccugagggcaagggcaguguccacacaaggcccuuccagaugugggaugugggugccucaagucugcaagugcggcccagcguacucagcaggcaucugcccugugaccaugacaugcagcagcugagccuuauggccugggggagccaggcaccugggaggaccacgguggguccucggccaccgggaacuggagcacgggcuucccguggcguugccaacgugggccacacaugacaggaccgccaaacacacggcuuguguccaagacccugagacaucuugacgucccgaccugcuccuuugucuucucugaggaugggggcguggggguccacacuccgcagauguggggggcauagccuaagccaggccccacccuucucccucccuugucucauccccacccccuggugagcaccacaucccucauuuauaaaaauaggccaggcacggugggucacgccuauaaucccagcacuuugggaggccgaggcgggcggaucaccugagguuaggaguuugagaccagccugaccaacauggugaaaccccaucucuacuaaaaauacaaaaauuagcugggcgugguggcgcgcgccuguaaucccagcuacucaggaggcugaggcaggagaaucgcuugaacccaggaggcagagguuucagugagcugagauugugccacugcacugcagccugggugacaaagcgagauuccgucucaaaaaaauaauaauuuuuuaaagagcagagcaagaaguguuuuuaccauuguuggaaaugacuuaugugucacuuuuguggucugcguucucuuuggauauuuucuguauguaacaacuguaguuuaaaaaaauauuccaacccauguuuugucuguguuuccuuaccagaagacagacacacagcugggccuucugggcucugcuggccuccccugcugcccucagccuguggcaaucugcaccaggccugcagcccugcacagcacu

SEQ ID NO: 17842 - RNA, 9280 nt, Homo sapiens
ggggccgguuggaggccguaggagcggguggggucgggaggagcucggggaccagaaaacgcucuguuugggugggugcgugcgugggcauagugguuuggaaggagcgugaugaggggagaagggccggggcggggcugcgaggggcggggucugggcggggcugcgaggggcggggggucugggcggggcugagggagauaagguuuaggcggggcugagagcggcgggucugagagggagggggccuggguggggcggggccugggcgaggaugcgaugggggggucugggcguggcugcgaggggcggggccugggcggggcugcgaggagaggggucugggcgagacugagagggaccgagaggggaggagccugggcgaggcugcaaggaacgggguuugggcggggcugcgaggagggggggucugggcggggcugagaugggcggggcugagaugggcggggcuguagggagaggaaggagaaccccggcguguugaaggcuccgcgaaaccggagcggugggggacuacgcggagggugggagggauuccgagaggagggucgcgggagccgugggcgcucucagcccgguguccgcgguguagggguuggggcgcgccgggcggcgccgugagaaacggcgggucuccaggugcggccgcgggcaccuguuucuaguacccccguccccgcgcucgccuuccagccgugggagccgggccgugggggcggccgucgcgagcaugcgcaccggcacugcggcgggcgggcgccgagucugggcgcggggacgcggggcggcgcgaagcggggcccucugccgccccgcgcucccauguacgccuuuuacucguugcucaucuacaucuucuacagccucuuccgcagggaugguggcgccgcggcggccgcggagcccggggaccccgcccaggugagcggggcuggccgugcagcccgucgucucccgccgccugccccacccccacgccgagguucccggggcgggggcgggcacggggcgcggggcgacggggccgugccgaggacccucggcucggccccgaugcuggaagcguagacuucggccccaauccuccggcccgguucgcggagggaaggggccagcaggcugccugccccccuccucaggggcgccccugcccccucccuagagagcccgcaagccccggggucgccggcgcccagaccugcccgcgccagagcuguggaccgagcugaccggccuggccgguaggugcgggcugggagucccgcggugcgagggcggugccgggaccucccagggaggggcggaggccuggcucaagcacgugacccgaaaugucucccgcccuccucccugaccggcagccagcuccgagccugaggaugggucggaaggcgcagccgagggccgcgcggccgcggugucccuggaagaggcccuacugcgccucgccgaguuccucuccguccagcugggggcggaagagagcugcgggggcccggcggaccugggccaggugagcgcggcggagggggcugcuggcagguaccaccugccccggccuuccuggcuuucacagcccugcucggauucuugucuccuucgcagucuggcgagguccccucacuguugacagugaccagucagcucuuggcccuucuggcauggcuucgaagccccagggggaggcaggcccugcuccaggggacucagccagccccucggguccggccccccucuccagauggugaguaaaggacaguaaguugaagaagaacucuggagggagcaaaucccgguagaaccugggcggccuggaguucggggucauguuccggaagauuuggacuagagaccucuucagugcuaacugggcccacccuacuccaggauccacaucccaagaagaaagcccuucccacuucaccgcagucccaggcgagccacugggggaugagacccagggacagcagccccuccaguuggaggaggaucagagggcguggcagcggcuggagcagcucauccugggacaggugaggucccuggagccagaagggauugccggcugggacgccagaaaaaggagguccacccugucucucuuacuucuccccagcuggaggagcugaagcagcagcuggaacagcaggaggaggaguugggucgacugcgccugggcguggugaggcugcagggagaccuggcagggccgggcauggagggggugcuucaggugagugccgagguuuccucuccaccagggggcgacggacucagagaaaaggguucagcaucugacucuggagaacgaggcccugaagcagagccugagucucaugcgggaccuccugcugcacuggggccccgggccccccaucagggcuccgcagguacucugcucccgagcugcagccguuccugcagccuggggcucuugcacaccuggcaugcagccacagggcccgagccuccucaggaccucccgggauggucuguguagggcagccccaucagggaggcugaugccaaugggaagaccccccucuccguggccccucugaguggcugaccccaggagagcagagggacugugggaaggaggucugcguggagcugggaggcauggguucacagccagcucugcccaccucuugacuugacuuucccaucugugaaaugguaccacagaccgucccucucugagucccuccuggcccccacccucccgcaggaggaggcagaggcauugcuagagcuccagggccggcuucaggaggcccaagacaccacagaagcccuccgagcccaggugggcauggggcccagggauccauggcucaggggugaggcgggcugggguuuugggaggggcuuaucugaggcagggccugguaagugccuguuuccucagugacaggggugggguugggcggggcagcugggggugcaggaggugcagcugcagggccuucaaggggcccuccagcagcuccagcaggagacggagcagaacugcaggcgugagcuacagcagaugcaugggcagcuggcagguaaggguugggguuggggcucaugggaggcccuggaggcugggccuucccuuccaacagacuucccucuccaggacuucgggcacggauggccagccugcgucagggcugcggggaccuccgagguuuggucagcaccuuuacccagagcugucaggguucgcugagugaggcccggggccaggucaggaccccuccccgccuagccccuccucucugggcagccuauucacuguucuuuugacgggggcguuccuggggaguuggcuguacuaauaaguggggcucuggaacccaaacagcuucugugugacccagggugggauuccacuucugggccuuauuuuaauucuaugcauacuugguugacaguaaacucuuaaagcauugcccagaagcacggaggagacagaugaugugguguuccugccugucauuccugggcuuuauccugggguuacucaaugauguccccaggggcccagagccacugaaaguuguggcuuagcacagcugagcgggccugugggggcucccugcugcucucaggacccucccaccccccaccuccgcagcuccuuggcugaccccuugccuucuguacaucccuguucccucagguguccugggccuugggggcacugucaucuggagggccuggcacucagcucccugaggggcagcaagggcccccagccggaugcccagggcggcugccagaacucaaggguaugacaggcuugggagccuagcggggcagggagggcggcuggaagaagugcagcuucucugugcuuuagggucugcgaggcauuaugcugaccugauccccacugcaggaaauauccgugugcugugucggcugaggccagggacaucuucuagccuugugaguguggagccuggcccagggggcaccgucaccaccugcuaccgggggcgccaucgucgauuccgccuagacugggucuucccuccagacgccagccaggaggaggugacagccugccuuugcagccauccugacccuuuuucagaguucccugaagagcaggagaggcuccaguuuccccuucccagucuggguguccaccuggaggagagaggguggcugggcucuagccaggaaggaaagggaaccgagggggcugggaagcagggcaggcagcccagcuuggugccuccuccucccaggcuucacugccugcccacuccccuuugcugggguccaggguuugcccagcuaugagggccccucauugcuuuauggccccaaggcaggcgguggguggugggggccgugggugaggaggcaaccuucuagucuuagugugcucucucugccuugccuggaucccacucuccuuccccacccuuuuccugccagacaccuguggaaaagcaggggcuucagccccagcccaccccacuuucacacacguuuucaucugcacaugcccuuugcugcuacagcucccauagcuaaggagauggcagcucagagccaggggagacuagguaaggggcagaauggcagcgacucccaaccaggcugccugccagccucacagggacagggggacgacugcccagcagguggccagggucacccugauugccucuuuuccaaccacuucuuccuucaucccacacaucccucuggccuuagccccaccccacacugcagcacugcgcagggcaugccuugugcaccguccucuggacagccguccuggacaggguccucucagucaaugugucugaaccaaaggcaucuguggacaagccccucaucuguguuccuguuucugcaguggugccaugaugugcuccugaaugucauccucagugccaccuccauccaaucauggaaccucagugaccacacagaacacagaauucuagauucuagccuuguggcugucuucaaacagagcugacagcccacccuguuagcagcgaccuucugggcauaaaagccagccauguuguugcucaaaagacuguugguguccagugccaauggggugaauguccuaaccuugugucucucucagcaccugucugugccugggcuccagcaggccuggcuggccaccaucccccguaccugcaggcccuuccuggggucacgccuugugagccagguacugguguggccggcccucuaggugcacugccacaaguguucacagcaggugccacugcagcccuuaucucucaggggaaagugaggcacaggaaggccaaugaguaagcuccaaucauacccagguuugaaccgugcagucacgccccaacaucugggcucuuuuuuuuuucuuuauuuuugagauggaaucccacucuguugcccaggcuguagugcaguggugugaucucggcucacugcaaccuccgccuccuggguucaagcaauucuccugcuucagccuccgaaguagcugggauuacaggugcgugccaccaugcucggcuaauuuuuguauuuuuaguagagacagggguuucaccgcguuugccaggcuggucuugaacuccugaccuugugaucugccugccuuggccucccaaagugcuggguuuacaggcgugagccaccucgcccagcccaucugggcucuuuuaaacauuuuuaaaauuuuuuacuacauauauauguauauguauuuuuuuuuuuuuggacagucacacuuugucaucaggcuggagugcaguggugcaaucucaggucacuacaaccucugcuuccugggcucaagagauccuuccaccucagccucccgaguagcugggaccacagaugugcaacaccaugccuggcuaauuuuuuuguaguuuuuguacagacgggauuucaccguauugccuaggcuggucucaaacuccggagcucaaccaauccacccuccuuggccucucaaaaugcugggauuuauuuuucuuuuuuucacguuggcuuccacauuaaggacaccacaccugcgcucuuaacugcuguccccaggucuccuacguggucuucaggacuccagagccucugcauaggcuguuccucuucucauugugucuuuucccuucuuugccuggcaaauucuugcaagcaccaccuucucuagggagacagagggucucuguaggacacacccucccccauggucccuuagagccauccucccaggagacuaggcucugcucacaccugccuucguggcacuccccaccccaccaaauagggcauaaacaggcaacguggggaggacucaaaacacauucucccgccucccgcaggucuucagagagcuggaaccugcggugcuguccugccuccgaggcuacagcgucugcaucuucaccuauggccagacaggcaccgggaagaccuacagcauggaggugggacagagcucacgccccagugggagaggccccaggggcccugcaugacuuggaugugagcccggugugcaccccaccccauccucagggcccuccugaggaccccggcauaguuccuagggcgcugcagucgcuguuccgggagaugggggccggccggcagcaccgggugacacucagcaugguggagaucuacaaugaggcugucaggugggcuacuccaccagggaggccuucuccccaccccuggcccagggcccuuccggauuuccagagaauucuggaaccaagaccuuccccuuucucaccagggaccuccuugcuccagggccucccgagcgccuggccgugaggcagggcccagaaggccagggcgggauccagguggcuggccucacccacugggacgugcccaaccuggagacauugcaccagguagggcugcaccgcucuccgagaccccgccccgugcuuccacuugggggcggggacccugcaccugaccagcccuucgccccgccuuccagaugcugaaacuggggaggagcaaccgggccaccgccgccaccgccaugaaccagcgcagcucccgcucgcaugcccuggucacgcugacgcugcgcgcggcgucuccaccgcgcgcuccaggcaccgcagguaccacggccggugccugagcccugcggagucuccagagcacccgaggcccggccuucccccaugucgggcucgcucgccccucuaggcacgcugcaccugguggaccuggcgggauccgaacgcgcacggaaggcaggggcggccggcccgccgcggggagacccagacggcgcccggcgccugcgggaggcccagaccauaaaccgcucgcugcuggcgcuaggaggcgugauggccgcacugcgggcccaccggccgcacgugcccuuccgcgacucgcagcucacgcgacugcugcagccggcgcugggcccaggcaccaccgcggugcugcugcugcaggugggcgccggggcggggcaggugugugcgugccggucgccgcccacccgggcccgcccacccgcgccucuugcccgcagaucuccacgcggccggaggaucucggggagacagucugcucccucaaguucgccgaccgagugggucaaguggagcuggggccagcccggcgccgcagggucccgcgcuccuccgggacgccuucuucccucagcaccgacacuccgcucaccgggacccccugcaccccuacgccguccccuggcaguccuccaugccccagucccgacaacggcucgggcucggcucucgcgcccgcagagggccugccccucuaguccugggucgcggcccugcccauggggucucaggccaggucucugcuggcagaggcgguaguaaagucccuguaccccgucucccagggcacaagcucccuagccucuuuggauccauugccccugagcucccagagucaccccuccaccuccgcagccagugaaguguguugugccugcugaagugaucaccccccgcccccagcccugcaucaggccacaggucuuggcuuucuccuuaucaccauuugcuguuaucacggcacacagcagggaaucccaggcccccccgccaagugguuacccaagucaccacuccugacccaaaaaucaggcauggcauuaaaacguugcaaauuccuuuacuguuaucccccccaccaccaggaccauguagggugcagucuuuacucccuaacccguuucccgaaaaaggugcuaccuccuuuccagacagaugagagagggcaggacuucaggcuggauccaccacugggcucucccucccccagccuggagcacgggaggggaggugacggcuggugacugauggauggguagugggcugagaagaggggacuaggaagggcuauuccaggcucagcccugcuccugcagcuuugccgcugaguguaggaaaaacaggcaugacagaccagggugaggguugugcccagcugggccacggccaugcgugggguggcccaauaaacaccguggacucccagcaaggcugcugccugguguuucgaggcugcuguggucgcagacagccgccucgccuuggcucccugucaacaaggugggggugggagcgggagggaggaguggccccugucuuaagagccucacaggcugcaccaggagagcagccagccugggccaggggccgccaggucccgaggguggcugacccaaacgucguagaugcuuuuguuggguggcaccccuuggaagagggcgucuagaucgcagagcagcccugggggcccucggguuucaggggccaccccccaguaggcagggcugguugacggacacuggggacaggaggugggugguggugccaagggcauuaccacauugggaguguagauaggcaaguaggaggugggcagcugcccccagagggaggcccugugucccccgcuggaccgucccccaggaacugcggugcccugcaguaaguggagaggccaggcccuaggcucuggggagaggguugagggcccgauggcuccccccugcacagucucccccuccacucucguggggccaggaagggggcagaggggccacagaggccucucagaagagggaagggguggggugggcaccgccuccuccccacuguucccugugccugcaggaacugggcugcucuguggagcuagccccggccagggugcccccuccccggacccuccuagcagggacuugaugcugaagcccucacugggugguggc

SEQ ID NO: 17843 - RNA, 1778 nt, Homo sapiens
gucgcagacagccgccucgccuuggcucccugucaacaaggugggggugggagcgggagggaggaguggccccugucuuaagagccucacaggcugcaccaggagagcagccagccugggccaggggccgccaggucccgaggguggcugacccaaacgucguagaugcuuuuguuggguggcaccccuuggaagagggcgucuagaucgcagagcagcccugggggcccucggguuucaggggccaccccccaguaggcagggcugguugacggacacuggggacaggaggugggugguggugccaagggcauuaccacauugggaguguagauaggcaaguaggaggugggcagcugcccccagagggaggcccugugucccccgcuggaccgucccccaggaacugcggugcccugcaguaaguggagaggccaggcccuaggcucuggggagaggguugagggcccgauggcuccccccugcacagucucccccuccacucucguggggccaggaagggggcagaggggccacagaggccucucagaagagggaagggguggggugggcaccgccuccuccccacuguucccugugccugcaggaacugggcugcucuguggagcuagccccggccagggugcccccuccccggacccuccuagcagggacuugaugcugaagcccucacugggugguggcgggggacugggcggccgguauggccggccgugcagcacguaggggcccagguccuuggcgaaggcuccacgcgcaccuccguucugccagcgccggcacagggcgguguucugcagccggagcgccucagcugggaucaggcucacgucgaccgcccagaaguugcccuuggccuggggcuuugcaggguccuugggcaccugggugugggggucagacauggguggggcugcccaaccuuggaugcucaggacuuccgcgcgcgcuccgcccccgggcuccgacccuggccugccccaccuugcggaagcaucgguuggaggaaagguuguggcgaauggagucuuuccagcccucguagucuucccugaagaaggggaacacggccuggaccugacggaugaucugaaaccgccaggcggccggccggcgccgugagcccagacggggaggggguagcgcccuaccccucccccacuaccgggcucaggggcgcgcggugccggccccugcuguccccgaagaaggacauuucugcgcggaagcgcggcagagagggcaaggggcucccggagaagggucgugccuugaggcccucagcucucaggacuggucccacuggcauaccugggugggcuaggaaggggugggggucagggcuugaaccuggaaguggguggggaacgagucuggggaaagagagagugggggccggggcccgcucaccugggccagcuucagucugcgggagggagcggccugaaucaccaaggcgaucauggccaaguagguguaggggggcuugucaugucgcagguaccucuucuuccuccucuuagggggcugggagggcgacucugccucugggggccccaggcgggagccgcugcagggccccaugcgggacgguagacagcgugggcaggggccuggccggguggagggugcagggcgguggggcaguguagaaggcagggccgggaccugaggccgggcuggggcaggcgggcuggggccuuuaucauucggauggaagggggaggggagggaagggaggaagaggcuguggggga

SEQ ID NO: 17844 - RNA, 2864 nt, Homo sapiens
uuuacaauguuuccccuccccucagccgcacuagaaugucagcuccauggggucagggauuuaaggcagaagagugaaaaugcccaaccuaaaacacaagaucuacaaaagcaccuggcuacauggggccaggcugagcaacuguauguugucuacaaagggccucaaccuggccucacauggccacguccagcaccaaagacaaauguacagggaaggggagggugugagguccaacacucaccuauagaaacauguuuuuagcugcuuuacuuccaaaaagaaaaaaaggcauagcucucuuuuucaauuaaacagaaaacuacauaauuacguucaaacacucacugaagagccugccucaugggaagggcagggcugucgugggaagagucagcugcacuuuggcaccaucucaggugccuguccaagccggaucugaaugggacuggucaagugaggggucaguccugcagucugcgcucacaccucuucuccagaucugccaucuccuuuaggaccagggccacgcuguaccgcagcuccuggaacuuggcuguggggaccucaaagcgguaugcugacccaucugaaagcuucagcugcaucaggacgcucggcugcagggagcgagccagggcacugguggagauugcuacauccacccgccaccgaaagucagcaacaugcggcagccaggcccccugcugcugggccacagaaucaaggaggggccgcuggcucccaaauaccacgcuggccaaguccccgaccaggucuugggggaugcagagcuccuggagcuggucccugaaggugucaggcuucaggcugguggggggcagacggagggccugcuggagcagugugugcaugccugccagcagggcacccagcugcuccuccggcagguuggcgcugaccccaagacgcugcacagccucucggcaguccucccccugcaggcugcugaccacaaacuucagcaacuuucugaacgugcuccugucuagguccccuaguagccgggccauugcugccaccucuggaggaagcugggcccccaagaaacucacucggccacugugacuaucaccaggaugaugcagguauggaguugcagcccccacagcagacauugcugcugcuuccucuuugaucagccagcccaggaggucggucccagaugcagaugccuagagugggguggaggagagaagaccagugacucucacauccuuugggccagcgagugaggguugauaugguccccaucaucagcaugcugacagugugaacuaccaaugacagucagugcugcggagauggcccuggaagcagguggcagagggguccaugucagucccaggaggagcggaggccucccagaggaagugacaucuaaggcaugaaggacaagcaggaauuggcagagaaguagggggcagggaggaggaccaggaaacagcacaaguucuccaaguaaauuaauagaugaaagaaugaacuaggggaacgguccggggaacacagggacacugcagcuggcgccacagaccacacugagaccauuuaacuauucaaucuugaauccuucacaacagugggcaagaagaauuaccauucucaccugacagagagggagauaaggcucuaggccaggugcaguggcucaagccugaaaucucagcacuuugugaaggugaggccagcggaucgcuugagcccaggaguuggagaccaaccugggcaucauagcaagaccccguuucuacaaaaaauuuaaaaaacuagccaggcgugguggugcacgucuguagucccagcuacucagaaggcugagaggacagaggaucccuugagcccaggaagucguggcugcagugagacgaaaucgagccgcugcacuccagccuggacaacagagaugcugugaggaaggaaggaaggaacgaacgaauggagggaggggggagggaggggaggcagggaagaagaaaagaaaaguaaaaagaaaucaaagcucuaaacacagcugccaaagucaaggacugaagccuagaccugucuauucagaagucccagcuguuuccaccacagccccaacccccgggcuggaagagcugagcaacggcuggcaacagaggcaagugcggcaacuaaagaggguuccgacgcaccugaaggagcagugcagcagcacaagcaccugcuaugccagaggaaacgcacgugcccaccucagcacaccagguacuggagcagagcucagcggggcacagcuccuguccucgaggcacuugucaggccacucugcacagcgcugggggagcccaggagcuccccacgggcuucacggcgccccauucucccugggagucaacgaccacccacugccaacuccuucaccgucccgccagcaccaggagcuccuucccacuccaaagagccauccgggaaggccuccgagcugcccgcuuccggucgcgcggcuuggaaggccggguucgcacccugacuccguacccgcggcucugaugggggcgcggcgucgcccguuccggggcgcggggaccuuggugcacagagucaaauuggcacucggccgucgccgcccccacgguucggggccaaccuaccggcgggcgcuccuccgcggaaaagccccgcaguauccagagcucuccgaacacagcggcgaagcagccuuuccuaggcccacacccccagcucgggagggagacuccauccuacuccaccccacgcucccgcuguccgagucgcccccagcaccuggcgccggcaauccccggcugaugcagccaaaagcgggccugguccccggaagcgcccugagagccacu

SEQ ID NO: 17845 - RNA, 868 nt, Homo sapiens
aaacauuuucaagagcaugacaaaauaaaaacacacaaauuuacgucugauguucaccuugcccacuauuuuuuuuuccuaucuuaaaacagugcaaacagguaacuuaugcuuuuaaaacaccacgaccccuuccccaccccccaaagucccuuuccuccuaguaucugggggaaaaucugcaauucugcaaauguuacugcgcuagagguugcaagcagcggagaacuggcugaacuuggcaaaaggcaaggacuggucaaagcuuccccuuucuccuccuuaaacaucuaagugcuuuccagucugucccuugguuggccuuguucuccugccagagggaaggggguucaucaugcccuucuugcauauccuugggguugcuuccaucccuguuugaugucucccucaugucuggaagcuauauaacuaguuacaggaugguagugauuaacccacuuaucugcuagaucucuaguaaagcauaauucuaagcuaagagcaguuuagccccugaggagucacacauuugaggaaaagcugcuaucgaugacuucuauugucuagauuuccacuagcuccccucagacuaaaaguugugccccaguccacuucuuucucaaagaaaaaaaaauguuggcucaauucagacuguggcuguugaaggaugauggugauaguagguuuuguuaaaccugagagccugacaaauggugaaucacaauggcugaucugaguuaauggaaauugaacuaggugacaugaggaauucuggaaaaugccuaugggcagcucucugggcucuaagagggacauggagauaaagguguucacuagaggccuccuuuaaggagcccagcuuccaaga

SEQ ID NO: 17846 - RNA, 868 nt, Homo sapiens
ucuuggaagcugggcuccuuaaaggaggccucuagugaacaccuuuaucuccaugucccucuuagagcccagagagcugcccauaggcauuuuccagaauuccucaugucaccuaguucaauuuccauuaacucagaucagccauugugauucaccauuugucaggcucucagguuuaacaaaaccuacuaucaccaucauccuucaacagccacagucugaauugagccaacauuuuuuuuucuuugagaaagaaguggacuggggcacaacuuuuagucugaggggagcuaguggaaaucuagacaauagaagucaucgauagcagcuuuuccucaaaugugugacuccucaggggcuaaacugcucuuagcuuagaauuaugcuuuacuagagaucuagcagauaaguggguuaaucacuaccauccuguaacuaguuauauagcuuccagacaugagggagacaucaaacagggauggaagcaaccccaaggauaugcaagaagggcaugaugaacccccuucccucuggcaggagaacaaggccaaccaagggacagacuggaaagcacuuagauguuuaaggaggagaaaggggaagcuuugaccaguccuugccuuuugccaaguucagccaguucuccgcugcuugcaaccucuagcgcaguaacauuugcagaauugcagauuuucccccagauacuaggaggaaagggacuuugggggguggggaaggggucgugguguuuuaaaagcauaaguuaccuguuugcacuguuuuaagauaggaaaaaaaaauagugggcaaggugaacaucagacguaaauuuguguguuuuuauuuugucaugcucuugaaaauguuu

SEQ ID NO: 17847 - RNA, 13597 nt, Homo sapiens
ucccauguuuucuuuuuauuaacuaaaccaccuguuuacauggaagauggcaaggaauaaguccaguauuucaugggaauggccuagaauugcuuuucagcuuaguaaacuaauuucaucauuaaucauuacguuucuagccuccuuguggcauuugauacagggaauauugggauucuucuagaacguagaugaauauucccaauaaguuauuugacuuaggguaaaauguauucguguuuuuaaugccaacccuucuuuauagaaggcuuauuuguaaaucuuugccuauauccccuuacuaagaucuuugaaguuuaauuaaucaccacuuggucucagugcuuuccauuuuaucagccuucucauuuugaacaaguuguuuuuuuccuuaaaaugcagcugagaggcagauuacuuucuaauaucagacuuuaacugcaacuggagacuaugaaaaugaaugggacuuagcuaaaugaacaucagagaugaguuugauuugccuuuugugugauacaagggcauagcauauuuggggcauuccaaaaugugaccaugcuauccuguaaauacaaccaaaugucauuggaaauagaauuaagaaacauuccaccuaccuauaagaaauaaguuauuucauauucaaguuaaaaauaugauuugaugacuuuacuugucagcuuguuuauuguaacagagaagguaguggugaaaauuuccagcuuguuuaguugaauaaccaauaaacagaucaucuaaauuaaaacaaucugaucuugacuucacagagaugaagaagaaaguuuuaucuuuuaucucuacugcuauuccauguccuuuggucccaaaauaauguuuuggggaaagucuguauaagucuguaugcacaaagguaccucagaagguuggaaaucuauacuuaagaauauaguguugcuuagguuuuguuuuuuuuuuuuuuuuaaagucaugcauugucuguuugcuacaaauucauuaucuaaacaggaaaauaaacccuucuauucuuaaccagcuaccuucucagauguauucuuuuaaauaagacagggugaucuuuggucaagcccagaacuucaguuaucaauuguauuuuucagaauuccaugaauacucuuauagucaaaaaagaacccuuaaaaucuuccaguuacuccuucccacucuggauuauauuguuacuaucugggauccccacugcaccuuucaauucuuggaccuuggaccaaucaccuuaaccuuuagcucauuaucucugcuugugaaagcaaugcauuguggguauuuuugguuguguuuuuuuuuuaauuacauuucucuguuuacuuuggucagaauugauugacuuguuuuucugagguguugcauugguucuuaaaaugcugaauaauaauacuuugcaugcuugugugaucagccaaaucuuaucgcaugucuaaugugcaggguaaaaagcaggugauguauggauaucagaaaaacauuuacauauuauuacaauacugaaaacaaaauacuuaaacguaauguaaaaacauacuuugcauacaggcccugcccuaguggaauucuuuggguucaguuuuucauguuaaacuccucuucaccccuacccuacuuuguaagcucuuuaaaaagaaacuuccuccuagggcaagcuuauuuuuaaaaauacuccauauacaaaaaguuauuuccaagccagcagauuuuggauagauauaauaggcucuucuaggagugcuuuuuauugugugaauccuacuuuaauuaccaaauauccagguugcgcauucuaguuuugcacaccuuucccucuccucgcauguccuggagcuguguaaccuucgugugcacuuucacauuuucucaccaacuugccgaggccccaagcccagguuauguauucauacaucaccugccuguguagagcgcaugugcaugcugccguccucaauaaccggaauguguuucuguucuuuuguuuuuuuuguuuuuguuuuuguguggauuuucugcagugugguuuaccaggacggauuuuacggugcugaccucuauguaaguacacacacuggggccuucucgaccccauccccugacaagccagccuuuuuuuuucuguuucuuugguuugguuugguuuuuuuccuuuuaauuuauuuaauuuuuauuuucuuuuuccuuguggauauauauauauauauauuuauauauuuaagaaugcaagcaugcuucucugccacugcgcuugccccugggugcaaaaacuaagccuuuggguuuccugaucauugcaagggucagucuacuggacauauucuuuucccuucccuauacccacagauguucuguggaucauuaauuuacuugugagaugaucagcagguuuaaagucuuuuauuauugucgugucauuugcauacauaaauaacaggacuagcuuaaccuuaaaccagcucuuucccuuuucugcuuuucuucucauuucacaucccucuuuagaucauuagagcugugauuuagagguuaauaagcuuucugaacuguacauuuuccuauuuuaccuacuuugagagaacaugaccuugugauagccaaauaaggaaccgaugccagcaaagaguguguaguaaugagaaaacgccagauauuuaguucuuaaaagccauuggaggaaaugaguagcauaaucagcaacccagacucuucuuacagcuauuugacuaucauagauuugcugacucuacuagccauaguaauauggacuccauuauuuaaacugucuagcuaucacuaaaguuccaugauugguuugucacauauuauuuaaaauguggacaaagugauauaauugacaaaguacaaguuuuugaguuuugaagucuuuuaucaugaccucuccagauggacuuuuucugaaugcaagcuugauuuagucgcucaagucaucaagggaaaauuuuuauaagaaaaacuugucagcaugaaaugauucuguggggauagguuaaaauugucuagaaauacuuucuccacccuuacuuuccaaaaucaauaagagguccuuuuuagugaacuguuuccacagucuaccagagauucacaagcaaccuaaaaaaguuaaugcacuuucagaaugcacucagagguuuugcguuuugcaggaaguagagaugggaugauacaguucuucgaaauacaggugacucaccuguacuacuuagcauaggccuguaagguaugccuuaauuuaauaacuacuugaaggaaccucagcuaugauuugguccaaccuccuaacuuacagauauauuucucagagacuuacccagaacuacauaaauuauuaauagucaggcauaaaacccaaccaauccauauuucauuaccucucuuuguacuuuaauuaaaauccaccucuuuccucaaaauauuuucaacaaguaaugaaagauaucuuuuuuccuauguucacagugaagcuugagaacuggggaaucuccuacuuuuacaccagauuacauauuucuaaauacacagacuuacauaugauguuagcauguacauucucccauauacauuaguguccauauucucaugaaacucaucuuuguuauuuaacuuguuuucuugaaaucugaucuauuagaacaagauuuuccauuugaguuauuucuuaaaucaaguuuuuuucucuaauguguuucuuauuugaggauuuauuuuucuuaaauacaaccuauuuaugucuuauuaagacuugccuacuuugggccgggcacaguggcucaggccuguaaucccagcacuuugggaggccgaggcgggcagaucaugaggucaggagauggagaccauccuggcuaacauggugaaacccugucucuacuaaaaauacaaaaaauuagccaggcgugguggcgggcgccuguagucccagcuacucgggaggcugauguaggagaauggcaugaaccugggaggcagagcuuacagugagcugagaucgugccacuacaguccagccugggugacagagugagacuccgucucaaaaaaaaaaaaagacuugccuacuuuggccaggcaucaucgcucacguguguaaucgcagcacuuugggaggccgaggcagggggaucacuugaagucaggaguacgagaccagccuggccaagauggcgaaaccccaucucuacuaaaaauacaaaaauuagccaggcgugguggcacacgcuuguaguuucagcuacuugggaggccaaggcaggagaaucacuugaacccuggaggcagagguugcagugagccgagauugcaccacugcacuccagccuggcugacagagcuagacuucgucucaaaaaaaaaaaaaaaaaaaaaaaaaaaaagacuugucuacuucaaacuuguuaagucaaccaacccaauuuuuuaauaguuaucuuacuuccuuacuuuacaauguaagauuuuauugagacagaugauuuuucuguuccuguuaauaaaauacucuugguuuuuuuuuuuuaaucuacuaacuggauuaccuugcugagcuaaacacaaguaauucagugaucuugcugaaauaauuuuuuuugaccaguggccccuuguuaaugaaaguaauuaauaguaauguuauuauuucuuaguucuuaucuuaaagcagaguuacuuagagaaaaaaagguuggucacuagugcugaaauaauauccaugccccuacaugaaaagcaagaauacuuuaugagguaacuacugaguuaggccuaauacaacuguugcuuuuaaaacuguguguucuguauuccacaugugagggagcaaaggauacuucuucaaaaacacacagacaacaaaacacuaucauuuuugccuugaguuuguucugcuucucuccauacauuucccaucuguggaaaucugucagcauacauuuaguucuuauuuccuccgaaaggcauauuagaaauagaaggaauagagaguuuaguaugaaaagugcaccgaaucggagcuugaagagaagacacaagggaaaagauuuuaaauugcugguuaugcuuaaguuaaaugaauuuaggcuauuaauugugcaagguuuuuguaaucccuuucacagucccauucuuagacagugauuccugcuagccauuuacuuucuguuucuuuuauggcacauuccucucuggagaacugaucuagcaauucuguuccuaguuuguaaaaagaccuaccgugauaggauuugggaguguggcagcuagauuauguauccagcccucccucuucuuuuuuggccaguagaaaaggcauaguucgcccuaauucacuuuuuaaauggguuaacaaacugcuccuaaaucaccuccugugaaaagcaugcuugcauccaaaggaaagaaaaggcuggugggccccuuagugggcuuuuuguaugauuguuuuccuuccacagcuguguuuuuugaacugcucuuccuguguucuguuauagaauagucuuacaggaaccaaucauuagcgcuaaaauaccucagguaggagugccagugugaccugccaaucaaucagauuguggauugcagugaaaaaauugaauuauacuaaccauuccagcuccacguuagagaugggaacagaggcuuuuuuggacaaucaagacuugugagcgugugaucuaagcccugcuaccucagcagugcccacagucacauuccguacauaauggcacuuccucuaaaauuaagugcuccuguccucuugacacauaucccagccagguguguaauaugcacugucccaucacugccaccucuuuuaaucugucagucacauguaccugugguauuuaaacuguuuuuuuauauuuagaucuuagcaguuggggacauuuucuuacuacuauaaauuuagaaaagagaaaaaagaggaaguagaacuguacaaauaggauuucugaaucccacauugggcccuguagugagauaccaguuguaauuggacugugcugcuacauaaguuugaaguugccuuaaaaaucuagacauaugggacucaaacauugagacaugcauuucccuuggccucuucuccuuucaccuaagaagaucagugaguucauuuggauaauagcauacuuguuagaaggauugcugauagcuggaugcuaggagaaagaaaauagucgauggcuuuucacaauccaguuuauuuauguggcuacccagcaagauuuuggaaaugaacuaauuuggggagauguggaauaauaauguuugaaagguuugauuauugaaaaucgucucucaucuaccauagaaauaauagguggaagacaucagguugaucauagcaauuuuuucccuuaaccccaauuuuaaacaauaauaagauaaaauuuaaauacuuuaaaauuuuuuucauaaguacuuuucaaaggagacagagcucaaucaaaagcagugacgguaucaccauuauuguaaguuuguguguuacucacauuuaaucagugaugccauuuugccacaaaagaacucuauaauaucuccuagaaccaugguucuuagcagggguggggagguggugaggaaaaagagggaguuagauucauccaaggauaaauaaagugauuccuggaggcccagcauuaaacccacgcuaguuggaauagaucucugcucugcuguagugauuuucagcaucacaccugccauuccuuacccacccccugccgccaucccccaacccucugcucuauugaucuauacacuacauguagguaacaagcuuucauuuugucugcuggucuugaaauacacacucuccuccucagugucacauaaugucauugucuuccggguagaaagaaggugucuugacaucacaugcucaccaaaguccuguuuuaauguaaaccuaaaacaaaaauauaauaaaauuaaaagcuagguuaaaaucaagacaaggcaaaagucugccagugugagauuaaacuaauaaauaugcagauaaaggucagauauaggagggauuauauucuauuguauuuugcucuaguuuaaaacccagcuacagaacugugccgaaagaucauguggucaacguggcaacaucauaaaguuaauuugaugauaaaauuggcucagagcagaguagaaaagcccuaggagaugacauugagccaugaaaaacugagacuuuaacaacugcagaaaacacuggaaaggaucuuaaagccaacuuuucaaaggcauuuuccuuugaagaagcuggaacuugaagucagagauagguuacagauaugugaaaaaguaaaauuccuaaacacaggaaauauuuuagcagaaugcuguggauuagaauauacgguuguugacagagggcgagcauacaugugagugcugugggucaggacugaauuauauugccagugucaggcagguugaauaggggagcgaugaagcacugggcagccccacuggggacaccagguaucauucagaaugaauugcaaaggaauaagaauaauucuuuuuaaaggggcauguguguaucugaaucaagcuuagccaagccaaauuuauccagcuaucagaguuccaaaaagccguccgugugugcccuccuacauuagggugugcuguggccaugcuaauccccauuuuuuguuuuauuucaaaucacacacagauagaaucugcaaacugcuucagaucaaacaggucugauuguguguaaauacauauguccuuuuuaauuuuuauuauuaaugguugcuucaguuuugcaucagugcaugguuaaaagcaauacacaucagcuauuucaugacuucauaucuccaaaugaauuauuucuccucuuuuuuuguuuguuuguuugugcagucagcugaagaaauguuaacaucucacucuaaaucucucaguggagucucuguucccuucucugauauaacagauggguuacugcuuguuauaauuauuaacauuguggugugggccagggcuagggugggcaagauugacuauuucuuugggcuggggaggggccagucguuaggguauggaauguuaacucaaguggugacugacuguuuccguaauaccaggucguuguggcugcacgcucuaguaauugaggcuguguacuucaccgagcuugugguagagccuagggcaaaccgcugucccaagagaaugcugggauagauagaguuagccaauacgagucugaacguggugauuuugcugguuguuuagcuccagauguuggcaugcuuaguuuuuaaugugauuaauaaauguggcgccauaucccuccccacgccugaacccugucucuucuaccuccuucccacccuuguucuuuuugaaaaacuuaagaaacaguaaugaaaaccuugguguuucaaacugcacuuuguucucauguuuuauaaaagccuuuagauuugcuaguaagagugaaagcugaaaaaacgguuucucagccugaaauuucuaugcacuuugaaaucuggaauagaaauaaauauaucugaauuuucuuuuucucacauuuugugauauguuuuguugaauaaagcagcaaaaauacuuucgaguaaguguaugugugugugugcguguguguguguaagagagagagagaggaauacauccaugauacacaauuaauuuuucuacuuuuggaguagucauuagugaauuaccaaguuaguuuaguaggauauugccuaucuauccuaaaauaguucaucuuuuaaagguuucucuguaaugccauuauuauaaaguaaucaggagaauaaucauguuaaagucaucugcuuuaaaaaaaacucuucauguguuuuuucuuagugcugauauucuugagccuuuuguuuucaguaaaguauuugccaacccuguucuguuuucuuccacuugaaaagcagagaacuucaucauguuuaaacuucaaagucagacuugacuuaucaaagaaggaaaccgcuacagauagauucucuccaucuccuucuggauuggaaggaagauucuuuuccauagucugauccauuugaauuguuuugauuagcaguaacauuacuccuaaaccaccaagguuccuauggcuuccuguaggccuaggaaaaugaggggaaauugguucugucagcaaccucacuuagaaccuguuuuuuaagaauacagcuuaaagccaugauuugauagaauacucagagaucguaccuccaguaccucacucagucuuccugagagucaggugugaaaccuacccuugguugaguacuuuugaaccucaguaucccuuugcaagaauuuauaccucugccguauggcauaagacuucaguuuuuaauuuuuuuaccuagguaaacaugaauugggcuuuaacugcuuuuguugccuuaacuuuaaaauuuuuuuaauguuacuuugaugguuggaguaauacuaaagaguaaaaugcugaauuacccuuguuugcaaagaaguuuuacuaaauagcccugcuguaacuuuacacuagcaaacaaauucuaaacuaauggaaccaucucuaguuauaaugaaaaauuacuaggguucauuuuaguguuaaaauuccaacuguaauuaacauuugcuuuguuuaacaaaugcuuaaaaaaaaaaaagguaaagaaauacuuuaguuaguuuaauuauguuguggccaggauuuacagcuuugcccagauccuggcuagaauuccaaggaaccauguugaucagaaacggcccccaagggugcuuccugccauguucccauucauuaccauuucauugucaguguuugguaauauuaauuagagucuucauauaucucuggaagaauucguaauuaagaaggaaauguuuacuuucuaagucacucauuugaaaaacaaaggaggaauaauguauaaccacugaaagccagucagggauuuuuuuaaguacauuugaaacuacccugacuucaagcagcauaaacuugaagagcaggaauaaauuucccucacaaugcaguuucuucauuuagagaaagcauaaauuauauaaggaagaagcaaaaggcuuuagaagcucauaagaaauuauagguauuucuaaaauaagggguaacaaauaaaagaagcaagcuaggacuugccaugcaagaugguuaagaagaacagggguccccuuagaaaauaguuguucucaaucccaagaaaugauacagaaguaaauuugaaauuucuuuuguagauuuagaaaaaucgaacauuugaaaaaauaggaaguagaaagcacagggcagaaaccuucagauauccaugagaaaugagcacauuuuauccacagaaauaaaauguuuaugcuauuguucacuacugaaaugauguucaguugggccaguugaacauaguuguuuuugauagugaaaggccaauaauaaaaauuugcaucugaauuacguuuagguaaaauagaugaauucuauuucauaaauaauaaaaaguagaguuugccacuuuuaaaaauauccugucucauguggcaagcauuuguuguugugauugucucuugaaaugcuuucugaaagagugcaugauucacccugauagugaaaaccuuuuguauauuugaguuaucuaaacugaguugaaauagaaggaugugaugguuugaaauucuuuaggacugagaggauauuuggacuauuggaagaaaagcucagagucuacuguaagauuaauauguaagaaucucaaaaccuuuuagggaaggaaaaugcaguuaagugcuagaagcaggguuccugaucuauuugaauccagccaaagaauccucagaaauuuguaauugauuugcucaaguaugaaauguagaucugaguuggcaaacuuuccguaaagggccaagugguaaauauuuuuggcuuuguaggacauuggucucugucacaaguacuuucaaaaacagguggcaagcugcauuggcucacaggccagaguuugcugaccccugaucuacauuguuuuuccuucuaaauauuaccugauuaucuuagcuucuuggcaaacaugcuaggccggauggagcagagguuucuguuacaugcuguagucucuuauuaaugaaucaauccaagaacacguuagagaaucugaagucaacacauacagauuucauauauuuuaacuuuauaauuuauauuucuugucagagugcucccaacuugcuguaaauauuuucgcuuuugaaaguuccaacaaagacugugaaguaagacagauucaaaaucauaucuucauuccuuguauuuaacagguacuaccaaacuuuacuuuuaauacuaucacaaauuggaaagcaaauccuugcauaucguagggcuuaauuuuuuauuggaggaauaauaacaugcagacugaugcaguuugaaacauuuucuucccaugugugugucuauguuugugucagucccugugucuacauguguguacgucugugugugggcggguguguguuuuucuguacaccuggggggagagguaucuguaaagucaguucucuucucuccuguaggguggauaugcagccuacagauaugcacagccugcuacugcaaccgcagccaccgcugcugcagccgcugcagccgcuuacagugacggguauguacagagacaguggugagcuuugggaugcaugagagcuguuccaucccaaaaugucacccauuuuccucccuucaccauuuccacagcagcucuuagcacaucgggcaucuugccagccugggcuuucugcagaccucuugauggccucugucaugccuaaagcacaaggcaccgacucuguccuccacucccucuuucuuguucucaucucuucuuugacuuugacuccagucccucucuuccucaucuccaacuccuuucuuuuccauuuuauggaaguacuucagauuuuuuucaguuauugcauuugggaguagaaauagaaagguuuuuuccuauuccuuguaauuccaguuuccuuaugauaauccaagaccaagugacucacaagucuuaaagcacaguaaucccuuuaauuuuuuuagaucauacacuuuucuuuaucugucugauuguguuucuucuuuccaguuauggcaggguguacacagccgaccccuaccaugcccuugccccugccgcuagcuauggaguuggcgcugugguaaguauauaauauaccauugcuuuauaaaaccauuucauuccuucuuuuacccguagacuacagaagaucuagggagguaguaaauucagccuuucauccaccaucaagguauuaaagccacauagaucuaccuggaaguuucaugucacccucuuuauuuguguguuauuauaaugugagccacauggccuaguuaagggcagcagaaaggaaugaucauugauaauaugccccgaguaguggcaugauuugcgagagaaauaggggaacuggugaauguuuucuauugguucaaauguugagugcauaccuguggcauaguuucauugauagguguuggcaaaggagcauggagcauaaggcuguaguauucacaguaagcuuuucaaaaacuuaaguuucaaaugcaaaucuaaaggaugucucugcucuuccuaagccuucugguagauaguacuagaaauuccuaagugaaugcuuuauaggauauuuuauuauugauuauugauaacaauuguggcaaaauaugguguuguugauagaaguaucgaagaaguccauagaacuagcauaauuucuucugaccaaccaccucacugcaguauuauuguguuggcuuggaugccuccaguuucagugauuaggacucacaggcugcaacaaagacaggccauuccacagugacaccucugccagggcuuucucucuaauccaaaaugcaacugggcaacuaccucuggacauggguagaguuguuugaaaaggagacagaaugaaauguaaaauguaagaccuaaaggaauaugagaaagcuacuucucacaccaaauuucuacugaugaagauuuguggaaggaaguaauagggggcccugagggaauauauguuuauaaaugaaguagagcauuacaauauaacggcagugguagaagugccugagguuguauuucguccuaaaaugauauaaguccuaugcuaaaagaaugaccugagaaagaugcauuccugggaaacuucuaauugaaagagauaagccauuagauaaagucauuugauaaacauaaaggaauaaagccuaguuaaaaccccagcuagauauguaaaugugaauaugucaagaaacagccuaguuggugugcuucguagaugauagaggaaacagacuuuauuaaagacuggcucagguuuagauguggcaccaucucaaacaugggcugugaccacacauggcagggaucgugucagaaguaacgugcacugccgaugggucauaugugagaaggagaaacuggugaucuguuuuccaccaggauuauaaggcuguauc

SEQ ID NO: 17848 - RNA, 17946 nt, Homo sapiens
cagcgaggaggaggaggaggcggggcaggugggcuaugguugcuuggagagugcauccggcccgguacuugugaucggaggagagccggaucguccuuccuugaacccucuggguagggcugugcugaggggcugggcggggagcacaggccguguccgcucgcuugcaccuuuucagacugccgugucaggccucgagccgggcccaccuggagcccuccccugcccacccgcccccagcgcccgauauccgcccccggcccagaagggccgggcucggucauccccagucccgucgcggccacugacccuugagaucagcccuccccuccccaccuucccgucccaggccagcccagggcccgaagcccacccacucgcgucucuagcagccgcucuuguccucuggguacggcucgcgggaguguugguuaccauggugaagcuggcagccaaaugcauccuggcaggugagucugaaaacuugcgcuugaauacgguggucucuggaguccagagccuucauaauucauccagagcuuuuguucaccuaaauugccuaccuuuuccuuucucucucccaaaggcgaguuacugcaauuacugauacaguaaauuacguuaggcguggaagaaugaucuuccagggcacuucgcagcuccaguggauuucccccugcucccugucacauacucugagaccaccuucaccaguugaggugacucguuaaaaaaucacuaguuacaacucuggagaagcagacuuguuaaaacaaaacaaaacaaacaaagcuuaagcaaaccuugagugcuucagcuaaacauauacuguaccccaaaguuaggcaucagugacuuugguagucuuuacuaugggauuuuucccccgaccucacccccucugauaacggugaccugaguguagugaccagaguuugcaaaaggcacuuguguguugucuuuaagacccaaaguuacugugcugccccacuccaagaagggcauaaauguugagucucccaaaggcaggaaucuuuguuuuguugacugauacaucccaagcacccagaacaaugccuggaacauaguagguacucaauaaauacuuuuagaauggaugaauaugugaauauguggcaugcacauuuguaguguaccccuuguaucagucugcacauuuagaaaaacaauauuuuggauuauagacugcgaaacacauaugcauguuacugagugcuuacugcaugugaagcacacauauuucauguaaucgucucaccauagcacacugggcuagguacuggauuguuuuucuuuuuuuuuuuuuuuuuugagacggagucucacgcuguugcccaggcuggagggcaguggcgcaaucucggcucacugcaaccuccaccucccugguucaagcaauuccccugccucagccucccaaguagcugggauuacaggcgcaagccaccaugcccggcuaauuuuuuuuuguauuuuuaauagagcugggguuucaccauguuggccagacuggucucgaacuccugacuucaggugauccacccaccucggccucccaaagugcugggauuacaggcaugagccacugcgcccggccagguacuggauuguucugaucuuacugaggcacugagagaugucagccaaggucaaccccuagugaaggcccuaugcaggauuucagccccuagaucuggccaacuccaaaacucuuaacucguguuucuguugaaaccugugaccuuuccaggcuucccuggccagcucaggaaagaaguggugagaaauuauauagagaaaaagagauuccuguuuuaaaaaauuccccucuuccagacugagaauaaaugauaauauuuuuaauggcuuuuauaauuugaaaauaaaagggucacacagaaagaugacugacaguaguaacugaaucauacuggagcaaaauaaauuaaugguucucaggagaaucuccaguuuccagagcaccagaggaggcaguguuguguaacaaaaguaauuuugccuguuccucuuauuggcugugucaucuuggacgaagcacuuuuugagcuuuaauuuccuuauggauaaggugggaacauuauuuucugaaguuacuuuuuuuuuuaaaugggcuucucucuggguucuuuuuaaauucgguuuucaucauggagcuaacuuacuggcgcuuugggugcaucagcucugcuagacccucaauacagguggucucauugaauccucauagcaacccugugggauuggcauuauugccauccucauuuacagaugaggcaacugaggcccagaaaaaugagaacauuugccaugggucacagagcuggaaguggcagagcuguaugauccagacccugggucccaaucugauuuccagggcuuuagcccaagcuacucuguccucaaguagugcuccucuguguccuucuauuuuuuuuuuuuuuuuuuuugagacggaguuucacucucauugccuaagcuggagugcaauggcacaaucucagcucacugcaaccuccaccuccuggguucaagcgauucuucugccucagccucccaaguagcugggauuacaggcgcccaccaccauacccagcuaauuuuuuguauuuuuuaguggagacuggguuucaccauguuagccaggcuggucuugaacuccugacgucaggugaucugcccgccucggccucccaaagugcugggauuacaggcgugagucacugugcccggaccuuuuuuuuugaggcguaauuucacucugucucccaggcuggagugcaguggugcacaaccuuagcucacugcaacuuccaccuccuggguuuaaaugauucccugccucagccucccgagcagccggggauacaggcacacaccaccaugcccaguuaauuuuuguauuuuuaguagagaugggguuucaccaguuggucaggcuggucuugaacuccagaccucaagugauccaccugccucagccucccaaagugcugggauuacaggcgugagccacccacuaugcccggccucuuugugcccuucuuuacccccaacucccuuggguaguucuuucaccugagugcagccacugccuaguuaguggcuccugaacuccagccugcgccucaaucugcagccucuuuucagggauuccacagcauuuccucuuggaaguuuccagggaccaaaagaccucagcccagaaaucagcccccucugacaccuguccacccacccccaccacacacaugccauugguuuuauuuuuccauccaugacccacagcccuacuguuuaaacugaguuacucuguuuuuucucucacauaacuggucauugaaggaccugacguucaguucaaguguuuaugcauugaacagauacucgcugagcaccuacuacgucagagucaccgugcaaggugcagugggccugcaagcaugagucaguugcacucaaggaagaacuaagaugcgugugauacguucuaacacagcgaacacaaagugaaugcccuuugugugccagaugcggggaaaugccuccaggcacagcugcuacuuguucugguucuggagaagaaagaaaacaacauuugacauugaucuguauuuuguuuacuuuuaaaaaaacacuuaaauaguacuuauauaugccaggcacugugcauauuaacucauuaaauccucauaacaauucugugggguaggugcuaugauuaucuuagguuauacauguugcagcugaggcacagagagguuaaguaacugauuuaaacucacacagcuagaaagugauggagcuggagucuggcuccagagucugugcccuuaaguaccauaauaugcugccucuugauauacauggagaugguaauagagccuccugggaggguugcucugacaucacaucgugcgcuaccacugagcaacgauccacguuagccacacagauaaagaugaaggagggagagauggccuucagaggcugugcaggaaggguauucuuugagcuuuccuugcagagaauggacaggauuugaauuuggucuagggguaccuggaaggagguggccuugaggaauuuccagggacugggcgaacaggaaugcagagcccagauuugggguaagggauuacuagggagagagugggaagguggguuagggcugaccguggagauggguaggcuaugaaggaauccucagugggguuugugugaagguuugccaagauggaggcacugugucauggggguccaccuguugaugccacccacuggguggauaacagccgggagaaaaaagaagagaaaagaaguguucaaggcacagucgggaagacagaaaacgcagucgucauuucagcagagaaauuuuaauguauggaauugcuucaucaaguguuggagaacugaggaagcaagaaggcagcauugaguugacacagauuggcgggcagaggucgggguugucagaagcuugaagagacccagggagcugggauccggaccccugaggaaggggcccugcccggcuggucccggcaccucaggaguucagucaccugccgcgugaccccagcacaugccacagagcaccaggacccauuucccacugggaggagcccagcccuguguucagggcaagacacaccaaaccaguuccaaaccauccuggaggguccauguuuuaagaccacuccugguaccaaggacuacauaagucaggggccaggcaaaaaccagcaacucuacucggcauuucaacagugaggauuucaguaggaugugaaugacacuggugcuagaggacuggaagaggaaaagggggaaacugaggcagcacggguaguaacugcaggaaggagcaccaccucuugggcuggggaagcagagggaagcauguggggcucucagcccagaagcagggaggaggggcccugggagccaagguguggaucucugagaagagggcacugcccgcuggcgcuguuuccucugggggcaacaauaagcuggucugggaguagggaaacacacacacacacacacaccccaagacaggaagcaguuagugcugcuggggugcaggccauugcuaggguaguacuaagaaaaaggagaagcaggcgggaagagcaguguccucucccccgacuccagccuucccuucuucuuccagaacucccauuggcagagccuaacaggaagcuccuagcaagggagaaaugugucugcagaggccccuccccugcacacuguggaaggaugggcuuggggcugagauagaaacccagcagugaggcugagcuaacuggggcagggucagcagggagggccgagcagaggugggcugagacucagccaaggaugugaggaaugcaagggaggcugccugaagaugggaggaaggaggaggagcagucagaggugacccguugaaucuggggacgaugaaaacacacgguggcgucacaaacagaaagcuugggugaugggggcagcccacucaggaccagggcaugacggagcuuggcuguagacagacugagguuggaggaagguccuucauucuaguggcaacgcacacggguuuuuggauauacagacaaagcuugggagggagauccugccuucugucaaggugaugagagucagugggacggaguggacuaggagcagagcgccgccgaugacaggcccaugggaaugcccacacucggggggcagaggggcaggcagauagcaggagaaccaggccagggcagggucacugaggccacggggacaggacucgggaaggaaggggucacuucaggcugacucacauccuucagagaagucaaggaggaugagaaccaagaaaaggccaucggccuuggcaacugugaggucacaggugaucucgcaucgugcccuugcagacgucauccucucuguccugcagcgcccugccugcugucgcccccaggcccagcccuugccccuagggaagccucccuccccagugaauccucucauucauuucuuuucucgaugcuucccagacgccuugcuucucaguuugugcuauuugaauuugcacuugucauccuguugcucugcaaauguguuuaucaguuauuucaccucccugugcuucugagcccucauagccaacacaggcgguuuccuguaaguguuggugacucugacugacagucagaggaaagauuuaugaaauuaaccagaacaaaucugugaggaaucucauaagcaggaggagccaacuuccagcugaauucaggagcagagcugaaguugggagggcgggugcagucagggcccaaggaaggaaagcgaugcgcucuguuugcuccgagauggguggguaccccuugacagucuaggcugugguugccccagaugucauggaaggcggugaggagggcuuggagggacagcauuaaaaaugggucagaacucacuucuguaaucccagcacuuuggcaggcagaggcaggcagaucaccugaggucaagaguuugugaucaggcuggccaaccuggugaaaccccgucucuacuaaaaauacaaacauuagcuggucaugguggcgugcaccuguagucccagcuacucgggaggcuaaggcaggagaaucacuugaacccgggaggcggagguugcagcgagccuagaucgcaccacuguacuucagccugcgugacagagacuccaucucaaaacaagaaaagugucagaaguggucccugagcucuaggagaggagcagggccugggaagagcgugagguuggaauccugggcgaguuacccagccucucugagccucagucucuucaucugucagguaaggugaaugauaccuuggcggggaaggaaugaaugggauugugugaacagguccaugaggggggcucagcacauauugguucccuucuaaggagugaugacaaauagaaaagcaggaccugaauagcucacucaaaccuggaggaguucacauaaaaugaaaugccacaagcauugaaauaauugucuuacaagggaaaauuauaggugggaaaagucaaaacugaaaagugaacaguggcagacuguugagaagucgaggaaaggaguguugaagccgacuguaaaaugggaagcaaaggugaagagaugguaccaagugaugugaguuggaagccgcggagggcggugcugauuuugcuaaggauccagaggaugagaagcagaaagcacguguucugccaggaccuggacgguggagugcaaguccacguaagacucaggaggaaaagaggcugcaaauggaaacaaucagcaucaaaggaggcucagcagagccaugagagggaaaauggggagggcaaagggaauuaaagaugggcagggagagcuuccagcacccgugacgggcacgggaggagcgcucgauuaaauggcucccagcagucuugugaaaggcucaggucucagacugaaaacugcgacauaaaccuuuaguucugagggaccaguuucuggggcuguugaccagcagaggagagggagauaaagccaguaggugagagaugagcuuggaggaggugacugcuauugcagauagaauugguggagaggccccugggaagaagaauccuugggucacagacagguauucugcgauggagauggagcauagcauuuggaaagagauuucagaaugaugaacacagccucagacuucuugcuucccacaaaugcagagacccuuccaccccccacgccccacacaaaaaaguauucagguggaagcugucaacccagguugggucaguuggacaggugacucugccugucagugccagucacacuucuuuaccuucaagacuucaaaguaaauuccaguuuggaagugacagcuuuuccccauagggcguguuucaguggaagagcgucaguuccguuuccagggccccaaagcccucuguaaguucuguuaccuucugggucaguuccuguggauaaaaggcuuagccgugcagaagugugcucuggcuguugugagguuugcagaucagucucauggaccugugcccugcccgcggccucagaacaaguucccgugagaggcaaguacaucucucaaaacucauugaaguuuuugguuucuagacuaauguucugcagcgggagauucucaagucagaugagaacuaaggcguucuuuuucuucuuuucugaucucacaggagacccagcagugggcaagaccgcccuggcacagaucuuccgcagugauggagcccauuuccagaaaagcuacacccuggugagcuggggugucaagaccuggccacagcuuauagagaagugcucgguucaccaugaugagugacuucgaaguuccuugagggaagccuuaagacagcugaugaaaggcugcucagagggccacguggagaucguuuuuuccacuagcccagggugagagguuggcuacagagcagaauggccacaagcaacuuggccaccacguguagcagcucacaucagggcagggagguggagaggacuaguugguccccucugacuucugcaugcugagcugcuucucacaagaaugaguccagaacaaacccuuccacuggagauagcccuccugggaucggggugcuuguguguccuccuguaacaugcucucccuuugggggcccucagugcuaacauucuugguguuccucggcagacaacaggaauggauuugguggugaagacagugccaguuccugacacgggagacaguguggugagugaugccuuuacccaggggaacucagggcucccccagcugggcccagggucucuguggucacaccauccucccuaggagagaugcagugcaaggcuguggucuagacuuggcugagcauuucggaauagaaucgggaagcauucaagggagggacugaggagguggaggaggaaggaaggaaggaggacuaggagaugggccuggcccuugaggaacuuguucucuacuaucaagguucuugagucucuuuaugggaaccuggggcucuugaaagugaauugcaagacguuauguuugugugugcuuuucuagagagaggguuuguagcuuucaccagauuccuaaagaggucugcgagaaaaaaaaaaaaaguauaaguacuucugaugaagagaaaggugaguucccagguaaccaauaugcaaaacagacaauggugcugauguuuagacgguguaugccagggaucagaggccagccaggaaauacccagugccaggagggagcuugugggggagccgaggggugauuuccuaggggaccagcccuggggguucucacaugggcuggggaagguuuggacagggcaggaagggucaucccgcacccucugucugccucacaccuuagccaucccagaagggugacagaauguccuacuuuaaacaccuuccccaggccuacucagugaccuccuuuagaaagaauuguucuaagauuugaaaaucaauuugguuaacaaagugcagaaugaccuuuuggaaaccagagcacucaccggccuguuuagcauucuguucugccaggugggaagucagcuuguuccugguauuuuugcacucaggguuacaagaggugagacuccacacagaaagugcugguuggugcgagaacccgucguacugccucucuaagacucuggaguucgcuccuuuccccuucaucuucucucgugccugggagaaaagacagagcaugugugaagaugugggugccuguauuucaccccuaagacaaguccagugugaguugagagugauaccagugacucguagcuugugguuuuuccacguggagacuuuucuugcuuuucugauuguaggaacucuucauuuuugacucugcuggcaaggagcuguuuucggaaaugcuggauaaauuggcaaguagcacguggucuuuuuccugacugucaccaccuccugccaaaacguuuaccccugacagugcucacacagcaguuucccugcacugugcuguugggaagcucccauggcauuacucuuuaaggggcauuccucccagcccaggacucauggauacuuggcaagaaggaguggcugaugcgugugacugcccgggccccagcucuggggugcccaggauccaaugggccaagagcccugcggcucgguccuugcagcccucccccugugaggccucccuucuuuagagcaacacuguccuuucagaugguguccccuaccucccaagacaguacagacugccuccucccccucugggaagugcuguagaggccucagccuauaacgaggcucacuuucugccguuccacugggguuugcucuggaacaugccccugcugcugcccaggccucaccaugccccauccacccccgucccaccagccucgcaggauccacuugcuguaccuuccacgguaacagucucacuaaucugggccagugagcuaauuagaagguuugaguucuccagagcccuccccugccuuuccaagaacagccacauuuuaaugggaacaguuuucugccccuuuuuuuuuguugccuaagagaaguagaucuaaugauagugauuucauacaggguuggcuucaugcaucgguucacgacguucaccccaauugccuaccgugugcauggccuggcacuggggcugccaugcccagcagaagggaagauguauuagggcaaauccaggccaugugccacccgucagcucacacccuccccuccagccggcccugacuccugguucacccgcucuggcuuuagcuugaugccaggccucuccaggacccccucacugaagccuggaagaaggaggauuucuugaguuaaaaccacgcugaagugucuccugcgugcauguaacagagcucaauguguucuagcaggaguucaagaguuaaucuguggagugaaggguucaucaguuuaguccacgguccucccaucccugacacugccagaagccagcacagccuuguagggugaggaggagcccuccagaguggaaucugggcccgccuuccaaggaucugaaagggaauccaaucuggagggaaaaggauucucuucuguacccugggagguuacuggcaccccggaaauaaaccagguccuaauugugcgagguugggggauccagaaaccagagcauggccaagagucacgagcaccagggugcgcacccacagccuguacagggccauucuacauccaggggcaggcagcaggacaucccaggacucugagcagccccugaaggcgacagccccugagaguguagccuuggcucuuaauugggucauggagcccuguccaguugucagugugguuuggauuaggcugaugcagagauggcaagagaagcagaaagugcccucugcauuuuaacaagccagcccuuauuaagaagaugcaagcaaacaagcuucccaggcuggcuaaugaagaaagaaucuucuuucagggcugcaaagcacaaaaauguaacuugcaugguggugggcucuugauaagaaugaguggagaaugaaugaaugaggccagcugcaggugaaagcagauuguuggguagagaagaacucagucgucccccaucucugucaucguugucuuuguuuuuaaagccugucaggccuggacaagucacuuacccucccugaauuugguuucuucagcuacaaaguggaaauauucagacacucuaccgaguugggagguuucacagugaggcacggaagugcccagcagagccuggcccagacaugagcucuuguccuuggcggcaccgccccagcccugccuccugccacugaacguggcccuccguucauuccuuuggggaaauuguuggacaucuggggguguggcuguuuucguuucuuguuucccucugcuccccauacccuuucccuuggaaggccaaauugucucccagccuugaagucacuuuuccuguuacugacccauacucauccugucccucuugcacagugggagagucccaaugucuuaugucucgucuaugaugugaccaaugaagaauccuucaacaacugcagcaaguggcuggagaaggcucggucacaggcuccaggcaucucucucccagguacgggcugcagacacccauguuucccagcggcaucucuguccuuugguucaagagcacaagggcauugcagagguagcuguggguggagaaggggcccugggcuuggacuuugauggccuaaggcguacacuggcccugccacuuagcagccaugccaaccucggugagucaccacacacaccucucccagucuaggaaacgggaaugaagacacgcaccuggcagggcuguggggagacucaauaacgggagggugcuguaauaucaguuguuaauuccagaaagcuaaccccagggaagaguuccuaauuuucucuuguauaugggguacaaguaaacauucaagccuguugucacuucugaaugcuuuaaaucaguuuauuuuucgucccuaugugagaucaacaaauucuccucauuauagaccggggaaagugaucuccagagacaggcucaaaaauuagcugcagcugaugcagcugggagcugaacuaaauuaccucugaaucccugacuccgagccgaguccuuagauuacuauuaaugaccaguuuacaguuugcuccgugugcucagaauuauuacaaaggcucacauaaauuuggcccucgccuucaggcguuugcagcccuuuaaggaggcaagggagacagauacacgugaggucuagaaaaagaccuagcagaaguugugcaugaaaagcgaagcccaccugucucucuguggcccuuggggccaucacgagagacccccggcuuucccugugggggggcucaccaccucgagucaggcagcucucagaggaugcuuuacaccccucaaaaauagugcucucaucucgcccgcuguccuuccagagugugacagugaagugccauauuuugguuguuucuucugaguagguguuuuaguugggaacaagacagaccuggccggcagacgagcaguggacucagcugaggcccgggcaugggcgcugggccagggccuggaauguuuugaaacauccguggugaguauuuccacuugccucgucgccaagucuggagugggccucugcuggcagcggucuugcacaugaccucacgugcagggagcuguuauuccaccauaugcagagucucauuuggaacugauguuuacauucuuacccgagaucucuucucaguauagcaguagcugcucagacauaacaggaaagcagaucagccagccaacccugggaaaagguguaucucaacuaguaagaaauacaagugcuuugugugcggugaucaugacccucgacguuugcaugcaauauucuggguucagauguuguuggaacauuguuucauguggcucucacaaccaguccugugaaccagaaguuggccccacagcucccauuccaguguugaggagcucaagugacuuguccaaggucccaugauuagcgaaggguggagccaggauuaggacucauggccucuaauucccaucgguaccacccauccucaccuugcugcagccccagggugacuccaggccacaaagugccugccaguuaaaagagcagaagaccucauuacaaaaagcaagugauuuucagcgucuucaguacacuuuuccuggcaaaaacugcaauuacuuuugcaccaaccuaauguaucaugauuuuagcuguccagcacugaggaaccugcuuccuguguuugggaguuuuaaagucccauccuccuugaggccaagaugcagccaugugacccaggcugcaccaaucagaccccucacaugagacuccacuaggaagggcaugaagugaugaucugcccucuaggaacagguguggcccugaacauccaucucagagccagcaggggcccgaguguugguugcccugccccucgccaggguugcuagcuggggagaucaccaggccuggcacagucauggucguaacuuggaccucaccuuguggccuuuagaccugauucuguggcccucagaauugagucaugggcugguuaauguucuggaggucaucuucugcuccagcuugacuuuggcucuaggcacuucugcuauugcaucuaggaaccuugaccagugcugccguccgagcuuauaaaacucccccaaagcagcaugcuuccuuagggaaaguacagcaguaaaggcaggcacucugaccucccauggugaguggcagaacucgccgugggaaccuggacauguuauuucaccuguugguggcucaggcuuguaaagugaggaucauaaaauacaucccuuaucgaguaauaaauaugagaaucaaguaauaugucgcauauaaaacauggaucacagagucuggcgccugguaaacacucaguagauguuagcuuucuuaaaguauaaauauuaccccuagaaucuuguuuauacuguuauuacuuacuaaauccuuguauucauggcuugugcagagauaaauaucacccuugccucugguccaauuaucacaaaugcuaaauuaaugaagcccaaaucagcuuuuccuguauagaggguuugccaucuuuucugcagcacaccuuugugcaaagcaguaggcgguagugcccuagcaaacaggauuucaguauucucccuuccuccauucauuugugaaauugucccugcaccccaauauuccauauucccuagaacgcuugauagaacucagaaauuaaaacccaccccaaccuccaaaacaggagucaccaaaggccagugggcuacggguuaaacucuguugagguguugaagugggugggugggugugaacuacucuugaagaggcugcaguaagcacuugcuauuaucugugcaaguuaacuaguccccccugaguugaggcucacagaagcaccgcuggcagcucgguuaagaaagcuguaauuaaaaaggaaauauaagcaaacgcagcuugagacgcagccaagggcuggcgccaagcucaucuccuccucucuucugccuaaacaccgcagugaccauccugccuacccaaaggaggucccuacaaacaagugcaagaacaauccgcgcugaucacugcccucccaggcaagcgaggaguggggaaguaacguuugaugagggccuacugugugcuagguguuuugcacacauuauuuguuuaggcuucauaacagcccuacaagguaacacuccuguguuguauagaugacagacucagaaagguuguguagcuugcccugguugcauaguuaaacgagggcuagaaacaggacuaggagucaggccuguccagcuggaaaacuuggguuuucuagaagggguacccuggccuccugcggagccugcugugggacucugcagaacacaauucaaggccagacugaacacuagccugaaccugcccugagaaucccucuaagccgaccuacuccacagcuguccugacuguguaagcgagaugaugauuagugaucagacgaaaggauuccugucauugguaacccucucaaaguauuuggaaaacaguucaauuuucaucuauuucagaagcacgccguggugucuauugaggcucaccugcauugaauuccuuccuuuuuauguugcgaucucccaagauugcauuguggaguguuuucgaauccauuuugaaauccccgugcgugcgcuaugcaggccucagucuuuuuccauuccauucuuaacucuacuuucgacggaagcaguguuuuaccccgacacuggcuugccuaggaccuugugcucugcacaacuagcagggcccggcaggauguacugaauucuugcucucguguccagcuggacggugauggcuuucaaguccuuggcuguugggagcuuacuauaaauguucgucuuggcuacaaacucuccacucuuuccucggcacucucucagcauugccaccacugucuuuccucuuggccaacuguuuucuuuacuuaggcuuucccuugcuagaaaguccagguaacuuucuccacgggaccugguuuccuucgcacaucccagcuggccucgaggaaagguagcucuucccaaaucagagaaucuggaugcugggcugggcucugcaccaaccagcugggccgcuucacccgcugggccccaaacuacucaucugugaagcgaaggcaccgcgcuugaugccuucugcaacguucuucaguuuggaaauccuucuguuucguuggggauauuucacggccucuucucaagguugcacuuuugccagcugccagggaucgucucaaaacagguucuuagugcauucauagcuugagcugcugucuugaaaguaguacauuccuuuuucugccaacuuuuuucugagaaaguuuuugaaugcacacgugcacccaacagagugagaguggcuguuaagagagagggcgccauuuccuuugcccuccagccugucccugugcacccuggaggggcccguuuuuuccaccgcuuagauaaaaucuagggcaaguuccugaacuucucuuuucucucucagguaacaaaaauucuuuugggcuccuuuagucacaaagauauucacgauuucagguauuaaagugcccagcccugggugauugucaaaauucugaacuugauuuaaaguggcaccuccucucacagucuucgggagggagagaccggagccaggagugcagcguguuugcuggggucugucguggcccacuccacaccugcuggguggauccggcuggugccccaugggcgccucugagaugccccuccccaccccaucaguggcgcugucucaccugcaggcugcuucucacaggugguccccccucacuccuccugcagccccaguuccuggcuguucauucuuauugggacccgucacccuccuggaggcggucccagccgagcccccuuaagacagcaccaggcuggcuccacuuggcccccgcugguucagggaagugcugcugcagccguuuaguuugacaaaggaggcagcgaggccgucucauugguagcccucuccuggcuugcccagccaccaccucaccucgauuccucccaggccuggguccagcaccagccuaggaagagggugccccaugcugucuagcucuucuucgggauggggggcuccagguuccuugguauuuugcuuuggccuuuggagccucagucaaaacugaggaaaggugucauuuucacaucucgucacacguacagugacugcaacuaaaagcacaggcuuuguagaaacagacauggguucaggccccagcuccaccauucacaagguguguggcuuccugcaagguaccuucaucucugaguuaccugacuccaucugaguuuccuucuuguaaaacuggcauccaugaaaguggcuaccucgaagggcgugaagaugaaaugagguggaaaguagguagcccccgaaugagggaagcauugagugagagcuggcccucugacccuucuaaaagaacacagccaacuuuuuaaacugucuuuccagaaagagauggaaaacuucgaagccccuuuccacugccuugccaagcaguuccaccagcuguaccgggagaagguggagguuuuccgggcccuggcaugacgagcuggagcagaucgugcugcacaaccggagaagacagaauuaccucugcucuuuuaauauauaaugauggcuuuaaauaaaauuaggagaaaaugucgaagcagcagcuc

SEQ ID NO: 17849 - RNA, 11783 nt, Homo sapiens
gcgggagcagcgcggggcgggacccuacccgcggcccacgcggagccaggaggcgcggacuacagcucccggccugccccgcgugcgguccccgcccgcccccagcgcccgggaggaggaugcagacgccgcggccggcgaugaggauggaggccggggaggcagcgccgccggcgggggcgggcggccgcgccgcaggcggcuggggcaagugggugcggcucaacguggggggcacgguguuccugaccacccggcagacgcugugccgcgagcagaaguccuuccucagccgccugugccagggggaagagcugcagucggaccgggugaggcccccggggugggcggcgagcgggcgguggguccuccgcucgcccgacgcggggcugucgggccuggcucgcccgccaggcuggggacccggccggguucauuuccgaggaacuggaggcgggaagaagcggcaggaggaggggagggggaggugggucugguagugagggauguacccauugccguggcaacgggacgacgcaggccgcggccauuagaagcucuccagccgccccggaucggggccucuccuucuccuuuggggcuguggacagggagagaccugggaccuuuccucccucccaaaggggacuccugcucuggggaaggagucgacgaggcuacuucucccgcucuuugggauguggguggcggaugggugcagggagcuagcuggauggaggagcccuggggcgccuucugagcgggcugaaucuagaaggagcguuggcccagcgggcacuauuucugagcacccacccugacucugcugcacacugccugccgcgaccuugagucggacccuucccugcacugcgcucagccuccuuccucaucuguaacacgaagggcuggucugaagaugaccucuaaggucuccugucccccauccgugacccuccgaugcuguggccuuuggcaagucgccucaccucucaaugucuccgaucucucuguagagucgcauggaagcccacccugccucccugcccgcccgaguguccagugagauagugacuccuuuggaaacuuguaaacauccccugaaagccuagggaccugggggcgacaguggggcuggcuucaggggacagccucucagagggacauucuucgagcccugugcugggccaguugccacucagacauccucucaccggaugcucacagcaaacccugauuagggggagaggagugaguuucaaagaggccaaaucauuagccuaaggucacacauucaggaagagucagaagcagggcuugaacucagguccaucugaccccagugccuuuuugcuacuuugugccugcuccauccagggaagagcucucccuccacucuccuucccucccugugcgugugcgggguuggcuggggagaagccucacucuucucucaccgagcaucccucaccuccauaggaugagaccggggccuaccucauugaccgugaccccaccuacuucgggcccauccugaacuuccuccggcauggcaagcuggugcuggacaaggacauggcugaggagggugaguugguccagggggcuggccuggaccuuaugcagccugccagggcccucuguggaggccccaagccauuuggacaaccaggacggccaucugccugcuugguuguuuccugccucuucccagucggacggggcugauucccaagcaucugccugugccgagccuggggcucugccaagcggacgggcucaagcuuucccuggguacugucagggaggugaagagacacaugugcaggggauagaggaagucagcgaggcccuguggccucugcugugggcugugacgcccuuucucucuggccuccuaggaagccagguguggacggucacauccggaggcuggggugacaggaaugcaguguugacaggcauggggagagcucugucucucuuucucuggcugauccaguaucucaaauucugccuggugagggcuuguaaguggguggagcgggugacuguucacuaagucuggcagccugugcggcacagugcuggcuguggguggaggcaggagaggggggagucugcuucccaguggggcuuugguuauccccaggccuagguggccgaggcccuggauaugcccauauccgggccuaacaaacaguggggaggccaugucugggagaacgaccuguuagcagagcugcagccaggggcaaggacuacagucagugccaaguuaacucuucuuugggacacaggguguggcucugggucagcugauccagccagaccagcuugaauaugucacuucuccucacugcgucuccacugguaucuauucaaugggggcggugaucugccuucuggagggagaugucauaaauccugcaccugugcgugccuuccugcucugggccauggucugcccucccugagcccuaugggacacaguggucuggaggcccagcaacucucuaauaggucagggccacaacaccagaguccacuguaggugccuggcccugcagagccccacagcuugccuguuaaucccuaggggagcacagauaccaugggcguggccuaggcucaggagcaggccccaucgggagggaaguaaacaccccagcugcgucgcagccagcaccuguuuacacgcccugcauucucaaagcccugcuauucccacaccgucagacagcgcugucugggggcuagaggaucagacaggguuaucugggggcuaggggaucacacagggcuaucugggggcuaggagaucacacagggcuauccggaggcuaggggaucacacagggcuauccgggggcuaggggaucacgcagggcuauccgggggcuaggggauacacagggcuagggcucauccaggggauaggggaucugagaggagacuuacuagcugugugacacugagaaagugaccuaaccccucugugucugcaugcccccaucugugaaaugggggaccauagcacccaccucaccgagcugucaugaggauaaaaggaguuaauagugcagcauggagcucaguuccuggccggaggaugugggaugcagugcuagcugucugucaccugcagggcuccgcccagggcacuggggauaauucucguaaucaggcagcugcacucccugaccuccugcucuguguuugguccugugugggcaccggggacagagggcagaucagaaaugugagccccaucuuagccauuucaggcugcaaucaugaaguaacauagauuggguggcuuaugaaaaucagaaauuuauuucucuugguccuagaggcuagaaacccgagaucggggcacuguggcagguucuggugaggacuuucuuccggauugcagacugcugacuucucguuguguccucacauggcagaaagagagggagcuagcccucgcccgccccuucucgagagcuuguuuggagguucuagcaggggagcgcagcuacucacauacccuugaccaaaguccgguccuccucuaucggggguggucgcccccuucgauggagcucacagcuucgggagggacacaccuggagcagugagggaggaaggggacacacaucuagccagccagaucagcuaaaucaacccuggugaucaguggagugacagauguccccgccagaucgcccucacauccaauuagccuuucuuauaagaagacugauccuacccuggggacucuacccccaugaucucauuaccuccccuccuaaucccaucacaguuuucagcagguggauuuuuggggaacacacacauucugcucauaaugagcucuguccccagggagcccagaggccagucaaggaaagggcccaaagguccccugccuucugggagccuaggggagucgaaacagcugcaagcucaucgcuucacuggugggcugacuucuucaucucccagauuaacuuaacuguaagauggggacaguaaugccugcucuccucauaucccuggacuugugaugagcucgugcaggguguugcaaacuguaaggugaggcaguugggggaaugcauggacacaaggguaugugcuuacaguggggagacaugggcucuggagucugcagcgcuugaguucccucuggcacuuaccagcugugugaccuuggacaagcugcuucucuuugggagccucaguuuucccaguuguucaaugcagaugaugaaaguaccuccuucuaguucugagaauucaaaaauguaaugcaccuggcacuuagaaugugcuuaauaaauaggagcacauaaucaggggucaggcaaggcccugcucauggugacauucuggggaucagucccaaugacccugcugucucuugauagcccuaaagcugccccagacgguggccuggcagguaccccugggucaccgcacucagcacagcagagcuguguggcagccccucagccccuuccacaggaagugugggauccaaggaaagaaaugcucccucuuacuugaccccugaacucacagacacucagcucacccucagggcgggugaucagagcgagagguggguuucgggguggagggaacaagaggagaauggggcauggaggcagaaggagugaccugggaucuguucugucugugccagggguccuggaggaagccgaguucuacaacaucggcccgcugauccgcaucaucaaagaccggauggaagagaaggacuacacggucacccaggucgggagcaggggcagcacacacggccagggcaggggccaguggggagagagaggcugagagacggggcgggaagcagaggagguugggagagacaggaccaguguuugucauggggaggccgagcuggccuguaaggagaggcaugguugggcugacaggcugcccagcacagccccagacucggagacggacacugggguucagucccugucucagccccauuugcuguguguugggccaggcucgcccucuccggaccuugauuuucucuuaugggauagagaggggugggaauggcacacccaucccuuccucauaggcagaagggggucaguguggagguacagggugcccugcagaggaaaaugcaggauuagcaaauugugccuuuuguggcaucagauggucgccuggugggcucggcacaggcuguuggggcuggcguuugugaccuuggagccugggccucccuggccagucugcaggaggagggaaagagauuuuccgccuacucugggggaugugugaggguugggggacagguagugaggaaccauuucucaggcccaggggauuaaagaggggaggcuccgugucuccuugagggccugacuccuugagggugacccagaauguucccuaagccccacccauguucuuucuugaauuacccguguuccgguucugucuccuucacccuugagcugggugaccuugggcaaguaacuggaccucucugagccucaauggaaagucccguaaugccuaggauucuuggaaggauuaagugagauggugccugguaaaugccuggugaggagcaggugcucagagcauggcugccuccccccaaccaccucuucuuucucucccucucuucuucuuuggguauguugcgggggugguggcagcaggugcucaugccccuccuggggugccuggugcucccacaggugcccucuaugugacccuucugcccacaggucccacccaagcacguguaccgcgugcugcagugccaggaggaggagcucacgcaaauggucuccaccaugucugauggcuggcgcuucgagcaggugcgcuggggacaggggcgugccaccaggacaacccugggaccuccuagccucugaccaagcaggccccucccuuccugcagccccagccuuggguuccccaccacagucucccccaaccccaggguucuucugaaaucaaauuaaacaagguuaggagagaccacacuugguggcagguugaccgagagagaggauaggagccccaguggccauaggacagcacgggguguccuuguuggugggaguccucacagcaacuggguggugaucuaucugguggcaugagugagucuguggcccccgaaggacagcucaggugcaaggagaccagauccacauaggugaguggaguccacauugagucaguaccucuuagaacucagagucagcaucaugcgaucauagcaguuccugacacaguuuucagggucuccgcaggggacaugcccaguggccagcauugcaacaugcaggggagcccaaagcagugccuucccaugaggucuuuauggugaacggugguuccucccaguccagaugcaguuuacccaucgggagauccuuaucccgagggacuuuaucccuagucaugcagcugaccucccaccuuucagguuuccagaggagcagagccagaaagugagcccagggucaaaagugccuuuagagaaggagaggggguuggcuagccuuucuccacgcccacccacacguucccuggcacauggagacugcaaggcagaaggucggagcccccaggauggccuggagggauggaagaaugggccuagugcagagccagaggccuggcuucaccucuaggccuugccacagacaugccugccaccuugggcaaguuacaucuccugugcgggacccaguucccucaucggugaagugggcuaacaguaccuccucuguaggacucuugugagauuagaagggccaucaguaaagcuuacagcccuccguaggacucccuauguuggcauuagugucaugcaaaucauuagaaauccauauugaagucugcaacacucagagaggacuugggauccccgaugccauucccugcuccaccccuuccuagcugugaggccuucagcaggccugagauucucuucagggucccugagagcugaaugagacucaucaccuggaagaacuuucuuauuucuuagccagaagggcucugugggcgugguuauucuagggacccuggaacaagggcagggccacucugagagccucugggugucuuuggcaauugcacaggcucucagaggcugagcaagcaggccagggaccauuggucauuugcccuuuggucucaggaguggaccaccugucgucccaccucugcuuccaggagugaagggaauauucuguggggcuccaccuugccaaugccacccugcaaccuuguccuggggcugugucagccacaucuggaaugggggacagccgcccuuuagaggccuccgccugcauuuagaaaagggcccccuggcucuggggcuaggcuggagguggugguggggacagcgguaaugcugccacccuccaccagggaucgggccagccaagccaggcggaggggcugguccuggggcacagaccacaggcacagguugcaagggggaagacuccaccuuccugcccagaggugcccucuacaaacccaggagugggcccgacaagccgcaagauuaggaccugagcugguaucuugauuugagugccgaggucugucguauccugccccacggcccccaacaccaaccugcauuuuucuccccaugcuccgccccucuagcuggugaacaucggcuccuccuacaacuacggcagcgaggaccaggcagaguuccugugugugguguccaaggagcuccacagcaccccaaacgggcugagcucagaguccagccgcaaaaccaaggugagcccacccgccucagccuguguccggagaagucuccugucucccuccacccuccccgccugucccgccccugcgccugcaccaucccuccaccucucucccgccaccgcccaugcacaaccccaugcucacagccaccgccauccaucccaugccaccugccguuacccaggcccaggcugggagcagugaaaugagagcauccccagggugcagccggcguggacucagaggcuacaugaagggggccgcuuaguggccacugggcacuguggcauggacuaggggucagggcacaguguggcacucucugugugacuuaggacagggcuuguccucucccagcaccuuugcugcacucucugaagugagaggggaggaucacauacucuuuguagugccuuggagccuggaacuucugggaucccaaauggccguuuauuccccagggacaggugcauguccccagcuggccugagccaggaugaggaagccaccgcuguaaauccugccccuuucccaggcccccuccuuggcugcucugcaggauaggggcagccugguggcugccaguccuguguguccgccuggccuguugaggcagccuccugagagcacccuggcagcauccacuguaccacuguggggagagggcugagcggggguccugccauccuggacccagugcugugggaagucccaagggccuucgcagagccacagagcaggcgugaaccaggcugggaagaaggcaggcugcuccuccuggggcccaaccccacacaguggaggcuuaccucuggcuuccugucuaucugucugccucccuguccugcugugacgcacccugccugcccacccacccccaccacugccagggcugacgcugcccugcaagggugcagagcgagacugcuccuucugccucuuugggccaaagccccuggaccuggggugucagagacuggcuggcaucccagaucuggguggugucugcccuggggcuuccuuggccacauuucuacugaggagcagucuuuccaaacaaggccuucccaggcaccccucagggauaccccagucccacacccucccuguucugcuucauccccucccuccagccucgcucuauguaacagcagccaggcugaccccggagcaugcccacagcaucccauccucagcugcuuuccccaggcccuccccaagcugcccaggggaccggagaagaugcccccagcuucuguggcuggagcccuccccucuccugaggucccuuucaccuugccugagaccgggucuuuggggauagccagcaggcccuggccccucuguuagugucuccacucuuucuucccuggguccgccggcugguucacagagcacggaggagcagcuggaggagcagcagcagcaggaggaggagguggaggagguggagguggaacaggugcagguggaggcagaugcacaggagaaaggugcagccaacccccaggaggaugauugcuaagcaaagccggagccucccgcccacuccuugcuggagccagcugcagaaccgggggccccggggcugcugggggggcaccaggguuagcucagccacuugccuggcgccucacccgcauaaccaucccuucucucacuuucucuuugcagcccagucaucucaggaucccgcuaaccuuuucucccucccaccacugccuccuccuccgcuucccgcuggagguccugccucaucuucauccaccucuucuuccuccuggaucucaucugcacccugccucuucccucucugccccuguccggguuuucucucugccugcucacgccuccaucccgggucugcccuggucccagccucccgugcccuccacccaggcccccuggcccugcaucccagagcguccugccugccgccuccugcgccccuucugguaccuccugccucccagccuggggaggaggggcgcagcugcaccuccucugugcccacuaacccugccgggcaccucugagacugggcccuggcugcaggcccugcccccccuccucuccucccggccuccuccucacguuuccuccuugcagguucccguccgcacccucucagaccugaggcugagcuugcagugagggcuucuccucggccccucgcccgcccccagagcugccaucccugguuuguagcuuggcggugcuggagggagggguggagcgaggagggugcucaucucuugauccuuggacuugagccgagcuuucggcugauuaucuccacccaccaaaguuucucauccgaccuuggccuugggggugaggcucugagaggagaagaaaguuagggagugggaacuuuccuaccagcccaucagcaccagagccaggcugguggggagggagggaccgcugaagccagaggcccuggccaagucccugcacauccaggagcuccugugucacugccuuguggcauccccuauuucuguggggauggggaggacaggccacuuuuggauacccuuggcccaugaagugucagccagaguggcuuaaggauugcagaguggcagaaaaagcccuggccaugugcccacaagcccccuaucccacucuuuucugccugcucugugaccuugggcaagucacugucccucucugggccacaauugccucuaaaauugggacagacagcugcucccuguggcuucuuucgccuggggcaucagugccucucccagcccugagcaacccccaucccacccccuucagagucuuggcagaaucuggccucuguagguggccgccaccgagcccaagacggggcauggggcuccuggauggguuaguuggggagcccuugcugcuccccccaacucaguucugaauccaccuucuuugggccucagccccacccccuccuccagaaggaagccugugacucaacugccucucucucucucccucucccccacccgucaaucuccucuccgcccccuugcccugcaucacccccuccuuaccggccccaccuccgccccucccauccuccugcccuuccccucuuuuuuuucuagcuguuacaagccagaggcacccggaugugaggccccagaucaccuccagggacuugggguucccaucugaaauccuuuauuuuuguaccauggggugggccccgggccugagaaggaagaagcacccucuccccggccuccucugucugcacccguggggcugugacuuacuccugccuccaggggcggggcggggccccccugggaccucuuaaggcccaaggugggccccaggaccucugggcagaguggacugcucauggcagauguguggcaaugucuggcugugucucuccggcaccugcguccccucucccgggcuccccugcugcaugguggaugugcuccuuccuggcccggucacauugccuccuugagccuuaguccagggggucacuccucccaccccaccuaccucacaggguuguugugagggugcacagaggagcaaagucccugaaggcccucaggcaguauauaggggccgcccaccuucagcugcccugggaugggaaggacccagcccgaccccugggcauaacacuguguuugcaaauggagauucagguauuggggaugcagguuguggggagcuggccuggcagaguagggguaguuggcuuggccuucucuuuggugaucccacccccagccauuugcauugcuggcccagcgccuggccuggggggcggggagaggcagcagaaggggcugggcaggggcgguggaggacucaggaacugcccggggagaguggguauggcggcugagccaggggcccuccuguguuugacuucccgggauggguccuugcuucucagcuguguccgaccccaccauguaauaaaacccaaaggaacagcccagccuggcuguugc

SEQ ID NO: 17850 - RNA, 23170 nt, Homo sapiens
ugugugcagcuaggccccuauuugacaaugugugucugugugugugugugugugugugugugugugugugugugugugugccgcccccagcguaggaggcagaucuuuaucuggcccugggugcuugaggaguuucaggcuuucucauaagccucgucuccccgccucuccaccccaggccuugccccucuauccucugcacaggaagugggcuggcucugggcuuuuagucuuugcggccccagcagccagagcucagcagggcccuggagagauggccacggucccagcaccggggaggacuggagagcgcgcgcugccaccgccccaugucucagccaggugaugucccccugccucccucccggccccuguggaccagccagagggcugggagugaaagucacagagaagacuuucagcucugacucaguucccccagcaguuucugccugaacucccaucccccaacuuugucuuagaauuccccuagggagggguugggcccagcucucauggcuccuggcuggaggaaaaagcgguccccagucccaggucagcucuccuucccaacccauucaggggaggcuagggacugcugugggaugaggggcuucccugggcucugugugcugggcccccaacccggagagguggagaagggauggguggauagccugggugcccggagaggguacgggauauggggugggacaggcgggagcccccuccugaccucuguggaguggggcccauauaccgggggaggcagcccuguguugcgugcucaucaggaggcuuguggaguaaguggggacagaaggguccccuuggagagccaucuaugaagugaaguugcugcgaggccucugggagccccaggcuggaggcagagcccuggguuugagucuggguuugucccucccuuggcugcaugacuggacaggucagaagcaucuccggacauuggggaugggacccuaucuuuggggcugccuggagcucaugcucucuccucuccugggggccgaagccucccacucuuaacuguguuuguagcaccucgggggagggagguggagugaggagcugagcuauccccaaggguccccuuccuucccccacagccagggucccgcacccagcuggagaagccccugaaguuaaauagcaagagacaagcacuguguaugggagcagggggguggcagguggagguggccagagaggacgaggggacauaggccccauugaguucagaggucaaguuggaugaaccaugggcucccgagcuccugcuuuaccacccugccccagccaccauauaccccugauggcagcaggggccccgaacugcaccugaccagguucaaaucccagcucuaugcccuucucgccugggugagagguugacccguuucuuagucuccucauuuggcaaaaaggaggcauacuagagccuccucauggggcuguagggagggcuaaaagcugaacuacccccgagcgcucagggcaggcaguguaggcagagagagagcaggcaccagucccuguccccagcagcaucucucugaaaaucagauggcuggggucagccgcuccgggcuucaguucuggcauggaucaaauggggcagcaagacccaccuugcagggcugugguggggacguaggcauccgugggugugaccaguuucagagucaugaacgacagggcacgugugggugugccugaggacccaggagggggugcucaaacucgagguccugggcuccacuugcugucacccgaggcugggcuucuccucaccgugcaaccuuaaguggguuccuuggccucccugaggcacagcuuccccauugcagaaugagggugcagccucagugacugccaggcgcucccucagcucugugccccucuggcacccccacaccauccucccguggacucugcccucuccgagcaucgcugcaccucugagcuccaggcggcgggaagcagacuccagauggcgcuuucuccuccugcccggcugccucuaggcugggccugugguuuaccccuaaccuuccuuugaccuugcaccccuuugucccucagcaccuuccucacacacuggggcucucugcaguuccuguccugggcauggggucauccugaggcugggcccgaccuggggugacacccacacaaaacauugaugguccccuugccccagggccagguuggcaugauugagcgugaaggggcauaggggcuaugggaguccccugguugggcuaugcacucuuuggggucccaacccugugcccucugcuauugggggaucccaagaaagaggugagcagcccccacccuggggagcucacccuccuguggagacgguaggccaggcaaaggcgagcccaugguaccccgaauaagcaccugccagucugucugugagcugcuggguccugacucccaggacagagaggguggcagccuuaccucugggaccagugucuggcagggugggacagcaugagagagugagccuggagcccuagcuccaccucuuacuguguuuaugacccugggcaaguuaggggcuuggagccuuaguuuccucaucuguagaaugggauaauaaagccauugggcagcuuagacgagcuggcauaugugaggcacuuggccccaggccuagcauagaguaugugcucaguacacagaacgaguauuauuaguucaccagugcauauuuacugucgugugagcugucguggugggaagaugcgucuggggaguuccaggaggggaggaucccugccugggcacugggcagucugcccugacucagauuccagaaaggccucuuauccacugcaugaccuuaggcaacgcacuucaccucugugugccuccguuuccucauuggaaaauggggauaauaagaguauccccgccagaggcccugauugcugcauuuaaagaguuuuaaauggagccuggcuuacaguaaccugucagccgaugguuuuggugugacuaaggggguggcagagcggcguggaguuggguucugaucccagcucugugcugggcuccugauguaaccuucagcaagucuuucccacuucgggaccucaguguucucaaauguagaacaagggacugugcuugcucagagagccuuugcagcuuugacagugcgugggccucugacucucacuccugugacaucugccuuaggagauggaacccauggcucuuggggccagggugugugucccugcuccaugcuggcucugauguaagccacgagacaauccagggccaccuaaagagcucugcuuuuuuuuuuuugccguacugaggccucugaccacacucauucauuucacuacauuuauugagcaccgacugugugcccggcccugugcucagcagucccuggagcgagugugcuggugggccagccccuggucaacgccggcccugcugcugccagccuagagggaggagcaaggcgcucagaagaggaagcccucgcccuccaucacggaaaucagggaaggcuucauggaaaaaggcaugagggcccguuugaaaugggcuugaaggauggcaggaucuguaggggacccagggaaaggauagacuugggaaggaccuuuggagggugagugucgguuuccuggucaccuggagccacuggcuugugcaggcagguaggugcggugugugugugcuuuggccuggguacaugcaccugcuccugugagggcagggucuggaagggugggcugaccucauuccggucccagaaagccucgaaaaugggaauuuaggcuuugauugcaacagggccacugcagguuccugggcagggaugugggugguuggaggcgggcuucagggaaggcaggugagagccugcagaugggguggugccguugucugggcuggaacggcacgaggcuggccuggugaggguggggaagagacaacaaguagucacuggaguguccugcugucugaggagaguccugacuggcuagguaugggggcaaaggucaccuggaauaggaaggguacaguugucccagaacugaaagucagacaggagaagagcuggggaugagcuggguuuuugccggguccaggagcauccccugugaggggguccugcagaccaucgggagggacguggaggcuuggggcugagcuggagaaagacccugggaagcugagggcuggagccagugagaggcucaagagagagaagggaaggggagugagagcucgaguuuggagccgcuggagaagggggaacagcgggggaaaugcccaacgcucaggagccuuggaagcucucgagauggaagagcaggagggagggaaggauguuccaccuccuccacaucucuugacucaccugcuccucuccccucucccccugccccucugacugaggcuacccucaucuuucccuggaagcucccuccucaucucccugccucccccuuugccugcuccaaacaccucuccuggaagcaguccccuuaucuucccgaagugaccaugugcucacuuucucauuccccuccgcacacccagccccugcagagggugggggcagcuacuuuucuuucccauuuccgcugcgacaguuguggucuugccucacgggagcuuccacgguuggcuagagguucccugagaagcaagucuuugucucaaaaaaaaaaaguaaauaaauaaagcacuggccaguggccagugcauaauaggcacuccgggaaaacuuuugagccucccucugacagggcuggcuuagagauuucaugucucuuuccucccugggguauaaucugggugaccaaccuggcccugccuccagggagcuuccaggcagguaggggaguacgaguguggacaagguccuccguaaaggcuacugcagcccucugugccucaguuuccccuguccucuagggcucuucaguguuugggucagagcuccuaucugcuuuucugcuuuuccgaguucgcguccugaugccuucacaccauugccucagcucccucgagggacagugaggggcagaggcaggggcuagccucagagcccucuggaagccccucuaccugcugacuuuagcucugucuauauuuauuccaucacuuguuuguucaagaauuuuuuuuggccagaugccuacuaugugccaggcacuguucuaggaauuguggaccuagcaaugaacaaaacacaaaaauaccuguccuuagugagcuuacgugacucuguguguguuugugaagagagauagaggaaaacaugaaucagucaauaaacgaugaauaaauaaugcuaugaugaaaauguagggggguggugaguaacaaagggugcuucuuuuauuuuuuucuuugagacagagucuuacucugucguccaggcuggagugcaguggugccaucucgguucacugcaaacuccgccuccagguucaagcaauucuccugucuuagacucccgaguagcugggacuacaggcacccaccaccuugcccggcuaauuuuuguauuuuuaguagagacaggguuucaccauguuggucaggcuggucucaaacucuugaccucaggugauucgucugccucgaccucccaaagugcugggauuacaggcaugagccacacgccuggccacgacgggugcuucuuuauguagucuagucaaagaagaccucucaaaggaggcugcaguugagcagaaacuugaaggaagggugugagcauguguaggguggugggauuagcaggugcaaaggcccuggggcuggacugagcuggcaccgaggagugcagaccaugcacacugagggggcgggcccagccugccucuaggggcagcgaggccugggauguguauuuacgugugcucucucuuucuccucucccaccagggcuuccuuccucggcuccacccuguggauguaauggcggccccugcucuguccuggcgucugccccuccucauccuccuccugccccuggcuaccucuugggcaucugcagcggugaauggugaggacccugacaucugaacagcucugcuuucccuauggagagauggcuaaggcccugcuaaagccucuucccagaaggggauggggccagagaccagguguccaccuccugccucacccucuguccuggaccccugcccuggcaugcaugcaugaaugcgcgcacacacacacacacacacacacacacacacacacgccucuccaagccacaggcuugugcuacuuucugucccugccuugccuuaguuugccuguaggaacuugcaggcucuggagcuccauuuccuccucucugaaguggguccaugaaucccuucuccgcuugccagaguuacccaccuccuccucuggcaggugugggugccaggugcaggggcagugggcgugucuugggggggcugugggcaccuacagucagcacucacaccucaucuugcccggcaggcacuucccaguucacaugcuucuacaacucgagagccaacaucuccugugucuggagccaagauggggcucugcaggacacuuccugccaaguccaugccuggccggacagacggugaguccacuggccacacugcagaaucuuaggauggugggaucucauauucuggauccuaugcacuggacuccaaggagucaacguuuacagaaucuuggacuaaugggacccacagacuuuuugaaucacaggaguuggggcccaggccuggaaucaagggaucguuuaagagaauuugggagucagcuauuuagacuucuagaaccuggguggaguccaggcugcaguggaggggcuggggaugaacuggacaggguaguuuggggacacugagcugcaagccugcuaugccaaggcuggacuccacucuagaggcaagcagagaggaaguggggagaaaggaggguccccaagcuuuuuggauaagcucggauuuugagagacccuguaggcagcuguggggacagggaaccugggagugguuugggugccugguggaugggagagagaugucacugugauguaaacauccaggcggccagugagugagggacugaccccagguaggcuugauggggucagggagaagaggaagaccacagagagguggcugggcccagguggauuccauaggguguggggugggggaaaauggggagggagauggagggguaaggcagguucgggcccuggcuucuggguggguggugauuccacacggcucugaaggccuaauuaaggaucuaucuucauccuaagccucauggagcuuuggagggcucuagguggggaggacugccugucuugaagugguuuguguuucuagaucacuccagcugccgugggaccaggcugggaugagggagcaggacaaggugcccaugagggaggaaugccauggagccagugggggaggcagugccccucacagugguuggcacaggggccccagccuggccuugcugccuggugccauccuggcagcagagagaucugagaagagucccuugggccagcuguguggguccuuccuguucuucuaaagagggucuuuugccaugaaaggcgguggaaccaaaccugugagcugcuccccgugagucaagcauccugggccugcaaccugauccucggagccccagaugugaguagcccacccagggagagagugcagggagaggguggucucccagcuccgggcugcgaucucagggugggccggaugccaggggaagagcugaggcccaauggcuggggcuguggcuaagcaggaugcccagcgcugagcaagaggcagagaaaaacaggugacaccccagggaguggacucaggccugccccagggccgacggacccucuguaugugaggcaucugccauucugccucugcuccugcugucuccccugcgcuuuguggguccugugacacuuguguuccuuaucaaguaagacagcacuccaguaacuguaaugaccacacccagcucuucccgggggcuuggcagugcagugcaguguggggggugaaggguguagacucuggagcuggaugcuccagcccuggcucaccagcugggugacauugggcaaccccugugccccagucuccccuucuguaaaaugggcauaauaauggcaccuaccuuguugggucaaggcccaacaagggccuuguuuuucaggcccuccccagccugaaggugggaccucaccagggacccgccuccuucugcccaggcugcucgggccaaggggcaccugcaggccagugccaagcuguccccugcacccccguggcuucccaucccccugugcucauuggugccuaaaguccagagggggccgaggcagcuggggccagugagucagugcugccucgagcgugccaggcugugguagugccugggcuuggucccgcucugagauuggagugggcacuggagcaggaggaggccagacagugggagcagacaccccugagcuugugggggcaguagagaugccuggguccuggcuugggcagcugcagcugccccaggagagcuccuggcuaccucggaaggggcaggggucccgcuuguccccgacucacacuggauccacagagugcguagccccgacugugccuccaggaucagaucgggugccagaagcaggggagaggccaagcagugggaacagacagcucugagccugcggaggcaaggggggaucuucccagacccugagagugcagggaugccuggguccacagccacaacuuggguagcugcagcugugcccgggagggugggucuccugcgugcucccugcuugcaagaucaccuggaggcuuggguuuggaccagggccccugagagugcagggacaccuggcucuguggccacgacuuggguggcugcagcugcgcccaggagagcggggcucuugccugaucccagcccccaacagcaccaggaggccuggguccacagccaagacuuaggcagcugcagcccugccugggagggcagggcuccuaccugcuccguggagcaggagaccccagcuacgccucccggcugcagccagaguuuuagcagcggccacuccggaugggcagcugcggccuucaccuacagccccaugggucaacaucagcacuguccccuucuuaccaaugaagacacugaggcucagagagguauggucucugcccaaggucacacagccaggaaguacacagcugggauugaacccaggccugcgggcucccaguucaggcuucucaccguugcauuaggcugccucuugcagggcauauggccauguccauaugaguguacaucaaauuauugucugucaaagccuccugggcggcagcgggcuccaaggacacccggaccacaucuuccaucagguuauaugucuucuugaggggcaggagagugugaagauggagucacacaguguagcugauaaaaucacagccucuggaaccggaugcuguuccccuugcagggagcucuguagguggccugguuucugauccuggcuccaccauuucuuagcugugugaccucaggcaagucccuaaggcucucugugcuucagucuccucagcuguagaauggaaauagugacagugccugugcccaaguugagagaauuaaaugagacaauauauguaaagugcucucaagagugcccggcacagugugagugaucacgcgaauguaugauuggcaauauuuuuauaacaauaauaguaauaauaauaauaauaauaauaauaauaauaauaauaauaaugagacuacuaucaucggggaaaaucuagcccccauagcagcuauaagaaggcuaggacagggucuauaggguggagaggaacuggccaguuuggggaauuccaacgaucagguuuaagguuugcccauagugggucuuaugcagaccagagggacggugcccaaggucccggcccugaaaucagcauccuggaccccagauccuaagaggccugcacuagagcuuccucccgcagggcugccgggcuguaggguuggcagcugcacaguggcaggaugccuuaagcugcucacucggcagcccucugucaggcaugacaagccaggacucggagaugcagucacccuguagggggacacagagggccuggguuuaaacuugggcuccccugcuguucaucugcaugaccuggcgcaggucccuugaccagcccaagccucaggcuucccacccauaccaugggauggaugcugugugcauugaggggcuaaggcaucugagcagugacugcucauaggaaaaugcucaauaccuggccauuuucuuccagaaaauucaaggcguagggauggggagagauaggggaggggagggccuuucacacuaaaaaauguuaaacagguauaguuccagaacuguaccuuugugggggcuuaccagcuugcaugccuccuguaacagggagcucacucccucucaagguagcucacuucauuuuagaucaaguguugguaaacuaccuugacccauaggccauauccagcccacugccuguguuucuaaauaaaguuuuacuggaacauggcccuaauauucauuuacauguugccuacgucugcuucauacuacaguggcggaguugagucaucgugacagagaccauguggccccauaaagccaaaaauaguuacuauguggccuuuuacagaaaacauuugcugccccugccuuggguggcggggcauguggagaggcugccauccuucccaggucaucccgguggccucccccuuccccugccugaagcugcuagaaguuucaccccugcccuccuucccuugcagucucagaaacugaccacaguugacaucgucacccugagggugcugugccgugagggggugcgauggagggugauggccauccaggacuucaagcccuuugagaaccgugagugaggaagccaggguggggcuggggcagggcugggcaccuccuuccuuccaccuccucugggaucuucccugcuccagccuuucuccccggcagcuuccacacccacaucugaucaccucaccgcccgcuguucucgggaugacguccuggcuccuuccucuggcauucaaggccgcucaggauccagcccugggccuccuccccggcacuccuccucuugaggccuauauuucugcuacagccaaaggccaacucuccaaacccaccuugccuaucccugccucugagcccuugcacaugccgaucccacugccuggaaggcccuuuacaccuggaaaauucccacucacguuucgaggcuuaguugaaagucacuuccuccaggaggccuuccuagacuccccuagcccuuuguaccuccucuuucugggaauguauguccuggguuguuacugccugauuguaggucugucucuuucacugggcugugagcacccugaaggcagagucucugccaccccugugucuccuugccacgcacccagcacuaggucucaucaggacaguggucugggaagguuuguugaaugccugagcgacugccugcugaccuugggggccaucuccagggaagcagugggguggaaagugagagucaggccugaacuggaugugaucugacuggcagaccaucgaaacuuucugagccugaguuuuggggagaaucggagucaccuaccuaccaggcuuguaaggcaucuuugaacugagacauagaaacugcuuaccauguagucagcacucagcaucugcuuaucacuuaugugguucuauagagucuuagaaguauagaaacugagauucauuuaacuucagaaucacaguguuauaaucaucacacuuaaaauaaaugagaugauccauggaaagcucucaggucaauuguaagugcagagaaaagcugccgugagucauucauccagcagcuacugaaucaagugccagguaaucuuccaggugccaaggacacagcagacaaccaagucccugcccucaaggagcucacagucugcugggggagacagaaaaugaguaaagaaaccaaaccauauauuucguaggucaggugaugauaagcacugggaauaaaagugaaacaggcaagggggaugcagaguggugaguggucagggaaggcuucucucaagaggugaucauugagagaggccuggaggcagugagggagcggguccuggggcuuugggucgggggguaggggaggugguagcaugugccaggagggaggaguggcagguacaaagugggagguggaggucauggcugacugcucuccccuacccccuguugucuccaguucgccugauggcccccaucucccuccaaguuguccacguggagacccacagaugcaacauaagcugggaaaucucccaagccucccacuacuuugaaagacaccuggaguucgaggcccggacgcuguccccaggccacaccugggaggugagaauguggcccaguccguaccugccuugguuccuccuuccuguccugguccauguccugucccuuuuucauugugucgagguccccucagccccagguggaugguggguggcugaguccagugcucuuucugcacugccuggggcugccuccccgacuuccacguccuuaucuagcccccuuaauccuggggauccagcuggcagcagguuccaggcugacaccagggaaagauucagaaagccaggagauaggcagcugcccagccccaugggcuuucagaggccagggaagccaacccuccacgugucaaagcccaucugcuccacauccgugcgggccuguugcuuauucauucacuuacacucauuucuucauucacucaacugcucacucaauaaauauuugcugagcaccuacuaugcgcugaaugauggggagagagcggagggugagcucagcaaacuuccacucucaggaaucucagacuggggcagggcaggcaggcagucagucagcagauguagcgacagggucugggauagugaggcacccggauagugauaaguuccaucaagaaaacccaacggggcaaggaauuugacagugacuggcacaggcuacuucagacucaggugaccagggaaggccccuuggacaccuggguguccagaaggagcugaccugcaaagaucuggggagaaguuuugcaaaauuagaaagaccugccacggcaaaggcaggaugcugcuaugugucuggggagcaggaggaggcaaaaagagugacccagggugggagaggugugcggagacgucccacuuucugguccuguggagacuagacugcagcggggcacgggugggaaccagagaccagcugcaggcuugggagagggcggcagcucaggccuggggugagugcggcggggagagagggggaugguucuggaauggcuauggagguggaaccagguucuggagguggaaccagcugauuagcugaugacuugggcuuuaggggaugacccugggguuugaggccccagcaacuggguagugagggagcuuuggguggcaaggaagugggggugcagcuggcagggguuggggggggguucugugaugcucagccuccuggcccugccaugggaggugaggugggcgcugacaguccugucuccgacccaggaggccccccugcugacucucaagcagaagcaggaauggaucugccuggagacgcucaccccagacacccaguaugaguuucaggugcgggucaagccucugcaaggcgaguucacgaccuggagccccuggagccagccccuggccuucaggacaaagccugcagguacuggugggcggcaagggugagagggggcucaggcaggagggggcggcuggaggaggagcugcuccauucucucccugccuggggugaggguauagcagucagcuccaucccucacuugcuguaacccugcagggggcucgcuuuucagacaggaacagggguucagugaggggacggggcuugccaugggccuugugaguuggggaggggucgaaaggcuguuuucacucuucuccacccugaaaucuccaacuccugguuucuucuggggcuggggguggcugcuuucaccucucggccugaucugugaaauggguacagugaccgugaggcagagcugcugugaggaaggcgugugaugucccggcagccuggcccucagcaggucugcugggcgccugucccucaucgcaccacauuucgaguucaagcccaagcaagaccugggguccucuaaguggugcuuggagggagguggagagaggggugcagccagcuggagcccaggcugcugugggggugguggggggcuguaggcucaccaggggggcccaugggaucugucuggagcuggaggagcucuuagaaugccaccgugucauuucuuuuuagcaugaaaucuggcuucccagaggaugggcuuagcagaacccuguccccagccccccagacgcaggccugcguggcagggcccuggauggggguguuggggugaccgacccagggugagugagggcacuucucuaaccccucuccuugcuguuucucccaccccugggcagcccuugggaaggacaccauuccguggcucggccaccuccucgugggccucagcggggcuuuuggcuucaucaucuuaguguacuugcugaucaacugcaggaacaccgggccaugguaagaagguucuccuccccuuccuucaugcucccaccccuccaacgugcacacacaugcacacacaugcacacacacgcacacaagcacacauacacacacacacacacuuacaugaacacaugccaccuugccaggucagauucuggaccgaacccccugcucugauacacccgugcuucgucuacccuccaaagaguccucccuguccaaaaccuggccuuucccugugucgcauccccacaggggggcccuguggaaccaacccgaggggaaggugggaggugcagcccuccagggagagccccggggcccuguccagaacacugcucucaggacuggggaugcccgugugcacaugucagcugucucugugucuggguccccgccgguccaucuaggucugucauucgcuuauucccauauucacugaguacgagcugcaugccagguacagcucaaagagcugggaacacaguggcaggccgcaugcaugcgccccagcuccaggcagcucacggcccagugggggaaggcagacaaucaugcagguguguaaugacacaccgggaucaggauggcagaggaggaugucgacguauugccauuccuuaggauccauggaaaccaguuccaggacccucccuacccccuacagauaccaaagcugguggauacucaagucucugauuuuuguuuuauuuuauuuauuuauuuuuugugagauagagucucacucugucaccuaggcuggaguacaguggcgcaaucucgacucacugcaaccuccaccuccaggguucaagcgauucuccugcgucauccucccgaguagcugggacuacaggcacacgccaccgugcucugcuaaguuuuuguauuuuuaguacagacgggguuucaccauguuggccaagcugguuucaaacuccugaccucaggugauccacucgccuuggccucccaaaaugcuaagauuacaggugugagcccccacgcccggccucaagucccugauuuaacacagcagaauauuugcguguaaccuacacacacccucccagagacuuuaggucaucuccuagauuacuuauaauaccuaauaccauguaaaugcuauguaaauaguuguuaugcuguauuuuaaaaauuuguauuauuuuuuauuauuguauugcuaugaggguuuuuuuuuccugaauauuuuugaucagagauuggcugaauccgugagugcagaacccacggauccugagugcugacuguaucaggagcagaaaacagggaggggaaacuuggcuggggcguggccagggcugguuucccugaggaagggaugauucuguugaaaucuguagugggagcccaugggggguguggaggggauggggagagugucccaggcagaggaaacagcaugugcaaaggcccugggcaggcaggagggaagaaacuuccaggaacagagugcaggggcgcugguguggcuggagacagaaguggguggggcaggaggcugaacuugagccugggccuguggcggcagugaugcuuccuggggccucaggcuguggugaggaccugggccgugugccgagcagucauggaggguuuccccagaagugggacaggauccacuucgcccucuguagcccuggcugcuguguggagcguggccugguggagggcaaagcggugaggaggugacacuucugaccggggguuguggcccccugaugagagcccugcuucucccaagagguuugcaaagcgugccuagcugugucaccucacucgacuuuccccagcacugggaaggcagugagucaggggcuaccauugccuuuuaacugaugccaggacuggccagagaagucagcugacuugcccaaggucacauagccaguuaggagugacugccgcucuccugacccucguccuggagcagugguucucggcaguguucggagccccguuuccucuuuccucccaagaagacaagcauuccuccacccacccguccccuccgcccacagcucccugcaggccuucagggaaaccaugucccuguagagggagagguccucucccaggcauggguucaguggccuccagacugcccuccuccuugucguucuugcgccccuucagugcuuucuccaccaugucauucuccuguuuaacacucuucagaggccgcucacugcgcugcaguacacccuggcccuugagggccuccaccagcuguguggaaccuuugggcaaaucaaaaauggugccucuuucuucacggugauguacacagcuuccaggcacucagcuuagcaagcagaacaugggcuggaauucagccucacucaccaccaccuuucccacucccugcccaagccuaaugcccuugggcaguguacaaccugaaccaccauccauggcagcccugacaagaaagcccaucuccucucucccgccuccugguucauuccacuucuucuagccaucuccgucccugaccacucuggcuuguguguucacccccaucgacccccaccuccccgucuuguguagcacugugcucucugucuccacagaaugaauggugauguugcaacaugcuuuguguccaucuccccaugagaaugucagcuccuugagagcagggaccuccuuuguuggccauucuugucuccccagugcccaacacagcguccucccacagugaacacuuaguaucggcggaagaaauacauaaguaaauguggugcggcuccgugccuggcauccagagcuguggugccgauggcauaacaccgcgguccuucccuuucucacccuccuccuucccuccucuccucuguccaggcugaagaagguccugaaguguaacaccccagaccccucgaaguucuuuucccagcugagcucagagcauggaggagacguccagguaggaggccggggcggggagacagaggugggcaggggugugagugggaugaggggguggcagguuaguagcuaauuuuguguuuugugagaggagacaaaacgccgaagugagcagccuccggggugugcaugggucucuucuccagcucuggcacuuuccaucugagccagacugccuggguucuaaucccagcuccaccacauucuggcugugugaccuugggccuauagagccucccugggccucaguuuccccaccuguuagaugaggagaaaaacaguguuacuauguguccugcccugaguacauugccuggcacgcaguuaguguucaaaagaacccuaucaggcugggugcagugguucaugccuguaaucccagcacuuugggaggcuguggcagguagaucacgaggucaggaguucgagaccagccugaccaacauggugaagcccugucucuacuaaaaauacaaaaauuagccgggcugguggugcaugccuguaaucccagcuacucaggaggcugagacaggggaaucgcuugaacccaggaggcggagguuacagugagcugagauggcaccacugcacuccagccugggcgacagagugagacuccaucucaaaaaaaaaaaaaaaguacccuaucugguauuaccguugccggugugcugaacgaacaggaccugccagcacaagcucucuccaccccacugucugugcagacaugcucugugcuucuccugucccugcucaaaauuccugagcaggcuccauaacuuagcguggauacuaacaagucuucccgucacuuugagucacaaaacaccgauucauuuuuaaagugccggcccgcagaucaguaacgcucuaaacuccaucucagauuccgucgucuccucuuccccagcccaugcccccuucaggcaggaagcuucaagaaugaaggggggacaugggggguacuuuuuaccacccuagccccacucuaggcucccaagauugggggguggggaugagguaggggcagagggaggucaagaagaguggcggaggaggaaagccaugccggaccagagcugucaugaccuggcuuuggaguucucuaucagggcugaucaagggccccuucuggaacuccuuggaaaacucccaagaugagaauaucuuaguugcagugcuuuuauuuauuuauuuauuuauuuauuuuuugagauggagucuugcucugucguccaggcuagagugcaauggcacgaccucagcucacugcaaacucugccuccuggguucaaccgaugcuccugccucagucucccgaguagcugggacuacaagcacacaccaccacacuuggcuaauucuuguacuuuuaauagagacgggguuuugccauguuggccaggcuggucuugaacuccugaucucaggugaucugcccgccucggccucccaaagugcugggauuacaggcgugcgccaccgugccuggccauuaguugcaguacucuuaaugugcgggaauguauuuccuuaaaauucuucccucagccuugaggguagcaagauucccaucuauaaagguauucaagcaagccaugguugccuaugugucagaagcauagagauucucccauugaacugguuggaggcugcgguagauuagcugcaugcucagauaccuuccagcuucaaguccugauucuaugaaccuacaacaucgugaggugggagcugcaaaccauuccagcuucccaugaggguaugguauccuugggucuaguguguggagcgggguccugaggaagaaggcaugauguggcuggggguuggggauggcaaagcaggccccaccuuuucugcaucugggugagagaccuaccccuccacccuaggacccacaggggccacaaggcccacccccacuucccaggggaucguggaacgugugugcgagugugggaguaugugugaggggcgugagugucuccugaagccccuuucagggcauugugggcagaggcucaggcccaggaaguagcuggccacaggcagugggucccuggcucaccggcacuggccacaggccuggccgcucccucucuggcugcacacacagggcugcugucuggccccgcccuugcccuggguaucaugaaucucacccgaccagugcuucuuccucucugcccagccagcgacccucuuugccauccucaguuuauccuuucugccucucucagccuuuucuuuugugacauaacuccugguugcagaaagggggcggauuuaauugaguggugugugcacgugugugcaugugugcaugcauguaagcgugugugugugugucugcggagcagcuggcucagccucagggacucucccuggagaggagaacugggcauuuguugcugguucauuaauucaucugaaauagauccaugagacccgccaugcugggcacagaggccuggggagcccauugggccuggccccugugcuuagggggccauaguccagcugcugaggguucccaggacagaggguugucagggcucccaaacucacccacccgaggccccugccacaccaccaggagggccugcugucccccacucugcugugcagucugugucuuacccguuuuggguguuuacaucuccauuugcuuaccugaugucuccuuggugaccugaugggugacagcaaggaagucaggagagacguggcuguuguggaaacugaggcccagagaggugcaggggcccucccagggucacacaguuagugagugccagggccagggcuagaacccgggucuucccacuccuugccagggcucucuggaaucccgagcaacugagaagugcucugaugggcacuuuccucucucuggggaugggaggcggaggggguggggguggggacugcagggaacugggggaaaggugaaucaggaaaccaucagcucccccaagagacguucccaccacaguguaagcggagacccugggucccagcucugccgccugcuggucugugaucagggccagggcaugucccgucucugggcaucuguagggugaacaggcuguacucucagugcccuucugcuuuggcauggguggaucgauucccacacuugugcuagugcccacuagacagucugaggauucucuccuuuccuggguccccagcaucuagaacagugccaggcucauagcagguguccaauaaacagucacucuugagcaaucagacauuccugggcacuacuggcagccaggcaggccugugcugggcugugggucaggcagugucccugggcugguggcccagagggcccccaagccaguggguggguugggggagugcggggcuauaaucagggagagcuuccuggauggggcagcccugggccaacugcuucaggaggaggaggaguuaggagcuguugagaguccagaggaagggguggagggugaaggaagcccccacucacccaccccuggccuuucucccaccagaaguggcucucuucgcccuuccccucaucguccuucagcccuggcggccuggcaccugagaucucgccacuagaagugcuggagagggacaaggugacgcagcugcuccugcagcaggacaaggugccugagcccgcauccuuaagcagcaaccacucgcugaccagcugcuucaccaaccaggguuacuucuucuuccaccucccggaugccuuggagauagaggccugccagguguacuuuacuuacgaccccuacucagaggaagacccugaugaggguguggccggggcacccacagggucuuccccccaaccccugcagccucugucaggggaggacgacgccuacugcaccuuccccuccagggaugaccugcugcucuucucccccagucuccucgguggccccagccccccaagcacugccccugggggcaguggggccggugaagagaggaugcccccuucuuugcaagaaagaguccccagagacugggacccccagccccuggggccucccaccccaggagucccagaccugguggauuuucagccacccccugagcuggugcugcgagaggcuggggaggaggucccugacgcuggccccagggagggagucaguuuccccugguccaggccuccugggcagggggaguucagggcccuuaaugcucgccugccccugaacacugaugccuacuugucccuccaagaacuccagggucaggacccaacucacuugguguagacagauggccagggugggaggcaggcagcugccugcucugcgccgagccucagaaggacccuguugaggguccucaguccacugcugaggacacucaguguccaguugcagcuggacuucuccacccggauggcccccacccaguccugcacacuugguccauccauuuccaaaccuccacugcugcucccggguccugcugcccgagccaggaacuguguguguugcaggggggcaguaacuccccaacucccucguuaaucacaggaucccacgaauuuaggcucagaagcaucgcuccucuccagcccugcagcuauucaccaauaucaguccucgcggcucuccagggcucccugcccugaccucuucccuggguuuucugccccagccuccuccuucccuccccuccccguccacagggcagccugagcgugcuuuccaaaacccaaauauggccacgcucccccucgguucaaaaccuugcacaggucccacugcccucagccccacuucucagccugguacuuguaccuccggugucguguggggacauccccuucugcaauccucccuaccguccuccugagccacucagagcucccucacacccccucuguugcacaugcuauucccuggggcugcugugcgcucccccucaucuaggugacaaacuucccugacucuucaagugccgguuuugcuucuccuggagggaagcacugccucccuuaaucugccagaaacuucuagcgucagugcuggagggagaagcugucagggacccagggcgccuggagaaagaggcccuguuacuauuccuuugggaucucugaggccucagagugcuuggcugcuguaucuuuaaugcuggggcccaaguaagggcacagauccccccacaaaguggaugccugcugcaucuucccacaguggcuucacagacccacaagagaagcugauggggaguaaacccuggaguccgaggcccaggcagcagccccgccuaguggugggcccugaugcugccaggccugggaccucccacugcccccuccacuggaggggucuccucugcagcucagggacuggcacacug

SEQ ID NO: 17851 - RNA, 17393 nt, Homo sapiens
aucgccaagaggagacagcauucuuuaaucaugcuggacggcagggcguggcggggucaggcaggggcaggaucaggcagggugguuuauagcacaggucuuccuggcacuuggucagacccuguuuccgucaucuggccauggagccacggcuccucggcugugagcaccagagaucaccccccggggcaccucagccccagagucugcaugagcaccaaugggcggaggccgccucccucuggggagaagggcaggccaccuggguuuggaaggcuaggggaacaccaggccaccccacccuggaagaagaaacggaaggccugaggucccuccuuugcucuagcuccccagaccugcugagggcucuaaagccuggggcuuccguggcccuucuccugcagguguuuguaaaggcagcaccaggccggaggagggcucugagacgaggagcugcccacccgggccuuagcaccuugauaaagccuggagagucggggcacugggccggugagaggggcaugaggggcagagagcaccuggggacagacaucagugucugagggcagcuggaggcccuggggaaacggaaguucagaugacuuugguggaagggacugagcaaggcccuggcagagcccugggaggaggcaggaaggggaucccagugaggagggcaggucuucucgcaggaugccguaucagcuguggggagagcuauggguguggguuccauucuucgggggccacuucaccccccaaaugcccccacacuccuggguccucuccucacagaacccuugaccuggccaaggcccccugggguuugcuguaacgaugagcacugggcagguggaugaggaacgggaaggagauaccugccccugccaccgggaccccgucccaccagccuuggggagcaguggguaauggaggaccagcagcaccugaacacccagaacacaggcccccaugagcucugggucugcuuuaaaaccuauguacacaucucuccccgccugggcuggacuggccagucacugagggcaggggcagggccugugucugacccccucacccuucccgggacccagcacagagugagugcucaguguuuaaugaaugaauaaaugaacgguggcugcaguggugcaggccugagcaagagaagagggggaagggguaaagagaacauagcacggggagcccuggagggaugagagaauuuaagaauguuggaauuggccaggcacgguggcucacaccuguaaucccagcauuuugagaggccgaggcgggugggucaccugaagucaggaguucaagaccagccuggccaauauggugaaaccccaucucuacuaaaaauacaaaaauuagccaggcaugguagcaggcgccuguaaucccagccacuagggaggcugaggcagaagaaucgcuugaacccgggaggcagagguugcagugaacugagauugcaccacugcacucuagccugggcaacagagcaagacucugucucaagaaaaaaaaauguugggagaauucuagaauguggggaggauuccagaauguucagaaaguacuagaauauugagaaaguccuagaaccugguugcuccagugugguucauagacugaccccaucagcaucacccaggaacauaugagaaacacagaauccuggacccacucagaccugcugagucagaaucugcauuuaacacgaaccccgggugauucgcaugcauuuccaaguuugagaagugcugggcuacgaggcugggaaaguucuagaauauuuagguuagcaagcuucuuaaaauagguccaagagagaagagaggagcagaaauaggcugggagggaugauggcagccaagauagaagcagggucuccccagaaugccagguccccggggaccucccuggccuuccugcuucacagcagugcaaacugagcccugcaggggacgggaccagcaccugagcucuccagccgggaggguggcccagaggcccucagucguccucggccuugaugagguggccgcugaaggugauguaggugucgaagucguugcuguagauggcguucucgcgcuggcgcuugaagagccgcacccagacgcgguccccguaggccagguccagcaucacacucuggcucugcaugaugcugcgcucgcugggcugcgcguacaggaugacagccucuuucugguuaugcauaaugugcacguacgucuccuuguaauuccagcugugcacauugaggcugaagaaguagaugccacgcaggggagcagcaaacuggccggucgccaugucaaagcacccaucaagguucacaaagacccuuucgaagagcagcgucuggaaguccucgccgcugugcagggccgucuugcggcccacugagaaggcgaagaagcgcuucuggcacggggcgccggggcugcccaucucccccuugucacccuugcugcccugagggccaggcuccccuuggggacccucccugcccauguacccuggcaggcccauugggccuggguccccuuugucaccuguggggauaaaaaggggacaagucaggguggacaucugagccugcuccaaggaggugcccacacucaucugugacggcucugccccuguccuggcccagagaagaagccagcauuuauuuagcaccuacuguaugccagacauugccuccccacaugccugccuaaagaaaacaucaugaccgucuucacuucacagagagggugagugacucaccccgggccacacagugcaggagcagaagaggcaggacuuaaaauauggucuguccccagggugacuugacuuccccucacccagcagggaggguccgacuggugucucugggaggccaggcccaggcccccaccccaggaccacagcgcaguccaggcuggcagggauguggggugugcuggaacauacuuuggguuucugacccagggaagaaaccaagaaaaauacauuugcccaccuggaggaaaagcccagguuaggagccaggaagcccuugguuggcaguccugcccugugugaccucgggcacuccacggcuggggucucgguuuucuggucuauauuuuaaagaggauuauguccaccucagggguguuugugagcccucaacaaaauguccugugggaaagcacuuugcaaacucugcaacuaagaggcagaacaguucacccagcacggcuggcccaucccgaccugcucugaggucuggcagcaucuacaauggcccccaggcaggcacagcccugcccggcccuuaguccaggcugacuuucaacauaagaaaagcaggugaccacccacgccuggagggacccgaccucacauagcucccugccaccugucacagugccuggagucacacgagcaaccacauccuugcaugggcuagaaggcccuguguuuuccacagggggggaaggggacagaaaggagggcacaggcccuugagguggaagcccagagagcugggcagggcaaggccacagcucugcaggguucuggcuccaccgccuggcuggagaaccacguccucaccugcacagcucuagaccuugugcaggaaguuuguugugccccagcccaaggaaaggaaggaguggaggguggacaggacgaagggacuaucuucuuuuuacaaauaaggcagcaagcucagggcgggggagagaccagccugacucacugggcaagggggcagaagaggugaggcugggacccaggacucccaaagccagcccgaggucccucacggcagccuacccaccucccagcaggcugcugagcugggcccaggagcagugacccuggguuuggggagggcaaugaggagggaccaucagcagccaggcaccucuccaaccucaugcagagagcuaagucagcccuggggaagcuggguggggaggggggugugaggaagagcaacguccucaccacgaaaucagaacaagggcaggccaggugccaggugaccacuggcugugcagugaguguccccggggagagcucaggaacaaauccuggcuccaucccugacagcuguguggccccaggagacuggguuuccccaucugcaaagugggaggaauaagaaaauaucgaccucacgggcuguugugggcagagacggacgcuaaggaugucaaggccuggucacagccgucagccaccacagccuggaagggaagcgaguccuuccacguccuauugagagagcggguagccagcccgcaccuggacggcccucaccuggaugccuuucaccuggacgggcccucaccuggacagcccucaccuggacagcccucaccuggauggcccucaccuggacaggccccacagggcugcaugcuccgacccucggcccccgcugguugcucuccacaugacauuagagggauccauuugaaaccugggugggaucaagucccugucccacccaaaccugccccuguucccacuccacucagcggagcccaagucccuacaguagccggguggugacagcaccccaugugaucugagccuggugcaucucccggcccugccccagggccccugcaccagcugugcccuuugccaggaggcuccuccaccaccucuuagaagccugugcuccauggguccuccacugaccaccucauucaauaugcagccugcagcccagacccgcacuccugaagccccuuuucauuucccagagcacugaucaccaucgaacauuccacuccacuaacuuaggugaugugugccuugcucacagcccaucuccccaccgagaacgggugcucaggcaggaggcaucuuggucugguuuguucacgcuccgucaucaguguuuggaacagaccaggcucacauuggggcucaauaacucaggaugaaagaggagucuggacagguuuccgcccugcccucuacucccuccaccucagcucccuggcccucccugcccacuaccaggccccacaggagggcacucacccuucaggauggugauauuaauguagggucugaucucaggcagggcgugggggcggccggaggaagaggcugaggauacaugggcaggauccaggggguccucagagucacagcaccguuggcagccgcuggccacagcucugucaaaggugagcuccaccauagggaucucacacaucaggagaaagagcaggagcgcugcccagacgggacccagggcggcuguccccauggugaccuggaacaaggaaggagggacaggaacuauacuucacucaacaucuacuaugugccgaugccuggggugggcgggugcugcguccuccagccacagcacuccugaccuaacuccagagggaagguuauuguccccaucuaucagacaagaagacugagaccuccacagagcagcaaguuccccaagaucgggaggagacuggcagggcagggccugcaugcugagucuccgggcacccaguccauggaggcuucugcuccacacaggccuuggaaggaugaagccccucugaaaacagccacagcugagagcagacagggaucccaggaagcuuugcuggggcaggugagaagaugccccagcuggccauggguggcaacccaggagaccgucagaugcuuucccgcccgcgcaccucccucuggcacuuucuugccaccgacuccacuaucuccagcaaacacaugcccuccgggcaggaggacugagguuagugaacacuggggacaaacguggaggguucuggaggcuuguucucaggagaggggauggguggccgagcccaugcuuuggugugagaacaccauaguucugaaaaaaaagagauaagagaguucauugauccuagcagacagaaagcaacguccaugagagcaugugggguggugcgcggugauggugucauugcaucgcugagcagucaggagaaggaauacuggguccuugacugcagcccauugcuagucuuuagagugccuuugugcaaagcaaagaaggugccccucuggacaaauuagaaaugauaagaguccccguuggagggacgugaugcugagggugugcagcuuggcaagggcuggcgcuaguccaccucccugcucagcaccuuugugcagucaacuaucuaugcaacccaaccuuauccagaagcccugcagggaggguucuguagagagaguuaguucauuggaagaugguugugucaaucaucguagaccugccaaucagaugccaaggugguaaauuggaauuaagggguaggacuaggagguauaaaaaauucuaaaggaucagaaaaguguaaguguuggugaggaucugucucuggccuuggccaagaaggggucuagggcuccaggagagaggcaggaaguagccuggacaccaggcgcuagagacaguccuggguugggugggcaggaagccgggcaaaaagaccuuugagguggugcagcuucugggggcuggugccgaguuaucacaggaucagaaacucugcuuuugaaaccagacugguuuuuacacuucuggcguuucuuuguuuauuuccuuuuuguucuccuuuaacauuuaguagaauucaaaaauauuuuuuuugugguuaauacauguagacaagguacaauuauuacuuuuuaaaaugccacccugucucagcugagcacugaggugagggcagaguuuuaaaggggcaggauggccaggugcagugacuuacuccugcaaucccagcacuuugggaggccacggagagaggaucacucgagucccggaguucgagaccagucugggcaacauagugagacccugucucuauuuuucaaaaauuaaaacuaaaaauaaauaaagcggcaggagcccugccccccacccccagagcuggaugguagcagcaggagaagggggcuggacaggaagucuccagagccaccucccucuuccuggaggugacucuucccaagcuucucucugcccacccugguuggguuccugguucugcucaauaaggaggucaaauccucagagaucaacauccucccugucugagacugucauccucaacuuuuacuuauaaaugacaaaucccagugguuuuggaaaucccaaaauucccuucuuuuucccagccacagauaugaccucaugagaaaagcugaggucuuagagucaaaucugagacccagaauaguuugcaagcugugugaccuagggcuaguggcugaaccucucugggcuuccugcuccuugauacuuacaaggaaaugacaccacccuuucccucccagguaauuuggaaggauuucaaugcaggaaaagugccugccuuauaaaagacuuaaaaaaaaaaaaaaaagugugcuuugacuucuucccugugccugcaugggaugggaaggagaacuucucccagaggacuggcaugguuugggagcauuucuguuuccuauuggccccagcggaugggagucaaaggcugugagacacagaaccguggccugggagcaggaaucaggaagccguuaacgaggaaucauaaccacagccaggaucacgaacuagcucugggggugggugccaggcagggaccaagugugggaaccaagucauagggaggacuuuugggguccuugcugcuuccacugggaccucuuuggggagggagcggcagggcaacuuuucucgguccaggcaggccgugcagagcugaguuugugugugcccggguaggggcgggcacaaaccgggagcaguggagcgcagcccucagccagaggcaggaggaaauguggaggggagagccuggagaggcugucccagucagagggagagagcagggcccgagaugcuuccaggaagcaaggagggaggagaggaauuccaggcucugaccccagcccccaagcuugaggagccucuggucacucacccuguguccuguggccuccccaggcgacucacggacccugagccacugcauggccucuggcuccuuggcccaugucugcaauacuaacuuguugcuggcccagacccccaggcccagcagaggagggagagaggaggggauggagggagagagggcggagggagggcggagggagagggcagagccgcuucccacuuccccuccucccugcucccucccuuucagccucuggguucugcggagauaaagggaggcagggauuuccuuugcuuaacucuuuggugauccaguggggucuugcuugauucaaaggccuagaaagucagagcaggcaggagucugaggcccccugaugauugggaaauggacacaggcauggggcacaggagccccuagguugcucaggaagggggaggcagcccugaguccacccugagcuaaagugcuuaacugcucugagucacagaggcaggguggguagcagagaaggugcagguguuggcccuccaggcacaggcuagaauccuggcccugcuaccacagucgcgucgccucucagagccuagguguuccagaacugcaguccucagcccccuuugugccaggcacaugggagggcuuaacccauguuuguugggugaaugaccaggcugaccuccucagguaucaugcaaguguuaccagagagggguacugaucagaccccaagagagaauucuuggaucuugcaccagaaagaauuugggguaaguccacagagcaaagugaaagcaaguuuauuagagaagcaaagaaacaaaagaauggcuacuccauaggcagagcacccccaagcacugcuaguuggcuauuuuuauaguuauuucuugauccuaugcuaaacagggguggauuauucaugaguuuuccaggaaaggggugggaauuuccugaaacugaggcuuccucccccuuuuagacaauauaggguaauuuccggacauugccaugguauuuguaggcugucuuggugcugguagaaguguguuuuagcaagcuaacacauuuuaauuaacauacaaugagcaauaaggaugaccagaugucacuuucauugcaaucuuagauuuggcagguuuuggcugguuuguuuaccgcauacuguuucucagcagggucuugaugaccuguaucuugugauaccaguccugccaacuuccuaucccuuccugugacuacaaaugccugaccuccugggaaugcagccuggcaggucuuagccucauuuuacccagccccuauucaagauggaguugcccuauuuugaacaccucugacauauuucccuacucucuuuuacgagggaacguuuaaucuuaaggguuguagaggcaugaagauccaucuucuguaacuucuucaggcugaauagaggcgaugauauuccugccuaacuauuagagucucuuggguuuggugcagagaggaacugaguaagaaaauguugguguguucagagucauuuguaacucugaguccuaacaaaaggugauaucuggaagauuaauguguucaauuuaaggaagcacugaguaagcuuaucuugcauucuuacacaaagaguauagcagcaauauauucuacaacagcaaaguaaaauaaguaaaauuaucccaaguaauccaaauaagaaggcuuuccaugaacugggcaagaaugccugugacuuaucggguaaaaugaggcugagaccuacugggcugcauucccaggagguuaggcauucuuagucacaggaauugcuagaugagcugauacggaguugcuagacgauuccaauacaugcucagaauuagauacugauccagauuuuuauguuauccaucccucuuguuucugacgagaagcagucaagagaugacuguuugguucacagaaagaagcaaggucagucuaaauugcagacaaaaaacucaaaaacaauggaugagacuagaaucuaugacagguguaccauauuuuuugaaacaccguuuuucucucuccagucucccauuuuuuauuaaaaacaaaucaugguaggaccaauuuauuugcaaaauaagcuuuagucuuauuauacuuggcuucauuauuugcauaaagugcagcaaguauaauuauuugccauacaggcuccuuuuaaaauuggcuuuguuucauaagguaucuuagauuagauguuuuaaagcuuugagcccagccauggauuuaccuaugccugcaagaaccuguaugaguuagauaaauuccucuccucuugaggucccgagauaacucggggcucccaggccugucagaaaguuacauucuuuacuuaccacaggucaggaacccuauacagggacuucauacacaagguacaagaccaguuuuuccaagaggcuuuuauuggcucuauuagucaacuuuaauuccuuaaagaagucuguuuauauuugaaagcaugccacucgagucaaacccuuguuaaauaaccaguuucuccaauuguguccuguuacaaaaaaaaaaaaagaagaaagaaggaaaaacagauucuuacugcacuuaugcaaauaacuauauugccguaaguuaagaacacucacaaauaguuuccaaauucugcagaaaucagguaaagagaaaaaaacauauuccaaauuuuguuuuuggacaaaacuuuguuuuauaauccuuaccggagcguacuuuacucaauuguuaaaagcuguaaauagcucaagaaggggggguuucuugacucugaaaaacaaaacagaaagaucaacaacauuuuaagcaaaaagucauaaaagauuauuucagucuuuuauuaguucagucuaugcaauuaauuccuguuuugcuugauauauauguguuaguuuuccaagagucuuggaugauguuuucuuuuucucugcauuuaagaguacucaucagaguccuauagcugauuauaaaccaccuuuugaagagaauaaaagcaagacaacaauugucuauggaugacagaaagacuuagagcagucaugguuaaagaauuaauaucauugacuaggaaauguggauaccucuguggcauauaauaaauuaacaucauaacaauuauaauuauuauugauaauguccauuaguauugauaauguucauaucagaauuauaggaguuucccauaauuuuggaacacauaccaauaacauauuuauauaaacacagcccaaagaaagccaaacacaauuucauauuugacaaugcuuccuguauuauuuuaauguaccaaauaagccaaauaugucauuuuuggacuuuaggggaccuaauaucuaaaggacuaaucagguuagaaaaaggcauaacuuagaauuugauuuuggaaaguuugucaaauaucaaaaauuuaaaacauuugauacuacaaaauagcaucccaggucaccauaagucauuuauuuggccaaaaugauaacucaaagauguuuuuaagggcaaaaaccuuuacucaccgauaaagggaagacuuagcuuuccaaaaaaaacugucucuuuucguuccuuucuuuuuucuauagcuuauucaaaaggcaaacaaaaaucuuuaauuauuuuucaauauuacaugaaaaacuuguucaagagagaaagccaaauuuuaccuuugcauuuguguacuauuaaugucaaacccaauucauaauaaagccuuauagacaacucuauccaauuuuaauguuugaccaugagguaagagucucauaaaccuuuuauagcucuuuacaauuuucuuguuaaagaguauaccagugcucuaagaaaaccuuguuauacuuuuauuccauauuuaauuuauggaaaaacugaauaauaucccuuuaauuuaagccaauaaguucacacagaauuucuuuuacaagauuaaucuuucacaaaccuuccauaacuugcucaaaccuucagcuuuauccuaccuaacuugaaacaauccuuuaacccucuaaaguagggggaaaguccacauucccaugcuuucuuauaaucuucuuaccaaaagcauauucaauuuuccuuacacaccuugcauauaaaacuguuucucuaguagucucaauuacauauaacauauuacgauguuaacucuuagcaacuuuuauuuuuuggugaaaaaccugguaaguaagcaguuuuacuuauauuccagguguggagccuaggacagccuuaucugcagaagugcagauaaggucugacucuuuccagcauagcugggggcauggcuaacucgacaaguccccaggccuuaucuagaaucuaauggccccaaagcagguaagcugggcaauuuucaaaagucaaugaugcaguuuaugaccuugaggcauuuagcaaaccuaaaaucugaccugccuaauuuagaccaaaugucuaaaguuugaagauauuuuaauguuacugauaaucuuuaaaacugucucuauuucccaaagauuauuaaagucaugugaaccaaaaggcauuaauguuucuauuuuucugacaaaauauuugauuuaaguacuuauuauuuuuaagccaauuaaucagagcucuuucauauaucaacaucacacacacaacauauauaaauacacagacagaagauccaguaguuguaagauuuuucauuugccaauuuuuaaguuucuuaauuggauuacugacuucaggguggagcccuucaagaaacagggccaggaaagccugcaguuucuaaggccuaauaagcaggcacagcuggaaggcaaaacagaaccccaaaauuaaggguuucauuuuuauauuggauccuggaucccaaagagagggaaucagcccaucccccauggcagucuuaucuuucaauggaggguggggacacuuccauacuuucuagguggccaagagcaugcuuuucugauccaaaggugcgaagagccaaguauccccacaaaacugccauuagccaucccuaaaaguguauuccccaccuaguuauuacauagcaaggcuaaaagcucucuuaaaaugcaaaguaauuucugauauccccaaaagucaaaacugucagauaacacaauacaaaacagagcagagccuuagauuuugagaguggucuaucugcuuucaauuccuggggguguccaugaggagaacagagguuucucccaaaacagggucuguagcaccuccuuuuuuccugagaagucccaggcuauuaaaauuuaucuuagguccucucagguggggcaucaagaguggcaagaagacaaaauggggaaaaaaauuaagucgacugaaaagaaaaaauuuuucagaaaaauaagagccaagaagagaaaaaaaagcauaaaggccuuuuaaauauauguauagcuuggauauccauuuuuaauuaagcugacuuuuaaccaaaucuuguuaccagacucuagccgggacaaacagccaauauuucuggcuuuugaacuucacuaacaguaaccucccaggugaaaccgguaagccuuaacuaagguuagcacuuaacccagguauacaagguauuuucaaagaggugauaagcaguuuuuacgagaucuagaaucgccaaggguagugcagagaaaggaaaauucaaacgagaagucagaagcuguuuauggagaagaaaaugaauaaauggcaaaggucacauagauauuaaaccagaaaggacucauucccuaaggugggaauugaaccuggguccccagugugaagagacaaagccuuagcuacugagccacggcacuagacaguuucuguuuuccuuccuggaaggagcccagagaagccaauuucaagcgugcaaaggcuuuuaacugcucaggacaauuuuuagggcuaucacaugaagccccagcuuccugucgucuggaugguggagacuaagagaaaguacucccacacggucacaagguuaaacuugcaaggacguaaaaaaaaagacaagacagaaaccucaucuaguuuuuguuucagggaccugccgccaaguuuguaacugacgaguuugcugggccaacuugaauaaugggcuuauauggguccuaggcccacauucuauccuauaguaccucuuuuuaugacagacugacacagaaagaaaaauucauagcacuaaguacaccagauuuucuaaagcuuaagacuagcccccaugaauucuuuuucguauuaaucaaauuccuugcaggagagacaaacagugauuuuuaucauuuauucaaccaguuugcaccaagagaggccagaagccugacugguaagaaauucuuacccuuugccagcaugccagguuucuggguucccuuucucucuguggcuuugauggcccugcuuacugugccauugcuaugggggccaagacacguuacaaaagaaaaucgucuuuuuccauuucauggaaccacaggcaaaagccucuuaauuuuguaagaugcuguccaacaggcugcauggggaaaccaaauuaacauuuuccauuccaggagacuagccaccccacucagugcccaacaucaaccuggcaaggcucaaacuugcucccgauggcccuugucaucuuugauccacuccaagugagguggaaugcccuccaaccagaaguuucaacauaugguagcugggcaagauggaagaguggagagucacccugagugacagaaaagauagaaaagagaaaggagagaggaagaaaagcauugccugccgggggguggagaagcugaggagcucagggaggccagaggccuccauuccauugacacuggaucaauaguucaggaggucgcuugucaguagcaaagguaucuuuuccagcaaucucaucaucucuaaaguuucccccuuuggggagaagaaagcuccccaugucccaugauccuguacgugccuaauccugucacucacagcugucagcaaacagugcaaggcagauuaaugaaaagagaauagugguuaauaucccauagugccuaauccauuucuccuuaccaagggacaugaccgagggggaccucuaacucccuaaggacuccaaccuucuucauuugggccucuaacccaauuucugauaagcaucuuugcccuucacuaagaggggccuuuaacccccuauuucugaggagggaaccuaacccaaauccauacauuacccagaauaaaauaucccucacuuacccaaagucagccaauuggggcuguagucuauuuccuuuggguugaggguguuuucugguaucgucccuucgugguucacuagaaaaaaugguacuggaaaggggucccaauccagacccaaagagaggguuccuggacucgcacaagaaagaauuugaggugaguccacagagugaagucaaagcaaguuuacagagaaguaaagaaacaaaagaauggcuacuccauagacagaccaccccugagcgcugcugguuggcuguuuuuaugguuauuucuugauuauaugcuaaacaaaggguggauuauuaaucaguuuuccaagaaaggggagauuuccccagaacugagaguuccucccgcuuuuagaccguauaagguaauuucuggacauugccauggcauuuguaaauugucauggugcuggugggagugucuuuuagcaugcuaaugcauuauaauuaguguauaaugagcagugaggaugaccagagaucacuuucaucaccaucuuggauuugguguguuuuggccggcuuguuuagcgcauccuguuuaucagcaggguauuuaugaccuguaucuuaugauaccaguccugccgacucccaucucauccugugacuaaaaaugccuaaccuccugggaaugcagcccagcaggucucagcccuauuuuacccagcuccuacucaagauggaguggcucugguucuaacaccucugacacagggccagggcggcagccaagucgcuccucuaugcuccagccccagcuacaccaaagucuucuuccucugacuggaauucugccauuguuacugacucacccuggucuucuagaacuauucccuuguggaaaugacccccaacaaguucacaggagggcagccuguuugccucugggucuggcaggguccugccucaguuuccuucuuguuaggcagggggaaguuuggcaaagacucucugcccuggcuuccuggggcccgagacuccuguauaaagacugucucaaaugucccuuauccuccaccaagggauuugguggguuuuggcuggcuuguuuacagcauccuccuauucuacauuuguugaagacuuacugccugggccaggucucaucucucuaggggcuuuugguccccaaaggguguuuauauccauuacuucaacuaguccuagggagcuggggucaggcagcugaagugacuugcccaaggucacauaacugguagagaggagcaaagcccccuacagaagggaagacucuccaacccgauggaauucccucggggcuugggcaugggcggggaacaaugccugcaggucagggccguccugggaggagggaggugcaggagugcggggaccccggcggggaguggggauauauuuaaaucuggggcuucaggugcuaaaucccauucccccacucacagcugggccaaguguggaggaugggacggccccugggcucugcguccucaaccagggcucauccuugggccuccaauuuccaauuuauuuggggggauaaucaaacagaagaauaugaagccuggaaagauccucagaaaugaucucaucugauucuuucaucugaccagcagggacacuguggcccagggaggauuuaucuuuggcccaaaggucacauggcagacuacaauccaagcugggaugacagccagacucucccaaccuccagccuugugcugucaccccucccaaaccgacuuggaaucccccaggucauccauucaggggugcaagggggcccaaaggaaagcagacuaaaggacuuuggccacugggaacacccaaaggccugcacuggcccugcucucuacguggcccugccccaggcagcauucccagggcgcagagccagggcugcagagggagggagccaaggggagccucccucccugcuucuaagggaaaaggguugagucggcagcacuggagagggagacagcuccugccuggcuccaagccuucgggcuuagaaaaccugaccuucugaggaaacagggauagagagaaccaucaaugggacuuggggagaaacaggcuggggacacagcaaugguuuugucaagggccaacugugugccuggcaguguuccauaccgcccucaacagcuccucugcagagaagagcuguucaacc

SEQ ID NO: 17852 - RNA, 628 nt, Homo sapiens
gcagacgcaggcggaggcgccaacugcggggauggcuagggugaucacagcugccccgggggcgcggacaccccggcagcuccggccagcggagcucccccaccgcacgugucagguccuagcagaaacgcagcgucuguggccaagggccaggaaugcggccgcacauauucacccucagcgugccuuucccgacccccuuagagguggaaauugcccaugggucccuggcuccagaugccgaaccccaccaaagggugguugggaaggaucucacagugagcggcaggauccuggccguccgcuggaaagcugaagacuguugccugcuccgaauuucccuuaucaacuuucucgaccaucuuucucugguggugcggacccugcagcacuuugggcccccaguuucccgcuaagccuggccugggaaaauggggcgaggucuaaccuugcgucuccuccuaggcagugcauccauccucccuagggcagggaauucccacaguugcuacuuucccgggagggccucauggucggccuguacugccuuugugugcucaggggucccuuguuuucucugguucuuaaauguuuguuaccacagaaaauaaaacugagcuacuauuaa

SEQ ID NO: 17853 - RNA, 29153 nt, Homo sapiens
gggcgugcagacggacgcgcgggguggccgggggccggacgcacgacccggggcgggcggcaauguggggaggcccgggcagcccaggaggcugcggggacgggggcggagccgggggcgccacgggcaccgccccccugcgccggcggagccgccgcccgagugcggacccgggagcccgaggcgacuguagcgugcggggugagucgcggggagcucggggcgcgcccccgacggcgggucugcggacgacgccccgggggugcuuggccgcacaucuagcccuagggagcccuggucgacccccgugcgccucuugcccgcagacccugaggacacggccaugccgggccgggcggaggcgggggaggccgaggaggaggccggggccggcucggggucugaggcggaggaggacgcgcugugggagcgaaucgagggcguccggcaucggcuggcucgcgcccugaacccggccaagcucacgccguaucugcgccagugccgggucaucgacgagcaggacgaggaggaggugcugagcaccuaccgcuucccgugccgcgucaaccgcaccggugagccgcgggucccgagugggccacgaccugggccggccgugcccuggggcgcagcgcccacagccguguagcgcgaagcuagggcucugcugcccuggggcucggucuccgcaucaguagagugggccggcuggguaugcccaccagccugccuccuccccacccaccacugcgccuuggcgguccgcguugcccacaccggggucagaguuuugucucuugggguucucucccacuuccuggguccacauuagagcagaagguuggauguggcugccagggccggcugggccugggaccucccggucacagccgguggacuuggcaccuuuccugcgcucuuugaucuccgaguucugucuguccccuccucugugcaccauacacuccugggggaguccuuuuucaagugucaagauccgucucagcuuuacguggguccccacucccacagggugugccuuugaaccagaacucaaaaaggcaugauggaauggucuuuaaugguggaauuucaggcauggccaaugggagaaguauuuucuuugcuucuggggauagagggggcuucucugugccauugaaaaggcaggcugcauuugcgggccggcaucugugucugugggggguguuggggagcucugggagcccaggagucaugagggaaugugcuccccuggcuguggcagaauggcucucuucucuucccugauguguugggacaggccccugugugugucacuggcucaaaaaucuggggaacgugggccuggagcauggugggggcagaagcaaccaggcaccuggggaggccuuccccuagacccuggguacauccccccacuacucuguagggcgccugauggacaucuugcgcugccguggcaagaggggcuaugaggccuuccuggaagcccuggaguucuacuaccccgaacacuucacgcugcucacgggccaggaacccgcccagcgcugcuccaugauccucggugaguggaucugcgguggaugcuggcaccucggacuccagugcacaggcuccuuuccccaucccuguuagggaggcgcucccacuaugccuguugaacaguaagggaaacugaggcauggagaggcugaaggggcuugcccagggccccacgguaggcugaggguggggcugggugcuagugccguuauuccaaguucagagccacaugcuuaagauggcucuuucuucgugauacuguuuucagacauaugucugacauacacagauguauaguuuuuuauguaaaaaaauacagaggcuccaggugacuuugaauuuuuuuuuuuuugagacagugucuugcucugucaccaggcuggagugcaguggcgcgaucucagcucacugcaaccuccgccucccagguucaagcgauucuccugccucagccucccgaguagcugggauuacaggcaugggccaccacgcccugcuaauuuuuguauuuuuauuuuuaauagagaugggguuucaucauguuggccaggauggucuugauuuccugaccuugugauccgccugccucggccucccagagugcugggauuacaggcgugagccacugcgccuagcugaauuuuuuuauauaaaaaacacaaacacauacacacacgcacacacgccuacguguguauuuugcuuuuucuuagaacaacugauuuuagugauucuuucaccucuguuacauacacuuguuuuaagugacugcauacuguucauuagugaaguuaggacauaauucauuuaacccauuuccaguugauggauaccuagguuuccaguuuuguauuauuacaacgauacgggaacauccuuguaugugcgucuuugugcaaaugugucucaggcgaagagguucugagaagaauuucucaaagagucuguguauuuuaacuguuaaaucaacauaccuccuaccaggaauguguaagggcccauuugaauccuggggaucauguuuaaacguuuuuaccauucugauauguaaaaaauaauguuauuguuuuaaguuuauauuucauugagugauacaguucacagguuacuaguuauuaaaccuuggguaaauaacugcucugugcuucaguuuuucugucuuuaagauggguacaauaauaguaccuaccuuacaguguugucauaaagauuaagauauaucuagcacaaagaaugaaguuaacaaauauuaguagcuacuguaauuauuguugauagguuggugcauauuuuccuguauuuauuaacuauuuuuauuuugggacuugccuauugauaguuuuuguccauauuuuuauuugguuguugaucuuauugauuuguaggagcucuuuauauauuacggcucugaguucuuguuauauuuucucccacucuguugcuuauuaacuuuguuacaucuuucauuuuucaaagguuuaaacauuuuuauauggauuuguccaucuuuuuucucuuauaacuccuggauuuuguguguuguuuaggaagaccuccccugcucccaauucuacaaauauauuccagaauuucccucuaguguuuuuaugguuugaguuuuuugacacaguauguuaucuccuggauuuuacuugccugagcugccuauucuguccccuguucuguccuggcagaugaggaggggccugagggccugacccaauucuugaugacagaggugcgacggcugcgggaagcucgcaagagccagcugcagcgggagcagcaacugcaggcccggggccgggugcucgaggaggagcgggcagggcuggagcagcggcugcgggaccagcagcaggcucaggagcgcugucaacggcugcgggaggacugggaggcgggcagccuggagcugcugcggcucaaggaugagaacuacaugaucgccaugcgccuggcacagcucagugaggagaagaacucggcuguacuucgcagccgugaccugcagcuggcgguaggcccuggggagaugggucggggaggcaagggaaggggcagcuuuugcaauguaguagccagccagccugugucccagagccaccauugcuggcucuuugacguggauaaguccuuuuagugcucgguguaccuacuucauuggguuaugacugugguucucaauggggggugauucugacccccuagaaacaucuggccaugucuaggaaauauuucugguugucacaauuaguggggauuuauuggcaucugguguguagaggccagggaugcugucaaacgcccugcagggcacaggacaguccccagcaaagaauuaccuagccuaaaacaucgguagggccggggccaagaaacacuggguuaugaggauuugauaaguuguuuuuuuuuuuuuuuuuuuugagauggagucucacccuuguugcccaggcuggagugcaguggugugaucucggcuccuugcagccucugccucccggguuccagcgauucuccugccucagcuucccggguagcugggauuacaggcucgugccaccacacccagcuaauuuuuguauuuuuaguagagaugggguuucaccauguugacccggcuggucucgaacuccugaccucaggugaucugcccgccucggccucccaaagugcugggauuacaggcgugagccaccguaccuggcccggugaguuuaagacacaguuucaaacauguacagucccuagcacacugcucacaacuugugucaucaguagccauuguugauauuauuaucaagagacacauagguuaaacaucaugucuucuaauccucaccaaagcaccauacgccaagcccucauuugcaaauacagacucugagacucagauuagugaaaggacuugcucaaggucacagagccaggaagcggcacagccuggauuugaaccggguccggcuggcuccagugccagcccccuucccacgcugcuguuccgccuacucccuguguggggaagucucaccugacucccuccagcagcaagugaggcugugccuccuacugcaucucacuuucuugguuucugacugggacucagcagggggauaauaccaguauuugacugccacagggcguuguuccaaggauuuaaugagcugauccacgucaagggcuuagcagugcaggccgcacggcacgcaggaggcucucuccagccauguugcucgaggcugcacaguggguucugaccguggaguuugaagccucccuaccccaggagccuugggccguggcuacagcauugcagguggcugugaggcuguagaugugggugcacuggugugccaguccucgguuugugcacgccaggugggucgauaucuuggggaggugagcccugauggggguguugaggccaccaguugaaggguccaggcugcugguccugcuugaggauguagguggcugguuugagguugugagaugaccuugaggcuaucguucgagggccugguugguguguggcaggagacggaggcuuucugaggagugaugggcagggacagggacaugucccaggccugcucuacugugaaaaaccauguggcauggggaaggcuuuccuuucugugccucaguuuccucauccucaucacagauaaggaugauguaacaauuauaaaacggccuugugcuuuauagauaccauccucagugcuugccaugcacagaccccuuuaauuuuccagccacccuacgcugggguggacaacacuaucuuccccauuucuagaggaggaaacugaggcacagagaaguugguuagagcacuuucccaauguccugggauugaaggaauuuuuuuuuuuuuuuuuuugagauggagucuugcuuuguuacccaggcuugagugcaguggugagaucuuugcucacugcaaccucugccucccacguucaagcgauucuccugccucagccuccugaguagcugggauuacaggugugugccaccaugccuggcuaauuuuuuuuuuguauuuuuaguagagaugggguuucaccauguuagccaggcuggugucaaacuccugaccucaggcgaucugcccgccucagccucccaaagugcuggauuacaggcaugagccacuguguucagccggauugaaggauuucugaguuggcucucagcacugcugaggggcgguggcuggcagguaggagugcuccccuuucuuuacccagagggcuuccccuuuuuucugaaacagacauggggcuugcuguaggguuuucucagaagaaauaauuuacugcuuagagaggacggcgugagggcugcaggcuggggguacugggaggggcugcagcccucacggcuugucccaccuuuggguugggugugaugcgauugggagauguccugcguguguggccaucugggggcugcugggacaggggagggggauggaaaagagauggucggaggugccucuguagucugcaggucaucugccucuacgcagaguggcugcuuuuuccuauuuuagggaccuaagaagugaaauuggccaggcgcaguggcucaugccuguaaucccagcacuuugggaggcugaggcggguggaucaugaggucagaagauugagaccaucccggcuaacguggugaaaccccgucuguacuaaaaauacaaaaaauuagccgggcgugguggcaugcaccuguggucucagggacucgggaggcugaggcaggagaauugcuugaacccgggagguggagguugcagugagucaagauugagccacugcacuccagcuugggcgacacagcgagacucugucucaaaaaacaacaacaaaaaaagaagugaaauuaaacuuagcuacuauaaauuuaccuuaauuuauaauuuauguuuggagcuuuucugcuccaaaauuaacaaagguguugcagauggaucugaacagagcaccugaucgugccuggcuuggcggcuugcauccccaccucccauaggcagguguguggcggcugggauuuaauacccuguuuuauaaggugcaaauuuaaugagcuguuauuucuaagcaacauaaacugaaggaacgaacgcuauaauuuugugcucagugaguuuguacgccgggauuaaaugcauccguauuuccuguugcucgucggagacucccagguguccuguccucugagcucaucagggaagccggcuggccaggggucaggcaggaggcccugguguguggcugcgguuugcugagagggugugaccacaguuguccuuguaacgagcugucuuucucuggcuguucacaaagcauguuuugugaguggaaaggaaugcgggagucaugaauuucuuucugagucucuugcggaggaggaggaguggacuguuaauuuguagaauugccugacccagccuccagacccguguguguguguguguguguguguguguguguguguguguguguguguguguguggagggggggcugccauucuaaccucucaaggcuggggaacuagcaagucacuuuccaagagaggccaggggacuccuagggcaccaaauauugcaugccugacuguagcaccagaagucauugugaccuuuucccaacaaugacuucauuuuauggccugccaccugcugccacucuugucacugucuggccaccucagaccccacaugcgucacgcuuggcugagugcacucauaguccagcaaacuggccaugcacgucugcucccagcuugguggucacaccacagcugcccaccccccauaccaggccaacuucuggcugcacacuccgaacuggugauugguuaggggcaugggauuuuguuugaagcugugaagacagccacggucacacuguggcagcucuguagcccuucauaguuuagaggccucugcccacuugcugucuuguuugauucuugcaacaccuuugggaggcaaaugauggggccaggggauugacugggcccauuuuacugaugaggaaacugaggcccagaggagguaagugacuugcucaggaugacagagccuagaaguagcaaaauugaaaccugaacccuggaacuggagcucuugagggagaugaaccaacagccaaaucuucuggaguggaggcuuuguuaggaauuccuuucaggguggaccagaccaagucugagucucugagaguguguugaggugagauguuggcuuguugcggggagcaucugguucccggacuggaugagucccucaacucucaaaaccauugcccucuccucuccccucacaccccccccguacagaugagaugauugaggcacagagaggggccaugacuugcccagggucacacugagcuagagacggagcuggggucugacccuguuuuuuuuuuuuuucuccuucuuucuuucuucuuucuuccuucuuccuucuuuccuccucccacucugcccuccucccgccuccuccuucuccuucuccuccuccuccuucuccuucuaccucuucccccucccuccuccuccccuccuccuccucacccccuucuccuucuucuucuuuuuuuuuuuuuuuuuuuugagacagggucucgcucuguugcccaggcuggagugcaguggcacgauuaugguucacugcagccucaaccucccaaagcucaagugauucucccgcuucagccuccugaguagcugggauaauaggcgcgcaccaccacacccaacuaauguuuuaaauuuuuuuugucgagacgaggucucacuguguuaacuaggcuagucuccaucugcccgccucggccuucuaaaguguuaggccugguuucccuuauucuuuuuuuuuuuuuuuuuuuugagacagagucuugcucugcugcccaggcuggaguguagcggcgcaaucuuggcucacuguaaccuccaucuccuggguucaaaugauucucgugccucaaucucccuaguagcugggacuacaggcaugugccaccacgcccagcucauuuuuguauuuuuaguagagacgggguuucaccauguuggucaggcuggucucaaacuccugaccucaggugauccacugagggcccgccucagccucccaaagugcugggauuacaggcgugagccacugugccuggccccacuucuucuugaugcggcccuccuccuuuucugccaugagaauacugggcuaaauugacgggagucagugucagaagugcgggacagacagcgugucgugaugcagcauguccgcccacaaguucuuagaguggauuccccugggaggguguccuuggccuugcuacccacugcuccuuccucagcccuguuuguuuuauaucuguccagccuguccuguuuucauagacaagccuggggaggacuccugcuucggcuucucugggaaucugggaggcacccaggagugagggagcaggucuucccaccccuguaacccguggcucccagugugucucccucugggcugacccaugucuugggcuccagguggaucagcucaagcucaaagugagucggcuggaggaagagugugcacugcuucgaagggccaggggcccgcccccuggggcagaggagaaggagaaggagaaggagaaggagaaggagccagacaauguggaccuugucucugagcugcgugcugagaaccagcggcugacggcgucacugcgggaguugcaggagggccugcagcagguaccagggccagggcuugugggcacaggcugggggguggucaggagggccugcagcagguacuggggcuugugggcacaggcugcggggugggggaucaggaaggccugcagcagguagcagggccagggcuucugggcacaggcuggguagcggggcucaggagggccugcagcagguaccagggcuggggcccaugggcacgggggugggggguggucaggagggccugcgguagguaccagggcuggggcuugugggcacaggcuggcaggaggucaggagggccugcagcagguaccagggcuggggcccaugggcacgggggugggggguggucaggagggccugcgguagguaccagggcuggggcuugugggcacaggcuggcaggaggucaggagggccugcagcagguaccagggcuggggcccaugggcaugggggucgggggaggucagaaggaccugcagcagguaccagggcugggccucguggccauggggguugagggggggucaggagggccugcagcagguaccagggccagcguucaugggcacaggcugcggggaggucaggagggccugcagcagguacuagggccagggcucguggacauggagugggggugggggucagacccggaaaacaggcccucuugcuguuugcuuauccucccaaggccugggaagcugaggauuucagaaccagggaucugagaucuggauggagucccgguagccucuugccugaagcucugagcugagggcccuuagcacguggcugucccugguugucuggucuagggugugugagcagccuccagaagguccucaaacucccuaaaacugccccccugauuuugagugugagcauuuuucuggggaaagggccccagcuuuaauuugauuuguagaggguguggccugggggcccuagggcuugcuuaguguccugcggcaggucaguggcaggucagcagcugcaugggccugccuccuggccauuguuccacacaggaagugggggaugagagccaguguguuucaugggguuggggcacuuggcuggggugugggucugggggcaagaucuugggcccagggucuaccuguaugggccaggcucagccccuugaagaccccuagucaugggggugggaguaggucuugggaauggccuccgucugcugcccuggauggugggugagggccagagcacgagugugugccuggugcuuguuuaggaauaauccugggugaacuuguccagucacacccuucuccacuuagcuuauuagcuuacuuguaccccagauacucccuggaggguggguagggcuuguggggccacacccacucugccgauggggagacagagauccagagagggucgaggccccgggccagcauggcagagcuggucagguggguuuggagggcugagagcugcguguccccuuccuucccacacccagggugggccccuagccagacccugagguggcccugcccugugauccccaggaggcgagccggccgggggccccgggcuccgagcgcauccugcuggacauccuagagcaugacuggcgggaggcgcaggacagcaggcaggagcugugccagaagcugcaugccgugcagggggagcugcagugggccgaggagcugcgcgaccagguggggcccugcccgugcccugccccuugugcgggagggugucaggcagggccugugugcucacgccuucccugagcaucugcuugacgcaggcgccgcgcugagaacugcauucauuuguucucagauguugacggaggcacccuucuaggcgcuugagaugccgcagugagcaaaacaaaggugccuuuuccuugagggggaacuccagcaggggagacuggcaguaugugagauacacagucccacgucagcuauuucauguagucaaaggcgaugagcaccgugggagaugcagagcuggggaaggggccgguugcaguuugaguggggaggccaaggguggccggaugggugaaaugaugaucauucuucucguuuuacagauuaggcaguugagggccugugagguaaagucaguggcucagaccacuccacugggcaggaggggacuuguuauugggucucagacuguuggugagcgucucucacuggcccuccugggcaccugcugguuagcuuucucaugguccccagcccuguggucugaccccgccccgugccacccucaguaccugcaggagauggaagaccugcggcucaagcaccgcacgcugcagaaggacugugaccuguacaagcaccgcauggccacuguccuggcccaacuggaggagauugagaaggagcgagaccaggugagcccagccugcguguacgaggcccugggccaguugcugcuucccauaugggaggagacaaggagcaauggaggggacuagaaugguagaaagagacguuagccgcucccuguuggguuaggacggggcacaaaggcugggggaaccagacaggagaccuggagcccuugagauaccagccuuacacccuggacccacuggccucaucugagcuccuguggcaguuacagaagcugguccuggugucuucauuuuugaaucccuuguucuguccaucucaaagacaaggccagcacagagggagugcuuacaaauagaagccgaugaagaaauucucaaaaguuuuggcuuucagucccugggcacuaugacccuugucuccugccaagguuguggggugggcugaggaccuccggccagugccaccaggcccccgagccuccuugugugagguuccaucugcagcggggaagggcaggagguuuuuguccuuaaccaggugugaaucccacuagaggaguugaagucuguauauuauuguuguuauuacuuuuugagacugaaucuagcucuguugcccagguuggagugcaguggugcaaucucagcucacugaggccucccagauucaagugauucuccugccucagccucccaaguagcugguauuacaggcaugccaccauuccuggcuaauuuuuguaucuuuaguagagacaggguuucacuauauugaccaggcuggucuugaacuccugggcucaacugauccaccugccucagccucccaaagugcugggaucaaaggcaugagcucccaugcccagccgaagucugcauauuagaaaugcccucagaauccccuggcaagcuugaaagugcaaauuuggggcuucauucucuggacguucugauucagguggucuggggugggccccaggaaucugcauuuuauggggcugcccccggcucucucugaggcaugggugacaggucuggaccaugggcccagcucuggagccccuggucuucacuguggaugcagugggcuggguuugacuccuggcuucuccacugacugggaugcugggagugaagccccuggcacacagcaggucucguggaaaaguuuucaguucuuggugaaauggugagagccuggauucugcagauggacugcccgauuugaaucccagcucugucgcuccuggcuugguuuccccagucugcagaaugagaauaaugauauuaauaguaucuaacuuagccaguuagugugaagauauuuaaaugagcugauaauuuagcucagggcccggcacacagugcucaguaagugauagcugccauucuccuuacuguccccauucuccaagucauaggccaggaaagcugggccaagguggcuccuucagcugcugccuccccucccccaacccuaggccauccagagccgugaccggauccaguugcaguacucacagagccucaucgagaaggaccaguaccgcaagcaggugcggggccuggaggcggagcgggaugagcugcugacaacgcucaccagccuggagggcaccaaggcucugcuggagguucagcugcagcgggcccaggguggcaccugccucaaggugagcgggucaagauuguggagguccuggcaggaaggcugggguccuggcaggagcucuuggccagggcugggaacgugccggcccuggugggagaccucagccaggggaggaagcuugggggaagugggaagaguccucaguuaggggcgggaacuugaacccaggcugggcugggugugggcuggugagcaggcggaggggcauguuggucucugaguuucugggguugcuucugggacacuaagaauaguuuggagcuggucuuugcauuuaacuggggaaggcuggcugccugagugccugugugcauguuagaaugcaaaaccugggccucagagaccagcuagucaggacuaacaugggccuaagcaucccucagagaccagcuggucuaauccucucaucgcacagggcccagagagggugaggggcuugcccaaggccacacagccagcuagcacuggagcuggagucccagacccacuguaaauuggaucgugguccucaggcugcugccgggagcucugcuuuuuccuuuuuuuuuuuuuuuugagacagaaucuugcuguaucacccaggcuggaucccagguucaaguuauucucgugccuuagccucccuaguagcugggacuacaggugccugccaccauacccagcuaaguuuuuuuuuguauuuucaguagggauggggguuucaccauguuggccaggcugguuucaaacuccugaccucaagggauccuccugccucagccucccaaagugcugggauuagaggugcgaacgcccagccugcguuuucuuauuuugaguugccugacagugagcuccgcaggccugguguuugaagcacuggggccuggaggaauauaggaaaagucagcauuaauccaagacuuuuuuuuuuuuuuaacccccaguggcuuuuuugcuguuugguaaagacagagucccuuuucauggccaagaggcccugcgggugggguuccucuuguccucucgccugguucuguggguuccagucuuucaacuggaaugcaucacaguccugccucagggccuuugcacaugcuguugaucugccuggaccaucccagcuugaccuacuuagcgccucuauacccuugaguucucaguucaaaccacaguuucuuuggagaguacuuggacucccaggcuggguggggucuuuguguguuuuccaugcccugggcaccuuccuucugcuauugucucagcuuggggcuauuuuguucacaugucugcugguuuacaguuuaucucccauucuaggcugugagcucccugaggacagggaucugucccugugcuggcacauggcaggugcucaguaaaggacugugguugacgugggccuagcacugcucaccuccuuccucuccucucccucuuccaggccugugccuccucccauucccugugcuccaaccucagcagcacuuggagccugagcgaguuccccuccccucugggaggcccagaagcaacuggggaggcagcugucauggggggaccugagccucacaacucgguaagacaacugccccaucccaaauaaggggggacacugcuauagcauuauuacuaauguggagagugcuuucugaaggauccauuucacaggugaggacacugaggcgcagggaggccaaguacuuuacugaagcucacccagaaccauuuccuugccaggcauaggugccaggaggcguggggagccacccgcacacuauaaucuugcagagcccgcucuucugcucugggcccuacuucucauuuguggaaugggcacaaaccaggugugcugaggacugggauggugcugggcagugggggugacccaggcccugucauggcauugcaggaggaagccacagacagugaaaaggagaucaaucggcucuccauccugcccuucccccccagugccggcuccauccuccgccggcagcgugaggaagaccccgcacccccuaagaggugagauggcuggggauagcaguagacacccagggagguggggcugccguuucccgaacagccaccucccagaaucugcaaugccaaagucagguccaggcagucacuucccuuuauugcccucagauggcuggagcucuggaaacccagguccugugagucacaggggcgaccaaggucaggcuuaagauaaggccgaugggcagagcgaacucaguccuagccaagcauccuggcaggagggucacugggggucaagccuugaagauccuauacccaaggagaagcuugaugguucaggacuagggggcguggagaauguuucaagguaucagggaccuccggcaagaaagccaggccccagguuugggcaucagcagcaaauagggaccagaaaaaccaaggcgcacccucugguggcaagaccaagggcgggagauagccugccuccuggggcgcgauccuugucacugcuuuuccccuguaagcagcccuugauuuauuccuuuacuggugagaggcugggcccugggaggcuguggucaguauggccuugaucugcguaaaucugucccaaggaggugucugaugaggaggucaugguuuaauuuaggaggcguaccugggagucacaaaccacaaagguggcaagugagggugaggugaggggugagagaucagggguggcuuccaggaggagguggcauugaaagagcuggcuuugaagggcaugccagggcauuguagguggaacaacauuggacagaggccaggacauuaacuucuuacccugggaguuuaggggagccagguggcaugggugcccuguaccugggacccugccuugagucuagccugcauuugcuugggggcugugagacauuuaucuggugugggggcaggaggagggagcggggcagagugcccacugugccucaccuccugcccccucccugcccucucucugcccagauccuucagcagcaugucagacaucacagguaacagcccuugaguuccguggggagggcuccucuggucgggggagguggcuuugcagcccaccugaagccugcaccaccugcgcuaccuuuggccugcauccccuucccugaagccccgccguggccccugccaggcaggaagguugugcuugggaggacccuggggacuuugguuccagccucucaccccgagcccaguccugggccucacuccuguucccggcugugauguacgaggcucuucaguucugggccaccuuucacccucuucugggaaacugcggggucagccuggugggcccugaccuaucucugagcccagugggucugaugugcuccuggggccucaaaccugccaaggccucucugggcuggaggggggucagucccugucauggacccuggccaucccuguuucccagugccagaucccugaaccucauucuuuuuccccagggagugugacacuuaagcccugguccccuggccucucuucguccucauccucugacagcguguggccuuugggaaagccggaaggccuccuggcucggggcuguggccuggacuuccucaacagguacuguagcugccugcaguggguggagcuggggugauugcuugagaggggaacaggagugaggugggaggagcaauugccucgccccuguuuuaugcaacuauuggaagauuaagaucuguagacacuggcagcccuuggauuccaauccugcugccgcucuugaucgucccugugacuugggcuggucccuucacuucucugggccuccauuuccucaguagcuaaagggagaugaugacccuuuuugcauggaggucuuuugagggcucugcucgcagaagcaaagcacccagcucugccaggcauguagcaggugcuuaguaauaguugucacuuacaagcuguccucgucccaauguccugccugucagucccuuggcucugagucccugggacugagccacccagcaaaguuucaugcugugggugggcuugggucaccucaggagccccugugaccgggccagccacagguccauaacaggagucacaaagcccauuagugcagagugcacuguaggcgacgugcuguuaguguggccggugcguggccgcuguucacaccugccaguguaucuaagggagggguggggcagagcgggggcugcacggccauuguggucuuggaacucagcugugaggagagggcagguagggagagcauccggugacuguggaggaggagcgagggggaagggcgaaagucaaggcuuccugagucaggcugggaaaguguggacuuuggcuuguacacucugggaaaugugggaggguuuaguuauuaacugcaaggccagcugcuggcuguuuuacaacaugcucuuuguccagggaguaggcauaaugacgauuaucucugcuccauagaggagguaacuggggcucagagagguuaagcaacuugcccagggucccacaguugggaaguaccaggucuggguucauagugaccugaucagauuuggguuuuggaaagggcauaggaaacauggacugucagcgcuggaauguggagguguugggugcagagggaugggucacgcagcagauggguacagcauaggaccagggccucuggccuccggagcggcuuggucagccaguguccaggcccugcccccaccuggcccccggcagugggcucagcgagacauuguuuuugccugugcaggacgugcuucucggggaagggguggaggcgccucccuuccugcucgccucggcccuuccucccuuccuccaguuugggcugcagcagggguccuggcuguuguccagggggcgccaggaugcagccagggagcaggagccuccgucccagccccgcccaggccccacgaucacauggggccacuucugcugcccaugcuguuccuggggaggagagagguuccuggggaagaacacaggcuggggaaggugcagaggugguggacagagagagagagagaaagagagagagagaggcagacaggcggagaggagagggagagggagaugagggcccggacaggucccaggucggggcaacuugugugucuccugggauuguguuauggcgaggugggaagagcuggcuuuggugucagcacuugcuacugugggaccuugggcaugucucugaauuucccagugccucaguuuccugcucuguaaaaugggcucacauagugccugucccuuagggucacuauggggguuugaguaucccuucuagaaugcuuagcacacucacgguggaugucagcauaugcucgcgguuaguuaugauuauugucgccauuguuguuuaauccucagagcagcucugcaaggcuggaauuuuaaccucguuacacagaccaggacacugaaguacagagacaguuagaaauuggucccaagucacaggccccucggagcugguuggagauuccgaugugccuccccacugucucagcuguuggagaucucacauccguauugugugcccacuuuguacugggcaccauguugggcauuuucucuccucuuucccauuuccugcccaucucuugcccucagccucucugcccugcccuucucagcuccuggagccugggugccgggaggggaugguggauaguggggggcuggggcagaccggggguugggcugacagauagucaggugggggacagcaagggagaacucauggggcaagugaggugcugggugagagaggcagagcauggagagcacuggaggguuucggggugccgucuccccagcauagccucaccacugcccagcucgcucacguggccccaggggaucucuggcaccuucuguccuugcaaagagaggguucccauaagucauugccuggcuccacggcccacuagcugugcccauucuuggcaaguuaacuuuccugugccucaguuucccuuaucucaaccaucggguugucaggaggauugacugaggugaucuguguggcaugcuucagucucagcaucaggucccugaccugguaccaagcaggcacgcagacuacucagauaucuucccacggggcccugggggacauucauugaggccauguggccugucacugcucagagcuggcagagcuggcagacuugccccguuccugucugccugugaccugaccugacuggggagggggcugggagcugguagcuaaggacacugugcuuccuaguaccacacaggcagccagcuggucagccagucccaggagcggggagcaggcagccccucucccugcuguguccuuucucuaccccuccugcuugucugcugaggcggggggcugggaggaacccuaucuggacccugcucugggcaagccccugugggcucugcagacuccgaggagugcugggagcagguauuccuggucuguggaggcucagagaagucacugguccuuugaggagguuggcaagggcguccuggaggagggggcgccugagcugggucuucagggagcugcaggaguugucaagaagagccugaaaaaccugaguugaaagcugaggucagccuugaugcuugcauugcagaggggagagguguggaggagggagcgaguagaggugggugggguggguaggguugguggaagagccuggaugccagcugcuuacugggcucuggucuggagaggccaugauggucaguugucuguggguuugaaacagguggggaaacugaggcaagcgagaggugauuuguugugaaucacaccugaugccaguaaaugucuaguuuugacagagcacuuagugucuccugggcccuguucugagagcugcccaugucuaaacucagcgaguagccagggagguggguggagcugaggcucaagcggcugagcagcugggccguuugaccccagaguuccugcuggcacccugcgugcugugcuucucggaccaucugaccacaacccacagugagagaaacccgguacacaugccuggaacaaaaaggucaugagauaauaauuggauuuaccugggguggcgggagcggggugggggauagcauuguacuuucuauuccauagcauuauccagcugucccagucgcaacccagugaauguuaccagccacuaagggccaggccugcaguuuggaggccccagaguccucugguuuccaccucucccugcauuaucuuuuauucaugugccccccccccccaccccccagcacccacagagggcaaggggugucauugucagcuucguguuaugcaugugguaacugacgcucagcagccggcucauuugcccaggcuagggugcaguuugcccugggguuuggagcggaccgugugcuccagccacaaagccagggccagcauagccaggccaggucucaggccugcccccuuuccaugccaccucgaugcagccaggacaugcggcacugaaugaugccucccaugccugcaucuguccagccccucggccuggcucugugucuuaccugagagggcggggcuguuccccagcagugccgauugggugggagguccuugcagccgcgcccuccccaggcuggcagcagggggcagugcagcugugucugggcugcagcugcugggguggauggagaugcuucgccccgcugccucuccagccagcacaccugcugaccuuggucuccccaccuccuccaggccaaggugucuggcaggggacuugggguccauuugucucugagccuggccacaaggccucaccuuuucucauccagggacaggcagaacccuaccaugauggggauuuuggugacgucuuaauugucagugguccuccugcccaugggaggaaaaccagacgccucuguuccacgcccuccaaaggguggcuccagcuugccuuuccugggagcugcuucccaggauguaaaauaagaauuagggcaaggagcucagcauggugucuggcacauggaaagcacccaggaaguguucgcugcuauuguuauuauuaaauucuuccacgcauccuguguucuguccuccacaccuuugcucugauauauuccuucagccuggaacucuguuuccuccaucugucaccaaagugcaucuauucuucaccagcguguagccuagguacuucuuccgugggaagccucucucugcuuccacggcugguuguaaccaccuuuggaucugugccacgugcuaauggugaccucccuccucagacugugagcauaacaagcuuuuuuuuuuuuuuuugagacagaguuucagucuuguugcccaggcuggagugcaguggcucgaucucggcucacugcaaccucugccuccuggguucaagcaauucuccucccaaguagcuggaauuacaggcgcccaccaccacgcccggcuaauuuuuuuguauuuuuaguagagaugggguuucacuauguuggccaggcuggucucgaacuccugaccucaugauccgccugccucggccucccaaagugcugggauuacaggcgugagccaccgugcuuggcuauauaacaagcuuuuauuagucaucugcuaugugccagacacuggguuuggugccagggcuacagagcggaacaguauagaaguuugguccugaagguguucguucugauggaggaaacgaaagggccguggcaaggcaaaguuggagugcucuguggcacgcaggcuccacugcaccgugugcccagguccaggggagaggcugcuugugacuugagauuugaaggaugaucagcauuucccagguggagaaggcaaggaagagggcacagaagauggagaggccugggggugggagucauggcauacuugggaaaugaaaucacugugguuuuccaagaaugcugaacugaauccaaguacugauuggacuccaauucucaucuccuuucucccuucucaggucucuggcuauucgggugucuggccggagccccccagggggcccagagccgcaggacaagggaccagauggacugucguuuuauggggacagauggucuggggcuguggugcgcagggugcugucugggccuggguccgccaggauggaaccaagagaggugaggcccugccuccugagcuggggggguagggucagugcuuuugcccaggcuggacaucccuuaauuugguggaucaagaucaccgggcagagcuucuggggauuggucaaagccgaagcgggcucagugauuagcugugguugccugcucagccaggcuuaauugaagucugauugggcagggacugggagguggagccaacugacagcacguuacauuccugcgcuucaagucgagaaagaccuggaugagcugggcggguuggggaguccuguggaugggggcguccuguggauggggacgggucugacugggcugggcauggcaguuucugagggggcgcuaucugaacugugaggcaugaaacacccccacaccuggucuuccuccagccccugggcugcucuacucucagaggcucacuucuuucccucccugccuggguuuucucccagcaaaggguggaagcugcuggucuggagggggcgugccuggaagccgaggcccagcagagaaccuugcucuggaaucagggguccacacuccccucccugauggacucgaaggguaagucuggcuugggagucggagcuguuggccccagagggguccucuaacccguggugcaugggguggggagggaccaaggaccugagaagggaccagccuugccccaauugcccuucuccuggcuccccgccugcugaugccuccuucugucuguccuugugcccuuucucuaugccucccucuguaagcagcuuacagugaaaggagcacuacauuaggaguccagagaccuggguuugaguccuggcucuguuucuagaaggcacuggccuugggcaagucccugcccccucuggaccuaagucauucuaagaaggugaaggucggguccugggaacucaggccucgagagggccaugucuuuggccccaccaaggccgauccuggaccucaccauccuccucuuguccuccuugcugcccccugccccauccaugcccagccugccaguccuuccacgaggcccuagaagccugggcaaagggaccaggugccgagcccuucuacauucgugccaaccucaccuugccugagagggcagauccccaugcccuuugcgugaaagcccaagagauccuucgacugguggacucggcauacaagcggaggcaggaaugguucugcacccggguugacccccucacucugcgggaccuggaccggggcaccgugcccaauuaucagaggugacgcagagccaggagcuggggauggggucccccugggagccagggcucagaugggggugcucucccuccaccugcauucccucaccauccucugggacagggcgggggguucgaggagaaaugaggagcuuuccuucuuucuacacacaugaugucacucccucccacagagcccagcagcuccuagaaguucaggagaaaugccugcccuccagccggcaccgaggcccccgcaguaaugugagcacggcugggcagguaguggguggggggccccaagggugggguccaaaagggagcuagcaggcucuguucucuggcaaccuaggaagacacucccucccuccuucccuggugauuuaauuggucaucuacuaugugcccagcaaacagaacagcagagcucaccguccaggguaguuuagagaugaaaugagguaaagcgugccuaguaugcaggaguaccccugguacauaauaagcauuugacaggcugggcacaguggcucacgccuguaaucccagcacuuugggaggccgaggugggcggaucacaaggucaggagaucgagaccauccuggcuaacacggugaaaccccgucucuacugaaaauacaaaaacaaaauuagccgggcgugguggcgggugccuguagucucagcuacuugggaggcugaggcgggagaaugaagugaacccgggaggcggagcuugcagugagccaagaucgcgccacugcacuccagccugggccacagggcaagacuccguuucaaaaaaaaaaacaaaaaaaacaaaccagcagucauguccccuuuuccaaugccuggaugguggcugggcuucguggccagcgcugcugugcacaugggcaagugaggcucagagccaucagauaaaggaagagcgagggccccagccaggcagccugcauucgaccccagcucugccaccuaucagcugugugacuuuggacaaucaccugaaccuuccuugaggcuuguuuccucaucuguaaagugcggggguuguacugccugucaggcugugcguggcaggagaugacuuccgugaguuagugccccucaggggcuuagugagugucugucauguuguaggcauuugagaccugucagguauugguaaaaucagugccaucuuuauugguuucauuaauuuuucuaccaaggucacauugcuaauucauuggaagagacccuaaaguuugccucguaugugacauuugguuccucuuggucucugggccucagucuccccaucuguagcuugggggguauaccuaaggcuccuccaccaggcucagacgggcuggcuucccgggggccacagggauggcugcucucaucugccugggggacugugcugggcuggggaggggcaggggagggccugguggagaaggacaucuuugcugacccaggcucuucuggcaagccuggaccacaguggcaguggggcccgcugugccaggggucccguuuccuccucucccugagggggcggggcugagcucucagaugcuccucugucccugcacccucccagcugaagaagagagcccuggaccagcugcggcuggugaggcccaagcccgugggggcgccugcaggggacuccccggaucagcugcugcuggagcccugugcaggugagugcgcgggggcaaagcuguaucccguguugcucccauuguccagggaugugugcagcugaguguccuuuagcuuggguggccucuuuggccuggaagggccuguugugaggguuccaacaggagugggggucaugcugggggccugagagacaagaccaccccaccugccauggugauugccaagguugagggagacccugcggggaggugcaugcagacguggcugugacuguggguuugcacacauacuggcuuguucuuuucuggcagaguguguguaguggugcuucucacacgugugugguggcaggugcugugaggacccagggggguucccggaggcaguagggugaggccuuaggccagacagguagaaggggcugggggagcucagaugagggaguagcaaaucuggggcaagaggagcggguaguuagggaagacuuccuggaagagagggaguuuccgcgggggccuucaaaguuaaagaggaguucguuccaggcagaaggcacagaggcauggcuguguguggugugcuuggaggguguuggggacagcaggugaguauugaguaccagcucugucaggcauuggggacgugacugucccugcccucauggagcuugcugucuaauuaggggguagagagucagauaaucccaccuaugaacacaaugagagagugugaggugugcaguggagaacugggggccguggggcacaugccaggggcccugaugucuggggaccagggaaggugugaccuaggcucugaagggagggcaaggguuaacugggcugaguggugcagggcuggggcuuugggcagccccagggcaugcaaaggcccugugguuggacgcagcugaagggagaguggaggcuggugguguggggucaguggcuggcagccuccccaggcucucaggcaggacugugucacccacgugggggauguggcuuuuauuccugagaaucugggaagucacugguguguugaaagcaggggaguuaacaugaucugauuugcuuuuuaaagccucucuggcugcuggauggagaaugacccguagggggcagggaugaggcagagaaucagggaggagccuacugccaccgucgguccuacuaagggugugugugugugcauguguaggaggagcagcagcaggacuuaggaagggauggguggcgggguggguuuugggguaucgacgagcugguaugcugccugccugugcccuuaucucuuuugcgccccuccccugccacagagccggagcggagccucagacccuacaguuuggugcggccgcuacuggugucugcccugcggcccguggugcuguugccugagugccuggcgccccggcucauccguaaccugcuagaccugcccagcucccggcuggacuuccaagugugcccagcgggugagacuaugugccggggaggggaggcugggugccccucugggcagccgggcccauggauccuucaucucucccucuccacucccugugcagaaagccucucuggggaggaacugugcccauccucagcgccuggagcccccaaggcucagccugccaccccugggcuaggcagcaggauccgggccauccaggagucuguugggaaggugggugcugggggcuggccuggggugcucacagagguggcccagagcgggugcugcuguucugggcuugagcgccagcgucugagcgcgggccaugcucugcugcucacuggcagggcggcccuggccaaguccuuucccuccuguggccuucaguuuccucaccuguugccugggugggugggggcaguugacugcaugugggccccccuugagguguuuggcugacacagcucaccuacacauccuuauccuugaacuugccacuauccugggagcuggcagucggcuauaagguggcgggugguggguggguuugggucagcuccauccuccggguggggaggccuagguccugagggggaggucuguaucuccagguugccccaugagcccaggccucuugucuguacuuuugggcuccuuccucguugccagggucccucuggguggggaggcaggacuugcaucugggaaggcggugauaggggacccgucugggggcagcgcaugggaggcugaugucuguggcccaggaguacauuguagccucgauccuccaagcagaagcacugccugcuggagcugggugcucggggugugcgggagcuggugcagaacgagaucuaccccaucgucauccacguggaggugacugagaagaauguccgggaagucaggugagguggguggguggggcagugggcagggcacucggaccugagagcuuccuccuugaggaugccucucucccuccccccucucucucccucccccucuuucucccucccccucucccuccuucucccccucucucucccuccccccucccucccccgucucucccuccccuucucugucucucucucuccaucuccaucugccaucugucucucuuugguuguccaucuucucucucugacucuucccccuuugucugucccucucucccugucucucugucugucuuggucccccacuuugaccgcugcucacucuucucucggcaggggucugcugggccggccgggcuggcgggacucagagcugcugcggcagugccguggcucagagcaggugcucugggggcugcccugcuccugggugcaggugcccgcccaugaguggggacacgcagaggagcuggccaagguggugcgcggccgcauccugcaggagcaggcccgccucguguggguggagugcggcagcagcagaggcugccccagcagcagugaggccugaggcucaucugauaccugcaccuucuccccaagccagcguggacccuggugucuauggugaagcugggcccucccacccugagccuuccuagacccuuggacucucagaugcagggcccuuggcucuggccucucacccccaaggcugucucuggcccugccgagccuaugggagucccgggacagagugcccacuccccucuacuugcugcucugggccuccccaccuuuccuggggucuccacauucccacuagugggucuuaugugugucugugucuucuccuuaaacacucgcccuggagucuguucucacaccugugcgcagguuugcacacucaaguucucaugggcaggcucaggucugucccgcugcccugggcacgaggucuccugaggaccugggccuguucugcuccuaggagaccugagcccguuaccgcgugacucccaccauccagcucgcgcuccucguggauucagccaugcauggacugggguguucccuggcccauggucaccugugccccucgugucuccucacaugggugucugugguucucuccuguguaaaugucacgccccaccccuguuucaugugggcacuaacacgugugcguuccuggcgggcacacucaggaccgugccucacagggcccacucccugccuaugccucccucuuggggggccgaggagggcggcugcucugucaugagaauguacggcccguggaugauuaacgggccuuuuucacuuagaagcugcacauuauggagcauuaaacacuuuugucauagaug

SEQ ID NO: 17854 - RNA, 25072 nt, Homo sapiens
gguccaggaaaaacgacguuuuauuuucauaaauacuccugcucucacucacacacugaccccacuucugaccacggacagauggauggacagacguaagacacccauaggaggccccagcagaggccaaugaaugaaggagacacaccgagaacucuaggugccccacagccccucgcuggggccaugggccucuggcauuacccuugagcccccacagucccucagggggcccaauggcaaagggaaacccccaggaguacgggccaggugagguucccccagccuggcccccugaggcugugaccacagggccaauccggaagaaaagcagagucaaaccacacaccagagugcaaauagcuggggguguaggcgucaccccccagucacuggguuccuauggaggaggccuaagcugguccccagcuccagcauggcccccgaguuauggcugggccuucccauaaggcauaagagacagguggggaagaccccaccccagcugggguuggggcugggccugagguccuggcccuuccccaacagcugugcuuccuccccaugacccaaguucuuccaaggcuacacagccccucccucuccaggucccggugauggagaccccagcggcacaaacccaggcccagccuccuacuggguuuggcucagcaggggcggggccggagcaggagggggaagagucacuugaggccuacagggguguggggagaagcaccaggccugggggugaauggccaugggcaacaaaggguguccuuggccaccaaugccucccuccaggcuggacagugaccggucccucugccccuuccucuccccagccccucuguucuagaggcuaccccagguuucagguggggggaacugguccacaucccccaucucguuguaggucuggucacccauggugaaggugagcuuguagcggaggcgaaccuucuccuggggaagagauggcaaaggcagaggggucagaggaggagaaguggccguccccacccugcagcacugccugggggccccuuaccuucuggggguuggcaagcagcaggaccugggugauugcugagggguggacgaugggguuaaaagcuggcagcuccgugcccgaggguggcugcagcuucaccuucauaaccugugggcagauggcaggaugggcacagcuagcccuggcugcuuguccugcucugaggaaccaggcccagccugccagcuccccuccggggauccuggggcucaguccuucuggucccuucuacaccaaccacccagcaagggagggagaccugcccccugacagguggcuccccacccagcuccaugucacccugccuugagaggagggaggcaugcccuguccgacuggcuugucaccuuggggacagcugacuggaacacgauguugcggaugggcuggggggcggugcucagcauggaaaccaccaccaccagcacgucggagcgcccuggcagugggucccgggcaaaauggaagaggaugcggaagccgugcuggucauacacagucacgggcaggauguugccugugggagaaggugggagggcgaugggacagcugagcugcagcacauccgcucagcccccagcccccacccggcuggccucaggagcuggcugcuguacuggcaacaagagcaaaguccuccuuuggggccuuaccuggacccuggguggcagugcaggcaggggcacagagcggugcccagagagggcaggugaacccccagucugauaguggaggcaggacacccaccccagagccgagucacagcccagcuucccccgaugcuguguggcugcugccuggagugcuggggugagggacuuggugagggugagucucacgcugugugaccuugcggcagucacuccccuucucugagcucaggguucuccuacuggugagaggggcagcucugcccacugcugggagacacuguggggguagugucuuuggucacagggagcucauagagggcaaugcugaggaccaccaggccucaugugucugcuuggggcccggggcugggccaugguccccuuacugcuccugggcuggaaaaacccagccuuggaucugggucuuuaucaugguucaguucuguaaucugggggagaccccaaaccucucuguguccugggcccugccuuccuggggauggaaggggcccagagccuacucccuagaggucuucuugcuuauauaagccuggaguuuguacagcaguccucugauugcucuggggcagauaaggaaacugacuccugggaaggggagggccuuguucagagcuccccucugguuggccaguggcagagccaggggagcccugcuuucccacuagcuuccccagacagagcuccugacagggcagcaagcugacccaacccagccugcaccugccccagcccuacucacuggguuugauggacuccaggggcacagugaugcuggccagugagagcucgguugguacgggcugcugcggaggccuggggggcucuggggacacgguguggagaaggcugguggcgcuggagcugggggagcugcagcugcugcucuuauucugcaggucccggagugugagccgggggguuggcugcugcuucucccuuaaucgggggacagugcauuaagaagugauucuuggccagcgugguagcucaccccuguaauuccaacacuuugggaggcugaggcgggcagaucgcuugagcucaggaguuugagaccagccugggcaacauggcgaaacccggucuguauaaaaaauacaaaaaacuagcugggcgugguagcgcacaccuguggucccagcuacucaggagccugacguaggagaaucgcuugaguuugggagauggagguugcagugagccgagaucaugccacuguacuccagccugggugacagggugagacucccucucaaaaaaagaaaaagugauucuuuggugauggagagaucaggggcacaggaaaggcuggcacguguggcuaucucucuggccuugggucuuaccuuuagaaggagcagcucguguucucccuccacccugcaccccaccuauucacuccagcccaguguccuccccucugccggcccucuggaccuuucucaagggagcugggaacaccuggggggaggccaggccagugggcccaggucugccuugggcacuguuguguuuccagaggcaggugcacugcuuggcaucugcugcuuacaaaacaagacagcaacgagccucucccugcugggccuggacaagcccaggagaaguugcugguuugugggaacagggagugcuccccaccccaugccagccauggugggcccucaccaccgcacuugcugggauuccgggggcagcgacugcugcaggagggucuuccccaggaggucuaggucguccagaccgcugcuugcuggcagggaugucugcgcugggggucggcuuuccauacugggggccugggccagagcaggggcugggggcucaguggcauccgacgacuguggggaaaaggaugcaggugggguggggcugucuagagaggugucagcaucaccugauccugcccugaggcucaguguccuccuugcaaaugacaucugggaaagcagccacagagguggggaccccagaccacccauguccaugaugcaggguggcugggucugguuggggguucuacaauccagggaccucugucacccucaagggaaaggaagagggauugcccaucucaaucccaaucccaaaggcugggcugcagccccaaggcugagacuuggggaagauacagcuggagguaaggggaggcccuguacccugggugggugucuccaggccccugggccacccccuggcccugggcucuugaguagagcccauccauccuuuuaguuucuccaggccacuugucccagcugcccugacccugggacugggacaggccagacuaguuugugguccccuccuaccuggaagcuguuccauccgguaccauccaggcuugggccugaaggggguguggggucacugaggccugaggggaaagcaggagagaggugaaggagcugggcugacccugcagaggccagagagccgaggggccaugugugcuggcauggggcucccuaccccuuucugaggcucagcacggaggggagaaacccacauuuucagagggaaccagcagcagagcagaaccaguaaccaagaucccggcaaccccuugugcugaccccacacacgcuuccccucuuccuggccaggccacuccaaagcucugugcacacagacaauagacaucaggacuuucaucuucacucgucaucuggcagcagagagccugcagggcugggcugcagggagaagagguuccuuuccucacgcauccaggcaaggggagagcagcucugugccugccacuggcccacucgagggacgccugcugggugacugugggcuaggcacugugcuggcugagccacaguguccccaagaauacgaggacagggcuggacuggaggcgacgcugaaggcccucuuggcccuggcacaugccagugaggcucacugguacuauggagggcuggggaucccuguggauggcccuagaacuagcugccgaugggaaggaggcagcaggucaccagccagccugaccucugccugcccuggaauacugucagccaaguucaccccaaaucugaccuagagaagauaagggaucuuguuuccaacaaauccugaaaaagugagguccaaaccgaagugcuaccugacaggcaaaggcaaggguaccaggaagcugugacagugggucccuucuagaugcacuucuuagaggccagagauaaagugcacugaugaugcccuagaugcuucaggcccuucagaugcuggucuugcuuaauccucaaacaaccuucaaagguaggggugagcuucucagcccucuuuuagggauaagaaaauggacucaaaguugguaaauaaccugcccgagaacacacagcuagaaaguggcagagucuggacucagacagagcauggccugacugccagcauuugaacacaacucugccacuuggcugugugauauuggggggugacagccucaucuguaaaauggagacaccagccaggugcaguggcuaaugucuguaaucccagcuauuugggaggcugaagcugggguuugagauaagcccuggcagcauagagacucuaccccuaaagaauaaaaggaaaaaaaauuagccaaugccuguggucccaucuacuugggaggcugagaugggaggauuaguugaagccagaaguuugagaccagccugagcaauauagugagacccccaucucaaaaccaaaaagaggugggcgcaguggcucaugccugucaucccagcauuuuaggaagcugggguggguggaucacuugaggccaggaguucaauaccggccuggccaacacaggugaaaccgugugucuacuaaaaauaaacuaauuaaccgggugugguggcacacaccuguagucccaacuacucaggagccugagaugggaggaucacuugagacgggggagguuaaggcugccugaacacccuccuugagggacaggaaccugucucccaccccugccgugaagagugaggaccagcccccuguguggccccagggccuccuccauuccccaggcccaggcugcaggcugcccuggcacuuccggcuccugugcccccaugcuuugccucugagaggaaaacagaaggaagcugguggcucagaacuaugccagugcagugcggggacaggaagugcggcugcaucucgcuucucuuguggagguggugcugcagcugcuggcugggggcugguggcccugcaguacuuccccacccacugccccucagguagcugccacccagggcuggcuccacaggggaagauaaaccuuguaugaacguuccugucccuugaccguccuuuacuucucuguagaaugggguaaagguccucucccugcggucacccuuggcucugaaugaagagggggcggcugcauggggcucguaagcagcuucagggagggugcuggcugcuggguucacaaagggagcucacaacugggccuccuuuccccucagcucuccuuccccuucagcucucccuccacacuccggguccucauuuccuuuuccuugcuuaugaacaacgagucagagcagcccagcugcucagaguguggcuucaggaucagagcccagcucaaguccuagagcccuuucugcacaagucacccagccuuucuuuuuccuuuucuuuuucuuuuuuuugugagacggagccuugcucugucaaccaggcuggagugcaguggugccaucucggcucaccgcaaccucugcuuccccaguucaagcaauuuuccugcaucagccuccccaguagcugggacuacaggcaugugccaccacgcccagcuaauuuuguauuuuuaauagacaugggguuucgccauguuggccaggcuaguuucaaacuccugaccucaaguaaucccucugccuuggccucccaaagugcugggauuccaggcgugagccaccgcgccuuucugugcugccguuuccucauugugcaguggggcuauuaacggcaccugccugcagagaccgugagggucaccuaagacaggacagagugcaguagugggcaccaccaaaggaagcacuccuggaacccaggcagaccccgcccagggcgccccggguccccaucacuucuucaaggccuucgggucugguuuuugcuucagaacuggcucaggaaaccacagucugaaucuuggcuuccaacauaucccugaggauuccuuugauguggcccuaacguaucugcucuucaucccuucaguggcucucaggaggaggcuguucugaucucagcucucggauggggcugcugcccugagagcaguuggaaacccaaaaaugguuugggcagcugggaacgcuuugcugcuuccccccggggaagccuggccccugcugggcucuggagccggagccugcccgggaguaacagcaggccuggcccuggaccagcuuggaucaccgagucccucgcgcucuggccucggcuucucuggagccucugggugcucuggagcccagagcccucccucuccucuugguggaugaagaaacugcugaacuuuugcccagacaguucucaauuccaggcucuaaccuguugcggggaaauccccugguuuccccccaggcugccagagccugaaugcugguuagcuuauccgaggccggcuuagagguugccagccucacccucuggccguguggccucgcacaagcuccuaacuuccccgagccucaguuuccucaguugugaagugggccuaaugcucauccacgugccccacaggauccacaccugggguacgugguuccgcuagcugugagugggcccugggaucaugccccaucugcugcugagcccgcccuccuccaggccuggccccuuccucacccagagacaugagcucgucgucaagcagggaaacugaggcacugggcugcucagggcuggccugcucgccagggcgggugggcauagcuggguagguggugcccgcaggcgggagauccaggccugagagauccagcagggccgaggugcucccuggggugggaaagaagaggcuggcaaguccuggguguacacgugucucucagaguccacagggguugcgggggagcaacaccuaacccccgaugcuuuaccacuggucuccugccuccccuuccuuggccacaccagccccugccuggaaacugcucaacaggaccucucuuuggcauaugaugguacuucuguccggaauguauuuccuucuuagcucuacugggcaaacugcuacccauccuuaaggcccugcugaaacuuggcugcuuccgugcagcgccuccaucuccacuucucccuaacagaaccaauucuaaccccuuuugugaccccccaaggcugccaucuuacccuuauuagaccugagucuguaauguuuacuuuucuaaccccccucgcauuuucugauacauaaagccucuggggugucaucuagcccuauacaacaggugccagauuugucaaaugaaagaaugccuuccuucuucugccuguccucaccaaacccucagcucccccaccagacuucuucccccacagcugcaggcuuggcacagacuucacccccagcucccucccuggggccuuccccaucuuaaggggccagggucacccuggcagucauuccagccgcucugagaccagcacaccacccugcacucucugugccccuccagccugaugggugcccucccagcucuccugccaccuccucaccagggauggagccggcuguggcaucaccguugaccuccucaccccgcaccagcugcuuauacagguugaucaccugggugagguugucauuggccugcaggaucuccgcuggaacaggcaggaggggagaggccaggcugaaggacugugggggccucugggcggcaggggacgaggaccccacauccaucacagccugugugugaggggaagggaaaggggcagggaaacagcccaucucgucugcugagacucuggcccuccgccaccucccuggucucaccucccacccuucccucauucacucccugccauacugccugggcugucucaacacacugggcccgcucccgccuccaggccuccacuccagcucugcucucuggcugccccagaucucugcauggcuucaucccuuacugccuucaggucuucacccaaggcucaccucagggaggccuguccuaaaucccuccugcaccaccucaucccuucccugcuucucuuccuccaugccacucaccaccgugacgaacugucggugcucauggacuugguuauugucugucuccucucacuaaacuaccaugaggaaguuuuugucaaccuuuuuuuuuuuuuuuuaauauaaauauauuugaaauagagacugggucucucuauguuacccaggcuggucuugaacuccuggacuaaagcaauccucccaccuuggccucccaaaaugcugggauuacaggugugaaccacugcacccggcguuuugcaaacuuugaucagugccagaucccugagggccuagaacagugccuggcaccaaucaggcccucggcaacacugccuuccccaggugccaggguguggggcaaucugggcagugagccuuguggguggggcuccugcuuaaugagggaguggaugguacccagaccgcagcccaaguggcccaggcugacacgugggcagagaucaaggaaaagaaccugguauguggcccuggcagaagccgucaggcucaggucuggaacugccugggcugugggaugcacucuuagcuuccauucacccucauuagggaggaaggucugggggcagauggcccuccgucuccccuggcucugccacuguucugcucugugaucugggcaagucauuuuccucccuuagccccaguugugaaaaggggaugggucugccuccugugcagcugcggguaguaaauaagaugccuguuaagggggcuggcccacagggccucucaacaggggggcggccccugcucuguguccucagagaggagaaacccaaggucggugcuggagaagggggcccccuggugguggcuccuuccaacugcagauacuuagcagggccugggggaggugggggcaggagguggagggagagggggggaccugaccucagcaccugcccugggcucaccuaaggccucaucauuguccucugugucacucgccagucggaagagcgugggccgcauccgcucacagcgcugguacaguuccugagggcagcaggaugggcgggucaggguccgcgugggcuguggagugggcagggagugggguaggcagggaggcaggugcaccuucaugagguccucgcugcugccagcugcugcgccgcccuggcuguggcucaucaccaucuccgugagcaguuucacauuguuguucaccuccucgauggcauucacccucuucgagaucuucuccauccgcuucugguccuggggacacauuggccaagggccccugagaaccuuuggccuggacgaggcacugcccccugccacuugagagaaugugugcugggaucuggguugacagcugggugacugugggaucacacucuggguggggcuccagcaggcccugccaggagccccucaugccuaggaagggcacgcugguccaagaagcccccagugcccaggccucugcacaagcucaucaggaucuucagagauggcccaggaaccuggguuuccaaaccccucaccaggugcuucugaaggcccagggcccuagaccuccacugugguucucagugacucuugcccuccuuguguuugcccuuucaaaggagguuccuguacuucauagugcaaggggaccucuguggucaccagguacagccuggaaacgagcaggaagacccuuccagugucugucggugccuggcagaugggggagcccgugccuucaaaggcugcuuuugggagcagcccggcuuuccccugccccuccgcuuacugugcgugccccuccuuugcagagugaaaaguggccucacacaguccucccaccuuggccuccaaagugcugggauuacaggcaugagccaccacauccagcuuugaaacuuuuuuuucagcacuuugggaggccgagaugggagggucauugagcccaggaguuacagacuaguuugggcaacaaagggagaugcugucucuacaaaaaauaaaauuagccgggcgcuguagcgugugccuuuggucccagcuacuugggagguugaggugggaggaucgcuugagcccaggaggucgaggcugcagugagccaugaucgugccacugcacuccaggaugagaucuugucucaauuaaaaaaaaaaaguuucagcaggcacccaggcaacauauguauauuuacuuaaaaauuaaacauuuggccaggcaguggcucaugccuguaaucccagcacuuugggacgccgaggcaggcagauugcuugagcccaggaguuccagaccagccugggcaauguggcgaaaccccuucuccacaaaaaaaauacaaaaacuauaccggugugguggcacacguauuuagugccagcggccugggagguugaggugggaggacugcuugagcccgggagguugaggcugcaaugagccaugaucaugccacuguacuccugcuugggcuagagagugaguccuugucucaaaaaaagucuccucauauacauacacguauacauacuuacauauauucauuaguauuuuuaaauacuaaaaaauaauuuuaaaaauacuuaguauuuuuaaauacuaaaaaguaauuuuaaaaauacuuaguauuuuuaaaaauauacuaaggccuaauucauuucuaacuuuugacgaagagguagccagccucccaaaggcccauccagagcaagucacccaggcugccgggaauucuucccugcacacccuggucccccagcaucagcuucucugcugugccagcccgggucacugcagggcuccuuccaugugaagaugcauacagccccaucucaguggcccagcucaauacccccaucccgccuccucccugugcucugggcucggccgcuaccuccugcaccaucucuuugaugagcuuauuggcugcgcggaggucuucgggaugggagcucuucagcaggcgggccagcaucugcagagacagaggggugugaccgugagggcagcaccugggccaggggucagaagacuggagucacaugauggcuccccgcuuccugccugugggaccugaguaaguuacuuaagcucucugugaaauggugagaauuuacugaugccugauaggguggccacaggccagcggagacacugcauguaaagugcacaccacagcgccuagcagaaauaaguaaucaacaaauggugcuccuuauauccccauggcugagaaccuuucugggacaauguacaagaaccuuaacaguagacacucuccagggcuggggcuaagacuggggagaggggaccuuuuacuuuaaccucuuuauuuuaaucuuaccuccuccugggcuguuuaacuuuucacccacaaguuuuaauuuuauuaacuuuuaacaaaaaauuagugaaauucuuauagaaaaggucaaaauacccucaaacaaacuccagggacaccagacacacuccuguuuauuaaauguggggaugcuguaugggacauacucagcacauauuaaaugcccaguaaacagcgcccaucaucuacaacgaugccugggcucagugugugccucuguuccaacggcugaugccagggcagcuagaggucagaacccacggacccccaccugggcucagaguccccauaugugccuccuuggagucucaccuuggauuucuccucaucuucaaagaucacauucuucggccguggaggaggaaggggaaagguagugucaucuggaagcuuggggucggacuuuacaaucccuggauuagaugagugucagaaaggcugucaauaugucccaggcccagggguaggggugacauggggaugggggcaggcaaggguaggacagaagagggaggucagucuuuugccagcacgcuggcucuggacucuuaguggccugggccuacuccuaccuacuccaucaaaauugccugggggagaugguuuggggacccauauuuugaggccacucccuggagaccacucuuugaggggaagcuugauucgaacucaccuucuuuccacccaagcuagccucaggcagagcacagaaggccgcacuagcuguauguacuuucuccagaaguuaaaggacagacccaugaccuugcuggcucagaagccccugaagccgcuggagccccagcucauggugggggaggggaaggcaggcccuggucgccccccacccucugugugccucacccugcuucuuuagcaucugguaggccucugcgauuuucaccuccucgggcaggcccacuguccagcuguagaggagcuccaagaucuuguucuucaccuucuccgauguccgagagcccagauacuucagggacacaguggggaggccuuugauacugcccagccccacucacuucagucucaagcccuguccacacccuacugccuccccaggacuccccgggaagcccucuagccuacaggguccucauagccccgcccaaccagccugggguagacugaguucaccuacuaccccugccacuuauuagcugggucagcccucagugucuguuuccccaccugcuagauggcaccauggugaggaugcagaacugacaugagggacaggccugcucauagucggcucuggggacuuagccuugacaucccaggaaagaggagccagaggucuccaggcugcccagggaggggugaggguggaacugggaggcccugggccuacucuccgucuccuagcagcaaacugggcuggggaaaguggcucucacagcagaguccccuguugggaggagaaugggaggccauauggauuauucaguagcucuggucaaaggaugggucugagcaaggaagggccaagggggugggcugucacucaaacagcuuaagaaauguucacaguaggccggaggccauggcucacgccuguaaucccagcacuuugggaggccaaugcagguggaucaugaggucaggaguucaagaccagccugaccaauauggugaaacccugucucuacuaaaaauaaaaaauuagccaggcuugguggugggcaccuauaauugcagcuacucuggaggaugaggcaggagaauugcucaaaccugggagguggagggugcagugagcugagaucgcgccauugcacuccagcuugggugacaagagugaaacuccuugucaaaaaaaaaaaaaaaauguucacgguagguaggccgggcaugguggcucacgccuguaaucccggcacuuugggaguccacgacaggcagaucaugaggucaggaguucaagaccagccuggccaacauggugaaaccccaucucuacuaaaaauacaaaaaauuagccgggcaugguggcgugcaccugcaaucccagcuacuugggagguugaggcaggagaauugcuugaacccaggagguggagguuguggagcguagagaucaugccauugcacuccagccugggugacagagcaagacuccaucucaaaaaaauaaagaaaaagaaacguucauggucugugggaagacuccuugggcugagccggggauggcccgucuggagccagcaggcuccaucacucaggucuguggccuuggaugcugagguccagggagguugcucuugugugguggggacagggaaaccugccagagaccagguaggguucuguggccagguccacagggagugauuucaggccagagauggcugacacauacagccaucugucagcuuauguauucccuggaaucauuucuuccuaagcaccgggcagcuccauggcugccccgccccuggccagccuggaaacacuccuccgagaccccaggcugucccagaaucagguaugagaggacugugagaagagaucuguguuuuuccuaggucugaguucuaauggggggcugaggugacaccccagugggaggcucccuggaaaagucgcuccacaaucugaagguccucuuuccucuccccacauccgacagggcaggucugagcuugggcugggggcaccaaccuugggagacacgaccuugaugagcucguugagaaagcggaacuugcccacuucgucguggaaccgcuugccgcagcucuucaugcauguuuccagcaccugugcagggaggggggaugggaggggacgcccaggugcaucagaggccguggccucccucccacgccuuggacaggggccagaagcccaugggugggcuuucagaagggagggaauggccugugagguuggaagauucagagucacacaggccucugggacuggucaucacucccaugggagauagggucaggcgaccuacauacagugcccagcaaugcccaaccuguagcaaugcucuagucccauucauagcuuaggccccacaucugaguaccaacuguacauuauuuucuuacuauuuuuccuuuuuuuuuuuuuuuuugagacagaguuucacucuuguugcccagguuggaaugcaguagcacgaucucggcucacuguaaccucugccuccuggguucaaaugauucuucugccucagccucccaaguagcugggauuacaggcgcccgcccaccacgccucgcuaauuuuuuauuuuuaguagacauggggcuucuccauguuggucaggcugaucuugaacuccugaucucaggugaucugcccgccucagccugccaaagugcugggauuacaggcgugagccaccagcccggccuauuuuuccuuuuuuaaaaaaaccuuauauaggcaacaccuaccuuggccuuauccuaagcuacaucuaugaaaucauaggacuaguuauacuugagaaaaaaauguuaaaacaaauauguaacaauaaugauuauuauuuagagauggggucucacucuguuguccagucuggaguacaguggcacaaucauagcucacuguagccuugaacuccuugccucaagcaagccuccugccuuggccuccccaagugcugaaauuacagguauaagccacugcacccaacuaaacacguaaguauuaaaagagaaacuguaucucuaccaccacuuaaaaucagcuuugcuccaugguggguugguauguggcccaugcugggggccacagacaguacaccccucucuccucugcuauugaacagaugcaaaaccucaggccugagcccaagcaccaccccuuagcuuuacaaacgugcagaucucuggaugcagauacuccaggaguguggccucggcaggucuggguggagcccugauuccauguguugaacacgcuuccuggagaggcagccgaugugcagcugaagcaaagaaccccuggaccagaugacccuagagggccuucccucagcaacaggccuacguguauggaugcuggggugggaggccagcccgcuggcuguggugggacccuuggggcaggcccggaccuccauccugggccaucuuagcacaacucucuugggcucugaagagccuuauggaccccaagaaccucagucuuggccucccuuggugucgucacauggcgggggacggaugguggccucuccccuucucaccgucaaggccuggaucgccucccacuccuguggggacuggaucuugugggccagcagccggguggcgaguggaggccugggugggaggaacaacacagagccagagucgccacggagucccggucacccuagggccacgaccccaggccgcugggacugcagcccuccuccaaggggcccuggucgcccuaggggagggucaccaccccagcccgccgccgagacuucagcccucuaagguuucugcaggcauaugcaaaggcccagcucccucuccagaucaguuauggccugagauuguggcagggcagggccagacagagacugcaggcagggaccuucaaaagguaugagcucagcuccugggcuggccuaagaacucugaugugucacguccuuggcuuggcuugccauagagacaauuacaauaugccaugagagacgggcagacacaguucccugggaacucaagguggcaaaggacguucugcuguggcaaaucagagcagcuucaugguggagguggugacaucaucuaacagacuguaaaagacccgucaccagugacgguaagagcucacaugugcugaacuggucaugugugaggaggcucacaugcacuuuccugccuaagcugcauaaggcaggcagcacggucauucccgccucaccgugggaaguuccuucaacugugaagaaacugacacucagaggcaaccacucacccaagguuacucagcuaagagaggggacaggacucguacccaagcagcacgacuccaaagcacacacaccgcuguuuguggucccgaaacuuuaguaucgccuggggagcccacuaagaauguccacucccagcugggcacgguggcucaugccuguaaucccagcacuuugggaggccgaggcagguggaucaugaggucaggagaucgagaccauccuggcuaacacggugaaacccugucucuacuaaaaaauacaaaaaaauuagccgggugugguggcaggcgccuguagucccagcugcuggggaggcugaggcaggagaaccgcgugaaccugggaggcggagcuugcagugagccgagaucgugccaaugcacuccagccugggcgacagagcgagacuccaucucaaaaaaaaaaauaaaaagaauguccacucccaaccccccacuggacagucgagucugggggcagcccaagaaggugcauuuacuuuauuuauuuuuuugagauggagucucaccgucaccaugcuggagugcaguaaugcaaucuuggcucacugcaaccucagccucccggguucaagcgauucuccugccucagccucccgaguagcugggacuacaggcgcacaccaccgcuccuugcuaauuuuugcauuuuuaguagagaugggguuucaccauguuggccaggauggucucaaucuguuggccucgugauccaccugccucagccucccagagugcugggauuauagacguaagccaccacacccggccuuauuuuuuauuauuuauuuauuuacuuauuuuuugagacggaguuucacuccgucgcccaggcuggagugcaauggcacgaucuuggcucacugcaacuucuaccuccuggguucaagcaauucuccugccucagccucccgaguagcugggauuacaggcaugcaccaccaugcccggcuaauuuuuuuuguauuuuuaguagagaugggauuucucuauguugguaaggcuggucuugaacucccaaccucaggugauccaccugccuuggccucccaaagugcugggauuacaggcgugagccaccaugccuggccuauuuuuuuauuuuuuaagagaugaugucucgcuauguugccccgcuauguugcccaggcuagccucaagggauccucccgccuuggccuccccaguaacugagauuacaggugugcaccaccaugccuggcuaagaauguacauuucugacaagcauucuagguaauucuuuguuuuguuuuucgagacagagucucacucugcugcccaggcugcagggcaguggcgcaaucucggcucauuacaaucucugucucuuggguucaagcaauucuccugccucagccuccugaguagcugggauuacaggcacgugccaccacgcccagcuaauuuuugcauuuuuaguagagacggggugucaccauguuggccacgcuggucucaaacuccugaccucagguaauccacccacuucggccuuccaaagugcugggauuacaggcaugagccacugugccuggccaacauucuaggugauucuaacacagguaguucugguucguccuugagcaaagggccuacuggccuccucccaauuggggaacaugcaguucucccucuggggggccuuuccccacaaagcacuggcugcagguccagcaggccugggucuuaccaagcucaggacuagcauuuucucccugugagaugugggggcagaucugaguccucugagccuugauuucuuuaccuguuaaaugguuccagcaaggcccaccccagagagugacacccaaacagcauucagugccaagugccccauccucaucacuuugugaauacguucagaaugaaaaccgggucuccacccacccaggccauuguacccgagacuggguucuggagagugcagggcagugcaaacaaguggggacggccaccuaccccucaaaguccucguugagcugcucgcagaagccguugaugcuggcccagucgagcuccuuguucaggggguucguggcucuaucuggaagaggagagcuggggucauuguggcccggcagugggauuccugcucuuccacuccugacccuggcaaagguguggucaggagugggagaggagugugacugagcacgugggaaagcucucccccugccuuccugcccagacagccucaagaccugauuguggguguagacagacagaugagcacagcugcccuccaaagggccccacuuuuagagacuauggucagggcccuuccccuccuccccacuccucccaccccugcagcuggacccaucacgccagccccaccuccucugauucugcugagaacagugucuccauaauucucaugaaauuuaugcucagaggagauccagaaguaagggagaaaaaaaucauagucccgcccucaaggagcuguguagccgggaagugggccaagggaagcuagguucucaauaacgugugacagagggaagccaaggagcuguagaaacacagaggaggggccaggcacgguggcucaugccuguaaucccagcacuuugggaggcugagguggguggaucacgaggucaggagaucaagaccauccuagcuaacacgaugaaaccccaucucuacuaaaaauacaaaaauuagccgggcuugguggugggugccuguagucccagcuacuugggaggcugaggcaggagaauggcgugaacccgggaggcggagcuuggagugagccgaggucucgccacugcccuccagccugggugacagagcugggacucugggugacuccgucucaaacaaacaaaaaagaaacacagaggaggggacucaguucaguuuggggcugaggaggcugccuggaagaggcaacacacaagcagggaccaggaggagucacccaggcuggagcugguacaccucugacccacgcauggcuguaugggcaggaaagaugcggguaaccacacgaggcagagaaugaggggccucaguaaggagugugagucuuaccaucacaccagguucagaaagccuucauucccuugggaguggcuccgguguccccuucucuaauccucuacuccugcccaggguagcagugcugggucaguucucuuuugugucccccagccugcuacggcacugcaucccagccacucauguccacaccugucuccccuuggcaaaugaaugagcagucagcugagggcaggcaaagggugagguucuggggaagacugaauccagaaauggauaguggcaaggaaagagggccaacaggucuacaugaagugguguaaacacgaccagacagcuaccccuuuaacccccaauacugguuaaacaacaaucuagcuuacaugcuucccugaaccuccauuuccccaucuuguaaagcuggaaugaaauauggauuuuuuuuuuuuuuugagacgagucucacgcuguugcccaggcuggagugcaguggcacgaucucggcucacugcaagcuccgccucccagguucaugccauucuccuuccucagccucccgaguagcugggacuacaggcacccgccaccacgcccggcuaauuuuuuuuuguauuuuuaguagagacaggguuucaccauguuagccaggauggucucaaucuccugaccuugugauccgcccaccuuggccucccaaagugcugggauuacaggugugagccaccgugcccggcuguauuuuuuuuuuuuuuugagacggagucucgcucuaucgcccaggcuggagugcaguggugugaucucggcugacugcaaacucugccucccagguucacgccauucuccugccucagccucccgaguagcugggacuacaggugcccgccaccacgcccggcuaauuuuuuuuuuuuuuguauuuuuaguagagacgggguuucacuguguuagccaggauggucuugaucuccuaaccucgugauccaccugccucggccucccaaaguacuggaauuacaggugugagccacugcguccggccuguauuuuuuuauuuuuauuuuuuuuugagaaagagucuugcuuuguugcccaggcuggagugcaguggcgagaucucggcucacugcaaucucagcuuccuggguucaaacgauucuccugcuucagccuccugagaguagcugggaucacaggcguccaccaccaugcccagcuaauuuuuuuguauuuuugguagagauggaauuucaccauguuggucaggcuggucucaaacuccugaccucaaaugauccacccaccucggccacccaaagugcugggauuacaggcaugagccacugugccugaccaaaauauugauuuuggaugacaaaauacuuuuugcaugggaaggccauggcggcagccagagcucgaucuucauuucuccacagcccaccucuaaggaccaccccuucccagccaguucugcccacgccugagcaccgagcugaggguguggaaggacacagcccaggagguagaacagagaaggaucuguggacaggaggcuggggacugacccagcauguggcgccugcccugggccauauguuauggcagggggcccaaagcccuggaaucccaguggcuggccgccauucauccaacucagauuuaaguauucugggugcuggggcuccagcagugaacagacaaaaucccugcccuccucaaguucacugcccagcaagagaaacaaugaauacucagauuaacaaaccccguguacugcagacuguugcaaaauguuacagagcaaagcauagcaaggagaagugcagacagccugggaggugggggcugcucucugggagggcuuucggagggcucuggagcccucgggagcugcucucugggagggcucucagagcugagcugagaucggaaggacgaauguucucucuggaucuagaucucugucccaggagcuccacaagacccucuagucccucagaaaaaugaagccccuguugaccuccuggggauaccaggaauaugacccuccccaacccagggguaaggguaacugucuacucugccuccgaguccccaaacaaaggcuggggaacaucagucuaaaguuagagaaucacugcccauucaaugacacccagccagaagacccuaaaacaggaagucccuuaaagugucaaagacacgugaguuggagugaggucagagaagcugauucuggacugcuccugggucagacgccagugaagaggaagcgcuggcaucaugagacaucaucuuucucccccugccucuggcugaaagccagggccuccagauccaaggagaucugacugaccuccuuggcccauggccccugacccucagcccucuuaauucuaccugaggggaguacccucccuagcaggcaguuggggagaacaccuagagagggagggagguguuucacaacaggguaagacuccacccugccacucuauagugcugacaauaacaucauuuaccucacuaggccgggcgcgguggcucacgccuguaaucccaacacuuugagaggccgacgugggcggaugaguggcuaacgccuguaaucccaacacuuugagaggccuauauaggcggaucaccugaggucaggaguucgagaucagccuggccaacauggugaaagcccaccuguacuaaaaauacaaaaauagcugggcgugguggcgcaccuguaauuccagcuacucgggaggcugagacaggagaaucacuugaacccgggagguggagguugcagagagcugagauugugccacugcacuccagccugggugacaagagugaaaacccgucucaaaaaaaaaaagaagaagcuauccuuuaccuccagccuccacaagggaagaggaaagaucuuacaauucugcuaggacacaaagggggaaggaaaggagaaaaucccagccccagugugucagggcccagccaaacccagguaucucuaacuucugccugguuuuagacucucuggacucucagaaaacccccacuguuucuaaaccugagaauguuuuguaugacccacagcucaagaccugugucugagaucaguuagccaggggcccacccauccccccagcccaguugcugcugagacccaggcggacacuuccggcguucacaacggucaagggcugcugagugccccuuuuccacccccugccccucugguggcuaggaugacucugaaacaucccuagagguuugguucuggggccaaccucaugguucaacucugcucaagccuggcuuaaaaggggccggccaugaccccaaaccacgcuagacaguugccggugugcccggguccaagaggguucccugaggcccuggcaacgacggggucccaacagcaguuaaagccuugggagagaacccucacuagaccagggagaagccagccacggcuuucagaggcagaguccaggagcggggcugugagagcaggggaucaucagggcuguggguuaaggagcucagguggaggguuugcgggcuaggaagccuaagcaauaggaagcuacgucugaggagaaacaagaaaaaaagggguguagaagccuuugaaggaaguucagcaagagcugggaaaggcaucuuggagacugagggguuaggcugaagggagugacagggagcuuggaauuauuaauacuucuggagucuaagacucucccaagccuguagggugcggggguuucucacuauguggcuagagacuaggagcggcgggaggaaucaaauggggcaguggguccucccuuccaggacgggguaaugagcaaaugugacuacuugcgggcuccaggaacgccaugcagggccagagaguggaggauucggggccugaaaauaguagggucccucccucccgggugugagaugcaaccccggggaaccgcucgcgugcuccuuccccgggccgcuacuccgugaagcaaugugagccuuggggguuggaggcugcucucuccgucccggggguucccggcgcagcucacucgccgucccaggggucauggcccagggauccgacaggugggcggcgcccgcucccaccgcuggaccgcgccggggccgggguccuccaucgcuccagggucugaggggccgacugaggacaccgccccucccgggccgggggcggggcgugaggagggggcgacccguaccccgcccccgccgggaaggggcccgccucgugcccccgguuccgguuccgguccggcccgcgccccucccggacacucacugauucgcgccuccagagucuccggcuccaucgcgggcuccauccgccaccggcccccagccucggcaccgcccccccgccccccgcagcucucgcgggaccuccugggcaccgcccucugccgauuaaaggggcaacguccgaacgggcgcgcucggcaccauagagaggccaacgagcucgccuagagcgucaccuacucgcccaaccccacccccacgcggcgucuacgucgcagcugggaccggccgccugcuuuuccguucccggcgcucaggcgggagaggaaguggagauacugcaggcuaagggcagcaccauggaaaccccaagggacgcucuaacucguucugcgucacggagaugucugugaccgccuccggaagaauucucugcgggcauguugcug

SEQ ID NO: 17855 - RNA, 1976 nt, Homo sapiens
cacccacccucaauucucugccacagugaucuucccuagagcccaaaucuggccucaguacucacccucccucuagcccuggcuccccagccuccucccauacaacaauguccaagcccugugcccagcccaugaggcccuccaugguccagguccuguuggcuucccagccucauccccguuuuucccccacaugcccggaacacuguucuccagcccuggccuucucauucuggagcuucugcccaugguggaaagccaggcacuucuccgccuacccuucacgacccaccuccuuuacucaugcagccgccagcccaccauagcacuuucucauggcuucccuuacagccaucaucaucuacuucuuuuuauuuuuauuuuuauuuuuuauuuuuuuuaauugagacugaguuucacucuuauugcccaggcuggagugcaauagacugaucucggaucacugcaaccucugccuccuggguucaagcgauucuccugccucagccucaggaguagcagggauuacaggcauaugccaccaugcccagcuaauuuuguauuuuuaguagagaugggguuucuccguguuggucaggcuagucucgaacuccuaaccuuaggugauccgcccgccucggcuuccuaaagagcugggauuaccggcgugagccacugcgcccagcccaucaucuacuucuuaacgugguuguggucagauuccaccccaacuaugcgcuccuugagaguggggacugggagggguucagcuuugaauccucagagcccagggccagguacauaguaggugcucaguaaaauaccugcugaacacucagggaagggagggcugugccgggccucagaggagauguuaagagagcagacaggguggccaggcaugguggcucacaccuguaaucccauuacuuugggaggcugaggcggguggaucaacugaggucaggaguuugagaccagccuggccaacguggugaaaccccgucucuacuaaaaguacauaaauuagccgggugugguggugggggccuguagucccagcuacucgggaggcugaggcaggagaaucaguugaaccugggaggcagagguugcagugagcugagaucacgccacugcacuccagccugggcgacagagcgagacuccaucucaaaaauaaauauauaaauaaauaaaaauaaaaaagagaaaggacagggugcacagagccaggaccccacccccuccuggucuggaccacccugggccaucuccuaagcuugacacucucaggccugaggcugucaggccagggcgcuuugacuauccccugccugccccugaacgcggccaagcccgaggccuuagccaagcccugcagccucaggcuuggcgcccggcccagccuuucuuuagccuucccgaggagccagcgagagagcgcugcagcagccgcaguccuugcuuccggggaaggcccggguggggccagggccugugguuaagucaguggcccucugcagacgcgcacgcagcaggagccacgcccuggucccugcccgggaguggccuggucucccccagcucugauucccugaaggacccugcaccuccucagccaucuucucugggcacccccugagcccagccugcuggccacaggccccuucccgccaacuugugggccuagcucaucaucaaacuauuuuccacuggcuucccccaaucucugccacagcacaauuuugguggggagguggagagggaugaaggagaauaggagguggagcuuggacucuggccgggggcggcggggugagggggggcagcagcucgccacucugauuggucaccucugcuccaaaacuggcuucaaaauuccacggacuccgcccccaguggcccccagcccuauccugacuugcaauuggcugaacuuucagggggcggggcucacccgguccgguccaguu

SEQ ID NO: 17856 - RNA, 4593 nt, Homo sapiens
ugggagcguccgggggcccaucucucucggguggagucuucugacagcuggugcgccugcccgggaacauccuccuggacucaaucauggcuugugugaguguggggacccccccccaagguccaggggauagggcaggaacugauggccagaggagagcugggcagaucgggagcagauucuagccccagcuguguggccuggaaccagugccuucucuuuucuggaccucaguggccacaucuguaaaaugggggugggcgccauggucccucaaggccuucucugcauugauaauugucuggauuccuccagggucugaaagcacaguuauuucugcccaggguugacauucugcagcucucugagaagugagcgugggaaggguguggccaacugggggacacccaggccacuaucccuuucccccuccuccaccccaaagagccuccuguccccuccccccugcagcugucccggucaccaggccagggcagaguuacccucugcuccagagaacgcugaaaaguugccaggacccgagacaagcugcccaggaugggcccuucuaggucggggguggagggugguuguguccaggcugguggcggggggggcgggggaaauucccuuccaccacccccaagcugggagguugggguggcagggaggugagaaucuuccucgggccccagggaaaggguucaaguuucuggcagaagaaaccacucaaaccaguuaacucuugcccacccacucggggugccagggaacagcagugcccagcaguuugcucaaucuuguuaacccugagccagcccagccacagcccgacugcagggcuauucucccuaaugcagagaggccguguuuuucagggucuccucucuagccccugggccucuuugcagagaggggcuugaaggagaauaguggggucgcccgccccuagccacuuccucuccagcagaggggccggccccuccauucagugugacggugggccaagugucggccccuccccagccugauccucuccaucugcgaugggacagagcaccccaucucccaagucacucuugaguccaaaauucccaagccaaucugcaaaaucuucuagagccugucuucuagaaccuucacguuacagacugaagccaaccccggugggaauagggacuuucccaggaccacauagacaaucggaggcuggaaauuacagcucaauccuuuccccaggcuuccccuuggcuuggucagaggaugccgggcgggaacaaccccacucccacccccagccacccccggacacuucgagcaguggaggccuuguccucuaacccggcugggccggggcuugucugugcagggucuggucgccagcaaccugaaucucaaaccuggagagugccuucgagugcgaggcgagguggcuccugacgcuaagaggugagaagugaagucgggguggugggcggcagggacgggcuugguccagcagggagggcguggccggccaagcccacaucuccucccuggccgggagcggguuaacggccagccgccgaugcugcguuuucugggugacucacuucccccgcagggucugggcgcccccaccguugccgcccccucccccgcucccucccugcuguagccucuuaaacuaaaccagcugcagccucgucaucuguaauaccuugacucccccgcccccaccccuuuccggucugggcgggaccugucgcuggggagggcggggagaggaguggggcgggcgucaccgccgccuucccccugagucccuccuuccugcgucuggucauucauucauucacuggcucaguccgguccuucuuccuucacuucucauucacucagacggcugccuuauuuucucggcaguuaggugaccuuggaccagucaaccaaccucaccuagccucaguuuguuagaaaaacaaggggggaggugguuguguggaggaagugagaugcggcuggcgcagugacagugaggaggaugaggaucagcugauauuguuaagagccgcacacuucucaugcacuaauuucauuucaaccaaacccucagaggcagguauugcuauuaucaccacucaacaaauguauuuauuauuuuauuuauuuauuuauuauuuuauuauuuuauuuauuuauuuuuugagacacagucucacccugucgcccaggcuggagugcaauggcgugaucucggcucaccacaaccuccgccucccggguucaaacgauucuccggcuucagccuccugaguagccgggauuacaggggcccaccacaacgcccagcuaauuuauguacuuuuaguagagacgggguuucaccauguuggccaggcuggucucgaacuccugaccucaugaucugcccgcucgccucggccucccaaagugcugggguuacaggcaugagccaccgugcccgggaguauuauuauuauuauuuguuaauucgccccauaauuacuaagcaucuuuuucuggugugccccacuugugcugggcaccgggaauacagagauguacaagacaggacgggaggucaccaucuggagggagucacugaccuugaccaaacgggcuaggaugcuaaugacuucaagaaucaagcgagcccuccugugcagcccccauuguacagaugagcaaacaggggaagaggggcaggagcagguggcauggccagagcuagaauccagguuucuugucucuguuagugaguucuuccagcaaggugcguucaugggauacugagugacagauuagucggucaguggggcuggagcuggccgagguggccucaugcccacccguuaccccccagcuucgugcugaaccugggcaaagacagcaacaaccugugccugcacuucaacccucgcuucaacgcccacggcgacgccaacaccaucgugugcaacagcaaggacggcggggccugggggaccgagcagcgggaggcugucuuucccuuccagccuggaaguguugcagaggugggcugcagaccggaaccggggaccagggacaggggcugggugggcuggggcggggcuggguuagugacuagagaccuuggcccugccugcucuuuccccuccccuucccucccuuccugugugauggccagugucugccccucuuugaaccucagugguugauuacaauaaaacgaaggggaaaaaaaaaggcugggcuugguggcucaugccuguaaucccagcacuuugggaggccgaggcgggcggaucaccugaggucgggaguucgagaccagccugaccaacauggagaaacccugucucgacuaaaaauacaaaaaauuagcuaggcgugauggcgcaugccuguaaucccagcuacucaggaggcugaggcaggagaauugguugaacccgggaggcggagguugcagugagccgagauugcaccacugcacuccagccuggccaacaagagcaaaacucugucucaaaaaaaaaaaaaaaaauuagccagcgugcuggcucaugccuguaauccuggcacuuugggagaccaaaguggguggaucaccugaggucaggaguucgagaccagccugaccaacauggugaaaccccgucucuauauaaauacaaaaauuagcugggcgugguggcacacaacuguaguccuagcuacucaggaggcugagacaggagaaucacuugaaccugggaggcggagguugcagugagccgagauuaugccacuguacuccagccugggcgacagaggagacuccaucucaaaaaaaaaaaaaaaucuaucauaggauuagaguaaaaagaaagaaaaaauauuauaaauguaccuccgcaggcucagccacaaacuggggcugugucagggccacaugaggaacggguucuggaagggcccauggcaugugggcccggcucacugcucuccucuacccccaggugugcaucaccuucgaccaggccaaccugaccgucaagcugccagauggauacgaauucaaguuccccaaccgccucaaccuggaggccaucaacuacauggcagcugacggugacuucaagaucaaauguguggccuuugacugaaaucagccagcccauggcccccaauaaaggcagcugccucugcucccucugaaccagccucgugugugugcuugugcguguguguguaugugugugcauguguuugugugugugagaggggucccccaccuccaggccugcccccuuccuucacuuccauucgcuuuguccacggguaccuccucaguuccaaugacgucuuccgcugggucccccagacaaagcacacagaguuuggcacauaguaggagggucagugaccacugaauaaaagucagucccugcccugaaacuguuuuuagccuagugggcccuagcacacagcagaugcucaaaggauguugcauaaaugacaucaagggggaaagaggcaaggacagaccaauucguguguagugacggggcagaagacagggagguggagggaagaauacgagaccccucucauuugccuucauga

SEQ ID NO: 17857 - RNA, 4593 nt, Homo sapiens
ucaugaaggcaaaugagaggggucucguauucuucccuccaccucccugucuucugccccgucacuacacacgaauuggucuguccuugccucuuucccccuugaugucauuuaugcaacauccuuugagcaucugcugugugcuagggcccacuaggcuaaaaacaguuucagggcagggacugacuuuuauucaguggucacugacccuccuacuaugugccaaacucugugugcuuugucugggggacccagcggaagacgucauuggaacugaggagguacccguggacaaagcgaauggaagugaaggaagggggcaggccuggaggugggggaccccucucacacacacaaacacaugcacacacauacacacacacgcacaagcacacacacgaggcugguucagagggagcagaggcagcugccuuuauugggggccaugggcuggcugauuucagucaaaggccacacauuugaucuugaagucaccgucagcugccauguaguugauggccuccagguugaggcgguuggggaacuugaauucguauccaucuggcagcuugacggucagguuggccuggucgaaggugaugcacaccuggggguagaggagagcagugagccgggcccacaugccaugggcccuuccagaacccguuccucauguggcccugacacagccccaguuuguggcugagccugcggagguacauuuauaauauuuuuucuuucuuuuuacucuaauccuaugauagauuuuuuuuuuuuuuugagauggagucuccucugucgcccaggcuggaguacaguggcauaaucucggcucacugcaaccuccgccucccagguucaagugauucuccugucucagccuccugaguagcuaggacuacaguugugugccaccacgcccagcuaauuuuuguauuuauauagagacgggguuucaccauguuggucaggcuggucucgaacuccugaccucaggugauccacccacuuuggucucccaaagugccaggauuacaggcaugagccagcacgcuggcuaauuuuuuuuuuuuuuuuugagacagaguuuugcucuuguuggccaggcuggagugcaguggugcaaucucggcucacugcaaccuccgccucccggguucaaccaauucuccugccucagccuccugaguagcugggauuacaggcaugcgccaucacgccuagcuaauuuuuuguauuuuuagucgagacaggguuucuccauguuggucaggcuggucucgaacucccgaccucaggugauccgcccgccucggccucccaaagugcugggauuacaggcaugagccaccaagcccagccuuuuuuuuuccccuucguuuuauuguaaucaaccacugagguucaaagaggggcagacacuggccaucacacaggaagggagggaaggggaggggaaagagcaggcagggccaaggucucuagucacuaacccagccccgccccagcccacccagccccugucccugguccccgguuccggucugcagcccaccucugcaacacuuccaggcuggaagggaaagacagccucccgcugcucggucccccaggccccgccguccuugcuguugcacacgaugguguuggcgucgccgugggcguugaagcgaggguugaagugcaggcacagguuguugcugucuuugcccagguucagcacgaagcugggggguaacgggugggcaugaggccaccucggccagcuccagccccacugaccgacuaaucugucacucaguaucccaugaacgcaccuugcuggaagaacucacuaacagagacaagaaaccuggauucuagcucuggccaugccaccugcuccugccccucuuccccuguuugcucaucuguacaaugggggcugcacaggagggcucgcuugauucuugaagucauuagcauccuagcccguuuggucaaggucagugacucccuccagauggugaccucccguccugucuuguacaucucuguauucccggugcccagcacaaguggggcacaccagaaaaagaugcuuaguaauuauggggcgaauuaacaaauaauaauaauaauacucccgggcacgguggcucaugccuguaaccccagcacuuugggaggccgaggcgagcgggcagaucaugaggucaggaguucgagaccagccuggccaacauggugaaaccccgucucuacuaaaaguacauaaauuagcugggcguuguggugggccccuguaaucccggcuacucaggaggcugaagccggagaaucguuugaacccgggaggcggagguuguggugagccgagaucacgccauugcacuccagccugggcgacagggugagacugugucucaaaaaauaaauaaauaaaauaauaaaauaauaaauaaauaaauaaaauaauaaauacauuuguugaguggugauaauagcaauaccugccucugaggguuugguugaaaugaaauuagugcaugagaagugugcggcucuuaacaauaucagcugauccucauccuccucacugucacugcgccagccgcaucucacuuccuccacacaaccaccuccccccuuguuuuucuaacaaacugaggcuaggugagguugguugacugguccaaggucaccuaacugccgagaaaauaaggcagccgucugagugaaugagaagugaaggaagaaggaccggacugagccagugaaugaaugaaugaccagacgcaggaaggagggacucagggggaaggcggcggugacgcccgccccacuccucuccccgcccuccccagcgacaggucccgcccagaccggaaaggggugggggcgggggagucaagguauuacagaugacgaggcugcagcugguuuaguuuaagaggcuacagcagggagggagcgggggagggggcggcaacggugggggcgcccagacccugcgggggaagugagucacccagaaaacgcagcaucggcggcuggccguuaacccgcucccggccagggaggagaugugggcuuggccggccacgcccucccugcuggaccaagcccgucccugccgcccaccaccccgacuucacuucucaccucuuagcgucaggagccaccucgccucgcacucgaaggcacucuccagguuugagauucagguugcuggcgaccagacccugcacagacaagccccggcccagccggguuagaggacaaggccuccacugcucgaaguguccggggguggcugggggugggagugggguuguucccgcccggcauccucugaccaagccaaggggaagccuggggaaaggauugagcuguaauuuccagccuccgauugucuaugugguccugggaaagucccuauucccaccgggguuggcuucagucuguaacgugaagguucuagaagacaggcucuagaagauuuugcagauuggcuugggaauuuuggacucaagagugacuugggagauggggugcucugucccaucgcagauggagaggaucaggcuggggaggggccgacacuuggcccaccgucacacugaauggaggggccggccccucugcuggagaggaaguggcuaggggcgggcgaccccacuauucuccuucaagccccucucugcaaagaggcccaggggcuagagaggagacccugaaaaacacggccucucugcauuagggagaauagcccugcagucgggcuguggcugggcuggcucaggguuaacaagauugagcaaacugcugggcacugcuguucccuggcaccccgagugggugggcaagaguuaacugguuugagugguuucuucugccagaaacuugaacccuuucccuggggcccgaggaagauucucaccucccugccaccccaaccucccagcuugggggugguggaagggaauuucccccgccccccccgccaccagccuggacacaaccacccuccacccccgaccuagaagggcccauccugggcagcuugucucggguccuggcaacuuuucagcguucucuggagcagaggguaacucugcccuggccuggugaccgggacagcugcaggggggaggggacaggaggcucuuugggguggaggagggggaaagggauaguggccugggugucccccaguuggccacacccuucccacgcucacuucucagagagcugcagaaugucaacccugggcagaaauaacugugcuuucagacccuggaggaauccagacaauuaucaaugcagagaaggccuugagggaccauggcgcccacccccauuuuacagauguggccacugagguccagaaaagagaaggcacugguuccaggccacacagcuggggcuagaaucugcucccgaucugcccagcucuccucuggccaucaguuccugcccuauccccuggaccuuggggggggguccccacacucacacaagccaugauugaguccaggaggauguucccgggcaggcgcaccagcugucagaagacuccacccgagagagaugggcccccggacgcuccca

SEQ ID NO: 17858 - RNA, 2324 nt, Homo sapiens
cagucuggagugcggcucccggggaugcgagcgaggagucgcugcuuuuccuccccggcucgggugucgggagagcucgccgagccggcuuugcgaggcccagccccgccggucugucgcuuggucucggcaccgggcucgggcucugccucugccucugccucugccuccgccuccucugccucccuuuucccagcuccgcgucuggcgcuugggcggcgcauccggguauuuagcggcggcgggcggaccgcggugaggacagggcugcuggcugccugcucccggcccggaauggcgcugcgccgccgccaucuguguuucuuccgccgagcaaauccgaccuuuccccccggcccgggccuuccugcuccccgccgccgcccugggccgcugccuggcucccugggcuuccccgccgggcggcccgcuggcccggccgccgccccccgcgcccgccacgcaccccaaacggcgccgaggaccgcuggugugccggcacauuuccccuuugcggggggcuggcucugcggggcuagggagccucggugcgggaaaccccccguagcaaagcucuccccugaggcuaccgggggcucugcucccggcccgcugcgggguccccuagcccgguggagcugccggaaagcggccccaacuaacacacgcggccccgagcugggcgacucccagccgggccgagccgggacaggggggaggggucgcucccccgggguccggucaccucucgggggucaccccgccaccggucccuccacaccucuacccccucuguccauggggcccccaaggaaacuuucccugaaagaguuggaaggguacuuucaaacuuugucccuucccccuccucugccgucucucccccagcgcgccccccgaccucugccuugagguucccuccugaggccgaacccccagugcugcccggacccucugagagaugaggagggccucccggguggccucuucuccucaaagaccccuacaucucccauauacccuaaucgggaauucauuugugugcuucucuuagccuggaaguuuuggggugucagagacagaacucgcugccccccauccgugaggcccagccuggggguucaguccccgucccaaggcuccuugaaggcaaugugggggcgggggagggcgguccacaauggagaagcugccccagaagcucuaaccagggacgguccggggggccccuguaaugaggagaggcccugagugcuuuggggacuugggaaagcggggcgcuaggguagaggucgaggaggggguuaugucccuuggguugugaccuguccucggaaaguguggaguuguuuagagagccguggccgcgaccaccgccauuuugcugggaagaugcgaugucuuuguuaaaaugcacacagauuuucccgugcugcuuggcagguguagacgaggcggacacggggcgccacugucuguagggaguucugaagcucgaggggcuuuaggggcccagaggccagcaggagagaccucagagacccuaggaccccuugucugcggccgaccuccuacucacgugccggguccgcuuggcagcggcccugggcugagauucugcgacguuugcucccugggccccucucccacaaccccgcuuuuauucccuaagcauagaggccggucacuguucacuuaaacaauacccugggagugggaguuuguugcuggucaaaaugaugaacgcaucccgguaugguccaagagcuguuugcagacacagugggcuacuggggagggguaaaggggagggguucgaggguuuugauguuggggacgggaucguagcugcgugggugugggagggcuccuacuggaccugggagucucugaagccaggacaaauuaauggguuucccccgcacgccaagggauggauuaauccaaaugauuaggggaggaagggggagggggagcgcaagacucggugucagaugccuucucucugggcuuaucuccguggcacaggcggggaagggaagcaauggggggucagguuaguucaaaaggucaagguucgucuuuugauggugucaauuucucuuaaguuucgucauuugaaaacacaacauucugguggcuuuguuuugguuauuuucaaagacaacucggguucccauuaagaccugguuggguuaauacgcacccaaauagcccccccuccccguauccgagauguuccacccugagagcccagaaccaugucaccccaucccccgccccagauccgugcaugucuuaaagacuggaugaauccaaugaca

SEQ ID NO: 17859 - RNA, 2443 nt, Homo sapiens
cggcggccgggccagcgggccgcccggcggggaagcccagggagccaggcagcggcccagggcggcggcggggagcaggaaggcccgggccggggggaaaggucggauuugcucggcggaagaaacacagauggcggcggcgcagcgccauuccgggccgggagcaggcagccagcagcccuguccucaccgcgguccgcccgccgccgcuaaauacccggaugcgccgcccaagcgccagacgcggagcugggaaaagggaggcagaggaggcggaggcagaggcagaggcagaggcagagcccgagcccggugccgagaccaagcgacagaccggcggggcugggccucgcaaagccggcucggcgagcucucccgacacccgagccggggaggaaaagcagcgacuccucgcucgcauccccgggagccgcacuccagacuggcccgguagucaggggcucaggagcagaucccgaggcaggcuuugcucagccuccgacgagggcuggcccuuuggaaggcgccuucaacagccggaccagacaggccaccaugaccgagaauuccacguccgccccugcggccaagcccaagcgggccaaggccuccaagaaguccacagaccaccccaaguauucagacaugaucguggcugccauccaggccgagaagaaccgcgcuggcuccucgcgccaguccauucagaaguauaucaagagccacuacaaggugggugagaacgcugacucgcagaucaaguuguccaucaagcgccuggucaccaccgguguccucaagcagaccaaaggggugggggccucgggguccuuccggcuagccaagagcgacgaacccaagaagucaguggccuucaagaagaccaagaaggaaaucaagaagguagccacgccaaagaaggcauccaagcccaagaaggcugccuccaaagccccaaccaagaaacccaaagccaccccggucaagaaggccaagaagaagcuggcugccacgcccaagaaagccaaaaaacccaagacugucaaagccaagccggucaaggcauccaagcccaaaaaggccaaaccagugaaacccaaagcaaaguccagugccaagagggccggcaagaagaagugacaaugaagucuuuucuugcggacacucccuccugucuccuauuuucuguaaauaauuuucuccuuuuuucucucuugaugcucaccaccaccuuuugcccccuucuguucugacuuuauaagagacaggauuuggauucuucagaaauuacagaauaauucauuuuuccuuaaccaguugugcaaggacagcaacaaccaaucuaaugaugagaauguacuuauauuuuguuuugcuauuaaccuacuuacgggguuagggauuugcggggggggcuuguguguuuuguuggcuuguuugccaugaagguagauguggguggggagaagacacaaggcaguuuguucuggcuagaugagagggaacccaggaauugugagguuagcaggaauaucuuuagggugagugaguuuucuuugaguugggcacccguugugagaguuucagaaccuuuggccagcaggagagaggugguagggagcagccagccggcaaaggaaggagggggaaaaaaaccgccaccgggcugacuuccaccucccaguggugagcagugggggcccaaacccaguuuccuucucauuuuuguuaguuugcgcuuucggccucccuauuuucuuagggaaggggagugggguccaagugacagcuggaugggagaagccauaguuucucccagucagcuaggauguagccauugggggaucuuuguggcuucagcaaauucucuuguuaaaccggagugaaaacuucaggggaaggguggggagucagccaagugccucagugugcccuguugaaacuuagguuuuuccacgcaaucgauggauuguguccuaggaagacuuuucuuuuccucuggauuuuuguuccuccuguacaagaggugucuuugcuugguuugguggggcugcggccacuuaaaaccucccgaucucuuuuugaguccuuuauuauaaguaguuguagcugcgggagggggagggggagugggcgggcaguggauaguaagacuuacugcagucgauuugggauuugcuaaguaguuuuacagagcuagaucugugugcauguguguguuuguguauauauacauaucuagggcuaguacuuaguuucacacccgggagcugggagaaaaaaccuguacaguugucuuucucuuauuuuuaauaaaauagaaaaaucgcgcacuugcgcgucccccccccacccccuuuuuuaaacaaguguuacuugugccgggaaaauuuugcugucuuuguaauuuuaaaacuuuaaaauaaauuggaaaagggagaaa

SEQ ID NO: 17860 - RNA, 2443 nt, Homo sapiens
uuucucccuuuuccaauuuauuuuaaaguuuuaaaauuacaaagacagcaaaauuuucccggcacaaguaacacuuguuuaaaaaagggggugggggggggacgcgcaagugcgcgauuuuucuauuuuauuaaaaauaagagaaagacaacuguacagguuuuuucucccagcucccgggugugaaacuaaguacuagcccuagauauguauauauacacaaacacacacaugcacacagaucuagcucuguaaaacuacuuagcaaaucccaaaucgacugcaguaagucuuacuauccacugcccgcccacucccccucccccucccgcagcuacaacuacuuauaauaaaggacucaaaaagagaucgggagguuuuaaguggccgcagccccaccaaaccaagcaaagacaccucuuguacaggaggaacaaaaauccagaggaaaagaaaagucuuccuaggacacaauccaucgauugcguggaaaaaccuaaguuucaacagggcacacugaggcacuuggcugacuccccacccuuccccugaaguuuucacuccgguuuaacaagagaauuugcugaagccacaaagaucccccaauggcuacauccuagcugacugggagaaacuauggcuucucccauccagcugucacuuggaccccacuccccuucccuaagaaaauagggaggccgaaagcgcaaacuaacaaaaaugagaaggaaacuggguuugggcccccacugcucaccacugggagguggaagucagcccgguggcgguuuuuuucccccuccuuccuuugccggcuggcugcucccuaccaccucucuccugcuggccaaagguucugaaacucucacaacgggugcccaacucaaagaaaacucacucacccuaaagauauuccugcuaaccucacaauuccuggguucccucucaucuagccagaacaaacugccuugugucuucuccccacccacaucuaccuucauggcaaacaagccaacaaaacacacaagccccccccgcaaaucccuaaccccguaaguagguuaauagcaaaacaaaauauaaguacauucucaucauuagauugguuguugcuguccuugcacaacugguuaaggaaaaaugaauuauucuguaauuucugaagaauccaaauccugucucuuauaaagucagaacagaagggggcaaaaggugguggugagcaucaagagagaaaaaaggagaaaauuauuuacagaaaauaggagacaggagggaguguccgcaagaaaagacuucauugucacuucuucuugccggcccucuuggcacuggacuuugcuuuggguuucacugguuuggccuuuuugggcuuggaugccuugaccggcuuggcuuugacagucuuggguuuuuuggcuuucuugggcguggcagccagcuucuucuuggccuucuugaccgggguggcuuuggguuucuugguuggggcuuuggaggcagccuucuugggcuuggaugccuucuuuggcguggcuaccuucuugauuuccuucuuggucuucuugaaggccacugacuucuuggguucgucgcucuuggcuagccggaaggaccccgaggcccccaccccuuuggucugcuugaggacaccgguggugaccaggcgcuugauggacaacuugaucugcgagucagcguucucacccaccuuguaguggcucuugauauacuucugaauggacuggcgcgaggagccagcgcgguucuucucggccuggauggcagccacgaucaugucugaauacuugggguggucuguggacuucuuggaggccuuggcccgcuugggcuuggccgcaggggcggacguggaauucucggucaugguggccugucugguccggcuguugaaggcgccuuccaaagggccagcccucgucggaggcugagcaaagccugccucgggaucugcuccugagccccugacuaccgggccagucuggagugcggcucccggggaugcgagcgaggagucgcugcuuuuccuccccggcucgggugucgggagagcucgccgagccggcuuugcgaggcccagccccgccggucugucgcuuggucucggcaccgggcucgggcucugccucugccucugccucugccuccgccuccucugccucccuuuucccagcuccgcgucuggcgcuugggcggcgcauccggguauuuagcggcggcgggcggaccgcggugaggacagggcugcuggcugccugcucccggcccggaauggcgcugcgccgccgccaucuguguuucuuccgccgagcaaauccgaccuuuccccccggcccgggccuuccugcuccccgccgccgcccugggccgcugccuggcucccugggcuuccccgccgggcggcccgcuggcccggccgccg

SEQ ID NO: 17861 - RNA, 999 nt, Homo sapiens
uguguuuuguuggcuuguuugccaugaagguagauguggguggggagaagacacaaggcaguuuguucuggcuagaugagagggaacccaggaauugugagguuagcaggaauaucuuuagggugagugaguuuucuuugaguugggcacccguugugagaguuucagaaccuuuggccagcaggagagaggugguagggagcagccagccggcaaaggaaggagggggaaaaaaaccgccaccgggcugacuuccaccucccaguggugagcagugggggcccaaacccaguuuccuucucauuuuuguuaguuugcgcuuucggccucccuauuuucuuagggaaggggagugggguccaagugacagcuggaugggagaagccauaguuucucccagucagcuaggauguagccauugggggaucuuuguggcuucagcaaauucucuuguuaaaccggagugaaaacuucaggggaaggguggggagucagccaagugccucagugugcccuguugaaacuuagguuuuuccacgcaaucgauggauuguguccuaggaagacuuuucuuuuccucuggauuuuuguuccuccuguacaagaggugucuuugcuugguuugguggggcugcggccacuuaaaaccucccgaucucuuuuugaguccuuuauuauaaguaguuguagcugcgggagggggagggggagugggcgggcaguggauaguaagacuuacugcagucgauuugggauuugcuaaguaguuuuacagagcuagaucugugugcauguguguguuuguguauauauacauaucuagggcuaguacuuaguuucacacccgggagcugggagaaaaaaccuguacaguugucuuucucuuauuuuuaauaaaauagaaaaaucgcgcacuugcgcgucccccccccacccccuuuuuuaaacaaguguuacuugugccgggaaaauuuugcugucuuuguaauuuuaaaacuu

SEQ ID NO: 17862 - RNA, 17700 nt, Homo sapiens
cggccacgcgaccaggcugcguccgcgaugcgcacggcucccaggcaggcaggcgcgcucgggcgagguaggagcgauguggccugggaacgccuggcgcgccgcacucuucugggugccccgcggccgccgcgcacagucagcgcuggcccagcugcguggcauucuggagggggagcuggaaggcauccgcggagcuggcacuuggaagagugagcgggucaucacgucccgucaggggccgcacauccgcguggacggcgucuccggagguaacgcuccguuccgggagucguuccaagaccuuucccgagcuugcgcuggaauggagguccuggaggugggggugggcggcuccuacacucuuagcuacuguuccccuucgcaucucucagggcgacuuuauggcuuccuaauauugacucuugccugguuaaacccuuuugacggagggaggcgauuugcccagcaagaaaacccgcauuucuugagcggcuccuuugugaaggucucuaccaauuguugcugcacgugaacuccugcuaacuucuagacgcaggaaugacuaauuccacuuuacaaacgaagaggcugaaauccacagaugugaaauggcuugcccaaaagcccccagcuagcugcaggcagcgcuggaauauuggagcuggaacauugccugacuggccagagaggacagcuugcuggguaaacucauagcaagcaaggggucccagggcugccacagaaaucacaugaugaguuggcccugccaggucucccucauuucuuucuuuccuuuuuuuuuucugagauggagucucgucuugcucugucgcccaggcuggagugcaguggcgagaucucgguucacugcaaccucugccucccggguucaagcgauuuucaugccucagccucccaaguagcugggacuacaggcacgugccagcacacccggcuaauuuuuguauuuuuaguggagacuggguuucaccauguuggccaggcuggucucgaacuccugaccucaagugauccucccgccucagccucccaaaguguugggauuacaggcgugagccaccacucccagcccucccucauuucacucuaaccagugguuacaccugacuuauucgugucaggccucaggugagugguaaucaucaacaagcucccaaagcugccuucugcccaggaaauaggcauagaacccuuggugcuguugcacucauuuguaaaacagaggucccagguaaucccuucucucccucaggggaagcuuagagccggucaaaagaugggaaauuaggagacccaaguucucauccuguuuuugccuuucccaggcugugugaacuuuccccucuggcuguuugcuccuaaggucagcuguguucacucugggcuuuagaauucggggacugguaucucaggcaccuaccuuugggggugugauucuggcagcaaaguaaacuguggaguuccaggacugcagcaggcgucugauccagcccucuucuuuaacccucaaggaaaccaaggggucagauaaggagucagugguggucuucaggcacaggagaagccugugaggaagggcugaguuccuccuuggguagaaugugauucaaagccagaguuuaggcugggcacaguggcuugugccugaaaucguagcacuuugggaggccaaggcaggaggauugcuugaggcuaggaguucgagaccagcacggacaacauaaugagaccccaucucuacaaaaaauaaaaaaauuuaaucgggcaugguggcacgcaccuguagucccagcuacucaggagguuaagugggaggauugcuugagccugggagguuggggcuacagugaaccaugauugcaccacuguacuccaaccugggcgacagagcuagacccugucucaaaaaaaaaaaaguuuaaacuucuugcucuucaagauguguagcacugacgcuccuucuguagcuguugaauuuggugccuccucaauggugacuccaggucuguuuccuuucuggaccauuuccccagggccuggcacugucaucuuuccaggccugcccuugccccaccugagcugcuguauccaucuccucuccuucaccucaggaauccuuaacuucugugccaacaacuaccugggccugagcagccacccugaggugauccaggcaggucugcaggcucuggaggaguuuggagcuggccucagcucuguccgcuuuaucuguggaacccagguacacagugaguggugggggguuguggggacugaccccagcugccugcuucccacagucagcaaggcugguuuagccagcucagcucagccacagcccugggccuacuguuggccucagagcugugcagcagaaaggcugagugcaggccucuguuuugcugaaaagcuuuggccaaggaacuuuauauauauauuuuuucuuuuugagacagagucuugcucugucacccaggcuggagugcaguggcacaaucuuggcucccuguaaccuucgccuaccagacucaagggauucuccaugccucagccuccugaguagcugcgauuacaggcaugcuaccacacccagcuaauuuuuuuuuuuuuuuuuuuuuugagauggagucucgcucugucgcugaggcuggagugcgguggcaugaucuuggcuacugcaagcugcgccucccagguucacgccauucuccugccucaaccucccgaguagcugggacuacaggcgccuaccaccacucccggcuaauuuuuuguauuuuuaguagagacgggguuucacuguguuagccaggauggucucgaucuccugaccucgugauccacccaccuuggccucccaaagugcugggauuacaggcgugagccaccgcacucggccuaauuuuuauauguuuaguagagaugggguuucaccauguuggccaggcuggucuugaacuccuggccucaagugaucuccuccaccuuggccuuccaaaguggaaacugccuuuuugagcauucauuuucccaccugcaaaacagagucccucacaccugaccuucuauaagaaaagaggaguaggcggcaggaacugagacuaagggcucuggggcuguucugacgggagcacaguugccagugcugcccuuuagugucccuguuccugugggcaaguaucuuaacuuuucucugucucaauuacuucauagggaaaaugaagauaauagcacuuaauaggaucauuacaaauuaaagacuuaauacauguaaugcuuagaauaggccgggcgcaguggcucaugccuguaaucccagcacuuugggaggcugaugcaggcggaucaccugaggucaggaguucaagaccagccuggccaacauggcgaaacccuuucucuacaaaaauauaaaaauuagcuggcaugauggugggugccuguaaucgcagccacuugggaggcugaggcaggagaaucgcuugaaccuaggagguggagguugcagugagcugagaucacgccacugcacuccagccugagcaacagagugagacucugucucaaaaaaaaaaaaaaaaaaaaaaagcauagaacagccuggcacauaguacugcucaaugaauguuggcuauuauuuauuuuccaaauguuacaaaauaaauuuauauaaguaugaaacuuaaauaguacuuauuaugugccaggaauucuuuuaagaaaauuacaacuauuggccaggcgugguggcuuaugccuguaauccaggcacuuugggaggccgagguggguggauuacugaguucaagaccagccuggccaacauggugaaacccugucugugcuaaaaauacaaaaauuagcuggccgggcucgcuugaacccaugaggcagggguugcagugagccacgacggugcgaccacacuccagccugggugacagagggaaacucugucucaaaaaaaaaaaaaaaagaacauuacaaguauuaacucauuaauccuaagugauaguugcuauucuuauucccgcuauugagaugaggacacugagauccagagagguuaagugacuugcccagaggcacacagccuguugugggauuugaacccuggcucaagaguccaugcuggcugggcaugguaguucacaccuguaaucccaauacuuuuggagcccaaagcagaaggaucacuugaugccuggaguuugagaccagccugggcaacauagcaagacccucucucuaaaaaaaaaaaaauguuuuuaauuagcugggugugguggugcgcaccuguagucccagcuacuagggaggggaggcugaguugggaggaucacuugagcccaggaguucaaggcuacaguaagcuauggucucacuacugcacuccagccugagugacagagaaucccugucucauuugccaaaaaaaagaaagagucugugcuccugacuacuugugauuaucauuaacugcccucucagaaaggugagagugaaaugaaugucagaggcagaacuccugacucgcauccagucacuucccagcaaagcccucacccagacccaacaguuuucaaauuuacaaauuagaggcccaggugaacccagaauuaccucugugaucuuuuucuucaccauuaggcgaccaaaaaagacacucaguaugguguuaggaagacacaucuuucuucuccacgagugcccguaauuccaccauuagacugccacuguaaaaccaaagucugcccagggagggaaccuaacagguccccaguuccucagugggaacugucugucagauuccuggcagcucugggauagcccauguguggcagaaaguaaggagacugaggcugcaggcuuucuggguugggucucugugguccuccaagccucuguccccucgaacuugucccacaugaccccacaggcaucaacacgugucucacucauuuucuucagagcauccacaagaaucuagaagcaaaaauagcccgcuuccaccagcgggaggaugccauccucuaucccagcuguuaugacgccaacgccggccucuuugagguguguggaagcuguccugcgggugaggguugguggggccuguuaggcugaggaaggcuugggugugggcagucgggagaaccuagcaggauucagugccaugccuagaggcuccagagcccgcuucuggaggucaagguugggccagguaggugcuccaggaggaauccuggggcuugcagggagccugaguuccagagccuuugggggauaagcuacaucagcuggaaggcugggggaggcgggggccugguacucaccaaauauauucucaccuccucuuacuagagcagggcgcugguccagcccggcacugagacacgggggccccagagagaagcacagaacaccuugccucucuacccagaggagcgcccuggcuggcaguacaguuuuuugauuugcuggagucccggucaagggagaagcccagggugguuaaaugauggcucuacgcucacugccucccuccaggcccugcugaccccagaggacgcaguccugucggacgagcugaaccaugccuccaucaucgacggcauccggcugugcaaggcccacaaguaccgcuaucgccaccuggacauggccgaccuagaagccaagcugcaggaggcccagguggggcgacgccuggguccacccucagccuccgccuggggaaggaagugaggcuuagagaggccaacuccucacucacagagauagccugaaaguuugaaacagcagagauuuguccaagaugugaacccagaucccucacacccagagcauuauucuuuuuuuuuuuucccugagacagaguuucacucugucgccaaggcuggaguauaguggugugaucucggcucacugcaaccuccaccuccuggguucaagugauucuccugccucagccucccaaguagcugggauuacaggcauccgccaccccaccuggcuaauuuuuguauuuuuaguaaagacgggguuucaucauguuguccaggcuggucucgaacuccugaccucaguugauuucacccaccuaggccucccaaagugcugggauuauagacgugagccacugugccuggcaccagagcauuauuccauugugccauggugccuugagguuuuucccuguguaugugugacagucucacucuguugcccaggcuguauugcaauggugcagucauagcucacugcagccucaaucuucuggacucgagcgauccucccaccucagucuccugaguagcugggacuaccggugcccaccacacccaguuuuuuauuuauuuguuuuuuagauggaauuucacucuuuuugcccaggcuggagugcaauggcgugaucucagcucacugaaaccucugccucccagguucaauugauucuccugccucagccucuggaguagcugggauuacaggcacacaccaccgugcucagcuaauuuucuauuuuuaguagagaugggguuuagccauguuggccaggcugguuucgaacuccugaccucaggugaucuaccugucucagccucccaaaguguugggauuacaggcaugagccaccgcacccagccuguuuguuuguuuuugagacagggucucacuauaaugcucaggcuagucuugaacuccugggcucccaaaguuacaggcaugagccaccauacccagccaguuuuuaaaauuuuuaguagagacagggucucacuauguugcccaggugggucucgaacccguaagcucccaaaguccugggauuacaggugugagccacugugcccggccugccuugaguauuagcaagcaccuucuguguggcaggcccuugcuaggcauaaggauagaauguacauguuggugagaccuggucccagccuagccugcccucugggaccuuacacaggagacugagaugugagcccauucucacuguccagagcucaggguggagaugggugacgcugagaggcacagaugagggagaggauguuccagcccccaagauggugguaccucugugcccaccucugugcugggcacugggcaggaugagcucucagagcuccaagcagcacaagagacgggugguuuggcccaacuugacaccacccaccaucugcucaugucuuuccugcagaagcaucggcugcgccugguggccacugauggggccuuuuccauggauggcgacaucgcaccccugcaggagaucugcugccucgccucuagauauggugcccuggucuucauggaugaaugccaugccacuggcuuccuggggcccacaggacggugggaccauguggcaccugaggccugggguggggcuucugaggguggcugggaaacgaggaggccaguccccagcaugauccauaaucccugggcucucaggaggccagugacagcagcgguggcuucccuugcaggggcacagaugagcugcugggugugauggaccaggucaccaucaucaacuccacccuggggaaggcccuggguggagcaucagguaccugcaagguugugucccugggguccccuuguccuuuugaagggcccuggaggggcucagggaaguggggagggcagcauggacuguacuuucaggaggggguuggguaggcucuggccccugaccaaccccuccccccaccucuucccuucuucucagggggcuacacgacagggccugggccccuggugucccugcugcggcagcgcgcccggccauaccucuucuccaacagucugccaccugcugucguuggcugcgccuccaaggcccuagaucugcugauggggaguaacaccauuguccagucuauggcugccaagacccagaggugcgacucccagcagggcaggcucgggggcggagagacguggugagagccagccucaugugucugcccaggcccacagacagcucugugcccaccgggucugcuucugccuguuccccucccuucucucugucccugccucuccccucuagcuucugugucuccuucuuaucccuccugucuuuccaccucccuuguuguucucccugcccccugccuggcuccccucugccucuuagagcuuguaacugucuuuguugauccuucuugcagacuugggcauagaccucgggccuggucccugcaaggagcgggugugaaugcuccacggccccuuagcuaccugugacaccuugugcccacagguuccguaguaagauggaagcugcuggcuucacuaucucgggagccagucaccccaucugcccugugaugcugggugaugcccggcuggccucucgcauggcggaugacaugcugaagagagguaagggugcugagacaagggaacuggugguggguccugagagaagagaaagggaaaccccuagacugugacccagccccguacccagccacgcugcggccucuuaggccagcugucugucuaagcuugaacaccccaagccaugaggcagucccgaaucugagaccuggggcaguucccuugcccucuguguucugcccccaagccuguugguucuggcacgcccuugcuuucuacccucccaggcaucuuugucaucggguucagcuaccccgugguccccaagggcaaggcccggauccggguacagaucucagcagugcauagcgaggaagacauugaccgcugcguggaggccuucguggaaguggggcgacugcacggggcacugcccugagcucuggguaaggacgagaagagccaagguccgccuacugccacagggucaaaggagguuuucgaucagcccagaccagaggcucugagcccugaaccaaagucccagagcugggcugggacgugaccugugcugagggcugugagaaugugaaacaacagugugaaaauuggcugugacacucuggucugcuuuauugucucugggcaggcccaguccuguggccgguugaagaaucaggcaggagccagggcucugaggggaggcgccugaggacugcagaucuccacugaccucuuucccuagauuaagaugggacccaguggccgggcacgguggcucaggccuguaaucccagcacuuugggaggccaagguaggcggaucaccugaggucgggaguuugagaccagccugaccaacauggagaaaccccgucucuacuaaaaauacgaaauuagccaggcgugguggcguaugccuguaaucccagcugcucaggaggcugaggcaggagaaucgcuugaacccgggagguggagguugcggugagccgagaucaugccauugcacuccagccugagcaacaagagcagaagucugucucaaaaaaaaaaaaaaaaaaaagcuggcacccaggccuuugggagauaggcccaguccaccguuugucucggguaguuucugugcugcuguggagggcugcugagaacuagccccacaggccuuuuacccugccacugcccgcuacucugcagccccugagucuagucuuagagucuagcuucuuccuucuccccacuggaagauguccuguagcugcccagauaggaggaggcuggguguccauguuuggaaggagaggcagaggauucaggcccaaaagaaaagaaugaggaucaccccuggggaagcuccagacagucuggaacccuguguucgcgcccacucucucccugccuuacucuggcuuucggcaagcuccagucccugugugugccucaguccuccugccacuaugccuugaggucugagguccuuccaucucgcucauuccaaggccuacgaugaucagccaccagggggugcugcgagcacgggccgcggccgccggcucgccccgccccuccagacugggggccuugggccgcggcuguucaggcugcccagcagucaaggccaggagaggcgauuugcugcugccaaggccccauccucccuugugccccacaacggcucgccgcuuuccuguuggaggggccugcgggaggagggcggucucucccuggcgaccuuguggaccccuugugggguggggagugggguccccgcagcuccacccucagcguggugugaccuugggaagcucuuaguuugcuugggacagaggacgaaaaggcccuuuaucauuaacgacaugaaacuagcccuacgucucucucugacguccugcaccuccagcccacccauuugccuguuaucuugggaugaacaauguaauaugagcugggcucuggcccagcccugcaggaucugaaagcugggauucagggaaucccagccugcgauccggaggaccuugcugcugggguccaggagcugggggaggggggguguggggggucggugugaggguggaaggcagccuggcugggguagcuguggccacauuagcggcaggaacauuugcagcccaccaccaccggcuagggcacguggcaccaggcgcgcugcugcaggggaugugcacaagggcucaaccaguaaugucgagccagcagcuggaugagcauggucugcucuagccagcagcucauguuaagcgccacgggcagcugcggggugacguguggcagucggugugcugcacccggcggggccagaacagagggcccagguccacccagaccgacgugaggcggcacgaggcgagauccagacagcggcgcagaaagugcgucgccgccccuguggcucccaggagccgccgcuggcguugcccugcugcgcuggcagcgccgcgacccccugggcuagccgaucgcgguagggcuccacgccguuggccaacccgcggcucagcguguccugcugcaccagcccggguccgccgccgcgcuucuuccgcagucauccagaaggugucuguaggaggcgcagcagccgcucugggugcacguguuucggcuugggcgccuaccgguagucgccggccgcccacgacaagcuguagggccacgcggggcgggagggccggccguggaccagcugcaagucugcguucugcagaaucagaggcucugaggaccgccccaagggcgcaauguccuuguucucugcgucgcgcacgggguucagggccgcgggcuaccagaagcggcaguaggaguggauggagguggcaccgggcgcacccaaggucuaggcucacggccgcgcucuuuauggccgccuguuccuuccuccuucccuccaccuccgcucucauaucagcuuagccuugccgcugcugggagcucaucgcccuaggccaagaaggaccuugugggcagggggcucccaagggccaggagugcgaagucaugaaucucagaugcuuuccagcccguuccaggguucaggcaugcacauucguccaggcuucugggagucuaagggugcguuacuuucacgcagugguugcaggucugucaaaguuucuaaaaucccaccaagcugagucucgccauucagggaucauaagagucuacaauuccuuugcgcaauucaauucugaauucaauucagaauuaauucaauucuggccgggcgcgguggcucaugccuguaaucccagcacuuugggaggccgaggcgggcggaucacgaggucaggagaucgagaccauccuggcuaaaacggugaaaccccgucucuacuaaaaauacaaaaacaaaacauuagccggguguggugggcgccuguagucccaacuacucgggaggcugaggugggagaauggcgugaaccugggaggcggagcuugcacuugcagugagcugagaucgcaccacuguacuccagccugggcaacagagcgagacugucucaaaaauauauauauauauuaauucaauucugaagcuucugaauucagguuuggcaagucuagauuagauuccuaauaguuucaauuccgugagacucugcuuccaaaaauugaggaauuucugcaucuaaagaaggugacaucaggcucuauagaggcaccucugagcccucgugaaaaccccggggccuuugaggagcugguucuuuucuuuucuuuuuuuuuuuuuuugagucuugcucuguugcccaggcuggagugcaguggcacagucuccgcucacugcaaccuccgccucccgggcucaagccauucuccugccucggucucccaaguagcugggauuacaggugugcaccaccauaccuggcuaauuuuuaguagagauggguuucaccauguuggccaggcuggucuugaacuccugaccucaagugauccaacugccuuggccucccaaagugcuaggauuacagacaugagccaccacgccuggccuuaaggagcuaguucugagcaucuaccccagcuccuccggccugggaugcgaguccuggcuccaucagcgccccucacacuguuuucucuccccuuacgcacuuccccuugaugcuccccaaccccagccccagcuucuaaaaacacuacacucagccccuccaccucuccccucccuuccuuaacucacugcagacugccuuuugcccucaaaacaccuguccaguuuaccagcagccuccucauugcugaauccaguguaccuugcuccccaggugcuagccucccuaacccucuggaggcauuuggccauguggccccuccuccacacaguucaggacagaacuccaugaccaaaucacacagccguucaccaagaccuauucuccucuuuggcucuugccuagacgagaggcuccuaacaggucacucaucaaaucucucccacucuguccauccuuuucaccccgggcaauaauagacuuuuuuuuuuuuuuuuuuuugagacagagucgcucuguugcccagucuggagugcgagcgaucucggcucacugcaaccaccaccucccagguucaagcgauucucgugccucagccuccugaguagcugggauuauaggugugagccaccaugcccagcuaauuuuuguauuuuuaguagaggcaggguuuugccauguuggccagucuggucucgaacucuugaccucagaugauccgcccaccucagccucccaaagugcuaggauuacaggugugagccgcugcgccuggcccauaacaaacuuuuuacaaaagauaauguggggggaaaaaaagaaagaaagaaagaaaaugugcgggucaugucucugcuguagaaucuuaguaguuccccguugcuaucagguaaagccagacuuuuuggacagguaccuaaaccaucugggcuccagcuggacuaaggcucuggaaagagcuuccggagaaggaucucaggauuugcagagccugagggaggagucucuggagucugccgaaaggagacucaaguccugguuucccacuccaggaaaccccagucaagacuaggaauccuuuuuuuuuuuuuuuuuuuuuuuuuuuuugagacggaaucucgcucugucgcccaggcuggagugcaguggcacgaucuuggcucacugcaaccuccaaccccuggcuucaagcaauucucugccucagccucccgagcagcugggauuacaggugcccgccaccacacccagcuaauuuuuguauuuuuaguagacaugggguuucaucaucuuggccaggcuggucuugaacuccugaccucaugauccaccugucuuggccucccaaagugcugggauuacaggcaugagccaccgcgcccagccucuucuuuuuuuuuuuuuuuuuuuuuuugagacaaugucucacuccaucaccugggcuggagugcaguggcgucaucucggcucauugcaaccuccaccucccagguucaagcgauucuccugccucagccuccagaguagcugggauuacaggcgcccgccacgacgcucaguuaauuuuuguauuuuuaguagagacaagguuucgccacauuggccaggcuggucucgaauuccuggccucaagugaucugccugccucagccucccaaagugcugggauuacagacgugagccaccaugcccggccuaggaaccuuuucuaaacauggauuggagcaagaaggugcagggauaggggauggagucacaucaggcugggccacaggaggugggagugccagagacuggcugggcccugggcacagagggguuaacuacaaagcaaaucacagagagcgagaucaauggguuacuggcugcagagagaggaaaaggcagcagcaacgcagagaggcagagaagagccaggcagaagagccugccaccugggggaaaucagggacugaggaggaaguggccaguggcuacuccagagggagugcccaacuccggcucagcagagggggcagaggagaggaggggccuuaaaggcaaagggggagaaguagaaggcagaccaguaccugcagggaggcaccaaggggcagccgcugaaucaggaggcccacccagcccggccauuccacccaggaucaagcccacugcccaaggcggagguggguguugcccauccugggcuuuggggaccuacugcaugcugggugcugggaugggggcagacauugccuuucuucccuacucccugccugaccccccuuuccccuacuuugucccaccaccccaguggucucaagccugcaaggagauccacaggcaguaggagacaugggcuguagagugggaugggggugagcaugggugcggugugcacacacacaaguugucagaggcaccaccuguuacaagcucucagaugagcacucuagcuuaagaggcaggauaccaggguggcaacagccccagagcugccauuucgagugugauauuauccucccauguccccucucugggccucaauuucccuaugugcagagaggaagcagugaccuacacggucuucccaguuuugccauugugaugaucucacuauacuggacccuccaaugacucagggauguuacccguguuuugcuaaggcuacagcuuguagccagagaaagcccuaaacccaugucccagggucuccccugagcuucagauccccauugagaaggaaaacauaccaguuucuggguuuggccccuccccccaucgccauaucuucauccuacuucgcuugugccuuccccagccucguggguugaaagugucccucaaauaccuagguaguccuccaggcaggacuccagggguguuccuuaggaaacugaggaacucucaccccuugaacaccacgagcuugcucacacagugacacucagcgaugacuuuggcucugcucuccccuccuccaucucccacgagcuuccagcccagaacaccuggccagacccaggucgggggaguuagaucccggggucaagcaaccagaacugggggcucuugccugaggauuccagcuucucuucccaggugcccgucugauggggagauggcugaugcccagaacauuucacuggacagcccagggagugugggggccguggcagugccuguggucuuugcccuaaucuuccugcugggcacagugggcaaugggcuggugcuggcagugcuccugcagccuggcccgagugccuggcaggagccuggcagcaccacggaccuguucauccucaaccuggcgguggcugaccucugcuucauccugugcugcgugcccuuccaggccaccaucuacacgcuggaugccuggcucuuuggggcccucgucugcaaggccgugcaccugcucaucuaccucaccauguacgccagcagcuuuacgcuggcugcugucuccguggacaggugcgcugugccuggggccuggcugggcagggcugugggggcggggguugggggaggaguccugaacagauccucacuggccuuaggaaggagagagugggggaccagaaagggaggugggugggaggaaacaaaagcucccugaccccucgcaagcagccucugggcaccugcagggcgugcuugaggggacuguccugcccuuccccuccuccacugugaacuuccagaggacgccucugagucucaaguggcagcacagggucuggcacauaguaagugcucuguaagcgcgaaaugaaucgcaaaagaagcucacgaaugcguucaucaguuuuuuuguuuuguuuuguuuuguuguuuuuuuuuuuuggaucuuggcucacugcaaccucugccuccuggguuccagcgauucuccugccacagccuccugaguagcugggauuacaggccaccacaccuggcuaauuuuuuguauuuuuaguagaaacgggguuuugccauguuggacaggcuggucucgaaccccugaccucaagugauccgcccgccucggccucccaagugcugggauuacaggcgugagccaccgcgcccagcccagcuauuuucuaacugcccacaccuggccaagcugugcacacaucugcuuccacagcuugaaacuuggggucaaauccaggcucacuccagcugaugacccugggcaagucacuucucucuggaccucaucugacgcauccauaaaauaauccuagaaauaacaagucaccgggaucgggcccuugcuaggugcaagggccuaagcaccuugcgcguucacacccuuaauccccgccacgucccccacgguucacaggaggcgcacugggccgcagggcccgggcgcgggacguggcgcgggccccugcgggagggcaccugcccgccccgcugaccaggcgcccuccgcagguaccuggccgugcggcacccgcugcgcucgcgcgcccugcgcacgccgcguaacgcccgcgccgcaguggggcugguguggcugcuggcggcgcucuucucggcgcccuaccucagcuacuacggcaccgugcgcuacggcgcgcuggagcucugcgugcccgccugggaggacgcgcgccgccgcgcccuggacguggccaccuucgcugccggcuaccugcugcccguggcuguggugagccuggccuacgggcgcacgcugcgcuuccugugggccgccgugggucccgcgggcgcggcggcggccgaggcgcggcggagggcgacgggccgcgcggggcgcgccaugcuggcgguggccgcgcucuacgcgcucugcugggguccgcaccacgcgcucauccugugcuucugguacggccgcuucgccuucagcccggccaccuacgccugccgccuggccucacacugccuggccuacgccaacuccugccucaacccgcucgucuacgcgcucgccucgcgccacuuccgcgcgcgcuuccgccgccuguggccgugcggccgccgacgccgccaccgugcccgccgcgccuugcgucgcguccgccccgcguccucgggcccacccggcugccccggagacgcccggccuagcgggaggcugcuggcugguggcggccagggcccggagcccagggagggacccguccacggcggagaggcugcccgaggaccggaauaaacccugccgccuggacuccgccuguguccgucugucucacucccguucuccgaaggcgggacgccaccgggccagggauggggcaaugccacgagcucucugaggggcguugaguggagcg

SEQ ID NO: 17863 - RNA, 1191 nt, Homo sapiens
aucccguauuuuuuauaugcuacaucuggcaacccuggcuugaggcuaccuggcaaaaaucaaaacagguuccuccuuguuaugcccuaugccucuguugccuuuauuuuuaucuuuacgagcaaucauuaacaguaacuucagacuccaggcucuggucgcuuuaggaggcggaaggcggacuaggguaggacuccuggcccucaucaacaggacugccaagaagccgggcaccuucugccccgcacaaacauggccgcgccucgccgccgaggauuggcucccgccgaaagcucguccuccuggcuaagggagccccuuccauugggcaguuaaaaaaaauggcggaccccgccucccgccguccucgggcgcgggggcggagccuagaggaggccugggacagggccaccagugauuggcggagagcgguggucaggccaucacguggcccgaggcccguuuguuugcggaaguaggaggaaguagaagugcugaguaagccgaggugagugaccucgcgggugggcggggccuggggguccguuccccaacuuccucggcgcuccggacucccaagucuccgccggacccuccuuuggauauuccucgugucuccgauucugaggcauguccuccauuaacccuuaugugacucccugagugcccccaccuuccaucuuuucaucccccugcguccccaauucccaucccgagaccgcccgugucucaucucgaacuuguggaccccagggaccccagcuucgacccugaguuucuccccugaaccccagucuccuccgugugucucccucaguaucccuaacuucccgagucaauccaucucuucucuuuccccgacccucagugccucuuuaggccccauuggccguccuaauuuuccuuccugugcuccucuaagugcucacuugauuccccacuucacguccgucuccaccuuucguggugccucuacucauuucucacucccugcuucuccugccuuuccucccugcuuuuuuuccuugccuuuccucucucgcgugccuccagaccugcccccgacaugcucccuccuuccccucagccuggccaccccagagucucccaccccuaauccuguguccaccuccugcucccacagaugacuuggaagcuggugacagggagcaugugaccagggugaucaug

SEQ ID NO: 17864 - RNA, 17778 nt, Homo sapiens
gguggauaaugaggcacugacccccuuguucuggcaggcuggggaugggaguaaaggaucuaggcagcaugguguccaggaguguuguucagguccacugagaauucacucacuagcugagcaccuacaguguuccagguguggccccagcucuugagaagcucauaaaaaagggaguagauugggaggcugaggcagaaggaaggcuugaggccaaggguucaagaucaaccuaugcaauauggugagaccuccaucucugcaaaaaauagaaaaauuauccaggcacagugaugcacacuuguagucccaacuacucgggaggcugaggugagaggaucgcuugagcccagaaguucaaggcugcagugagcuaugaucaugccacugcacuccagccugggcaacagggcaagacccuguuuuguuuuguuuugguuuugguuuuaaagggggugggggguagagaaaauagacaacucaccauugugcaguuucuaaaacugagaacuuuccuaccccaaagguuaaccuagguggcucuuucugcuaugcacauggagaggacugagcaauugguuuuuagagauccuuuugagugcuagacaaagcugccucaacauuuggucacuugggaaacuagugggccaauuugcauaccaaacccacagccugugggagggaacggaaagaagccauagugucugguggaccaaggcacagaggcaggaaagcaagacaagggcgcugaaaucgaauuugcuacaucaaggaaaguggggggcugggcgcgguggcucacgcguguaaucccagcacuuugggaggccgaggcggguggaucacgaggucaggagaucgacaccacggugaaaccccgucucuacuaaaaauacaaaaaaaaaaaauuaggagggcgcgguggcgggcgccuguagucccagcuacucgggaggcugaggcuggagaauggcgugaacccgggagguggagcuugcagugagcugagaucgcgccacugcacuccagccuggggcaacacagcgagacuccggcucaaaaaaaaaaaaaaaaaaaggaaaguggggauccuuacuggugaucagggugccacauagaggccuacccauuuggagaggcccuaugcccuccacaguggaguaagugccaugaugucggcuucacaggagggacugugggagcgauggaauuucaggcagugggaacaucaugagcaaaggaaagcaggggaugaacagcaacauccaccccgcacguggccuccaaagccaucucuuuuggguggggcuucccaccacggcgcacaccccucauguuuauguggcccuccuccccugguugcgauguacccccaaacaucugggccaggaaucauucagaccuggauaccaauuccagugcuuguacuuccuagcugagugaauuuagaaagucaccuucaccucucugagccuccagucauguauuccuucaacauguauuuacugugggccuacuaugugccaagcacuacuccaggcacugggcaggcaguggugaacaagauaagccuggccaggcgcaguggcucaugucugcaaucccaacacuuugggaggccgagguggguggccugaggucagggguucaaaaccagccuggcugggcauggugacucaccuguaguccagcuacuggggggcugaauuccuugaaccugggaggcggagguugcagugagccaagauuaugccacugcacuccagccugggcaacagagugagacucugucucaaaaaaaaaaaaagaaaaagaaaaagaagcaaggccugccuucauaaaacauacauucugguuggggaagacagacaauaaccagcacucacauacauaaaugaugaaacacccuacagaaguauuaagauaauauaagaacaaauuucaaggcugggugcgguggcuugcgccuguaaucccauuacuuugggaggccagcguggguggauugccugaguccaggaguuugagaccaguuugggcaacauggcaaaacccugucucuacaaaaaaaaaaaaaaaaaaaaaaaaaaaaaaauacaaaaaaugaaccuagcaugguggugugugcuuauggucccagcuacuugggaggcuaaggugggagaauggcuggaguccaggagaaggagguugcagugagccgagauugugccacugcacuccagccugggugacagagugagacccugucucgaaaaaaaaaaaaaaauucagaggugaagacugcuuuaaccaggguggucaggaaaugucucucugaggcagugacauccgggcugacgugaaagaugagaaagagucaggcaagugaacagaagaccagacagccagugccaagggccugucgcaggaaugagcuugguauguuugggggacagaaagaagggcacuguggccgaagagcaguggaugaggagagaguggccaaagaagguguguaaacaaccugagcuuuguuuugagaagaacauuggcugguauagaaagaaagacuuuggaggcaaaguagggagccucggaggcugcugccauuguccggguaagcugauggugccgagaccaggugccaugacuggagguggugagaaaugguccuaugcaggagaccuggagacaccgcuagcuugaguccugagguggggaggaagggagagggagggauggagccaggcuccaagguuuuggcuugagcagcugagaugggguggcaagggagcagagguagggcugacgaucaggagcggguuuuugggccgaguccucugcagugcccaucugacacccacuggaugcgcagagugggcagcuggcuaugagucuggaacucagagaagcuguucgcuccggaaauacaaaccuggggcucauagccauauaaaugucauuuaaagccacgggacuggaugagaucauuaaggcagaaggucuaggucgaaagaagagggccaggaccacuaccuguaaaaugagccaaugacaccuacacccacggggcucucgcgaggugucacgugaacgcacccagcgagcccuggaaccaggcagagaaucgcggcagccccgggggcggggcuuccagggggcggggucauacgggggcggggccgagggaccaagcggccgcuccuggccggagggcggccgggucggugacgucaccgcaugacuggguuuuuaugaaugaaaggaauccugugagugaguaauuccgggaagcucgccuuacaacuccgcgcggccucggcccccugcgccgcccgccccacaacaaaacucagcgcagcgcucccgggcgcccgguucagagcgaccugcggcucagagcggaggggagacugaccggagcgcggaucgggacagcggccgggacagcggcgagacgcgcgugugugagcgcgccggaccaagcgggcccagaagcgggugaggaacgcgggaccaggaggacggugcgcgggaccccaaggcggcaggguuucugcgucccgggaugcgccuggggugggcgcccgggcccgauccgucggggcucccggagcuccaucgcccggacggcucggggcggggagaagggagcggccgucccggggacgccgaggacggggccgaggccagcucgggggaguggggguggagacggggccccuucccggggcgcgggcggguaggcggcggcgccgggaggaaggggcagcgcaggccggcgaucuccgcguccgcccggcgggggcgggggcgcugugcuccuacgugacucggugggaacaggcccuggcccggcgcccgcgggcggugcgugcgcgguuuguuuacguccgagggcgggcguguguucccuggcgggcggccuggguauccugcccggugcgugcgugcgcuguguaccucgggggcgugugugcguguguugugcuugugugugcguguccgcgcgcgcgcucccuggggccuguacaccagcaguguguaccucggagagggcgugcccugggccggccaccggaguaaacgcggaacaaggacccgagcgaaggaagcggacccgugcgucuucgcacggggucugggaauucuggcccgggccgccccaguccuacuacccggggcuguccguccccggcucuccccggaguuucccagggccuccgccacgugaccccaguguuugucucccgcccagagcccgcgcccgcagccacaggguggggcaagguaucaaagaccccacccagcugagcuaggagugagggaugugagccacccccgcuuggcaccccgguggaucugguaacaaagugaguuggagcccagguucuuguccccagauuuuggggcuuccuggggagggaagaaccaagggacucucguucguccccaggguugcccauccccucagucccaugagaacaggaagggccagaaaaccuugacugcaagggugcggcgcagggagaggaccacaggcuuuuagcuaguccggguucuggaggcuguaccugcuaggucguggaggauggggcggagccgguuuccgcucuccugguaguuucaguucacaagugggacuggugagacuagacugaccuacagcuggacgccggaagcuagcugaggcucugagccagccgacagaccccgagugcccucacccugggccaggcagggucaguaggcauuggggauagaacucugacugcacggaggguuaaugagugagggguggggccugaccuagccgccacccacccacucacccaauagcccugcagaaagcaccuguuugucguagccgccugcaggaugggcugggggcuagagauuccuuggucuuaauccaccuucccccuccacccacccacccacggucuauggaauugugggaggggagcaauugaacuugcuagggugaggaaccaaugaucuuuugacuuuggaucuuugaacccugggugagcucugcuacagcagcccggacccucaguauucccaucuaccacugggaacuagguaacagccaggauggcaggaugguggguagaagggggaagcucuggaagucugugcagacagcguauuuuccaggugaauuguggaagagaaagcagggcugacagccccaugccaggagcuggggguacccaagaguaggugggguuugagucaggaggguuggggccaggagcacaggaaccagacaggcccacccucaaagcugggcaggaaacauuacaaaguagggccuggggucaggggaugaggggaaguggcugguugacucagucccagauggaaaguuagcacugagaaguuuaacuucccauugaaucaccccugggcccugcauugccauugggcccuuguccuggaccagaugccagggaugagaugaacagaccagauccagagacugcccucugggagcuuauagcucagcagcggacacaaacuugaaaaaagauccacagaaguaaaugcaaaacacagcuuagaugggugaugugagggagaagucacugugguuugaaaguacauaacagcgcucugacuuagccagggcaaucaaggaaggcuucccuggggaggugacuagugugcugagucugauagaguggugguugucugugaagcccuugaaggcaggagcugugauucacuucagggucuccagggcccagcacagagccuggaacauaguaggugcuucuuggauguuugcugauugaaugaaugagcccuggaucccugcccucuaagagcuccacaacacauggagaaaaaggccugggaaccccagagaaacaggaagccagggcaggggcugggggaaucuugaagcagucucccaaaagcgagcaaauccuucaggacucaggcaacuuccucccucacacacacaggcaugcacugcccgcuugucccuuugggaaacauucagggauaguagaauuugcugucuguucauucaucuguuagcauacgauccugggagagaguggacaggaauacgguugaggccugaggacccuacuguguuggcuugcggggaggcuggcauugcaggguuuugaaaugggccaagcacggacaggcucguggguuugugucaguagugauuccucugacagcucuugggggaggaucaaugauggggauuggagacggagggcaaggcaagaggcuggugagcaggcgguuguggucaugguccagaugaaggaggaaguggucuguggcugugcagguggagaagagggcuagucugauagucugauaguuugugucucaugcccccaccuccaggaagccuucaccgcuuuccuuucccuaccuccauucugcugguggucuuggagcucugggccagaaucugaaacucuaaacucagagacagucauuguuggaagguaccuuaggcucggaggacguuuggcauagugggaaaacugaggcccagagagagggagugccguaccugaggccacacagcgagugugagaggguaccugaacuggggcuggaaccccaggccguugcuucucuguggugcuugguucuuccagccuugcuccccuuccagcagggaggaggcuccagcagugcugacugccaagagcuaggaaaacacauuuuuucccuguccucacagagcgagcagaauggcucagcagccagaaaggagcccaugccagcgggugggccuucuacaggaugucucuggaguggacugguggggccagggagggggacguuggaggguuguggcugcugacuggacaaggcaguugucagucccucaagagucaccucucuccuuaugccuccagaagacgucaugaaccugcagacccuggaggucagcucugcuggcuuccaagggaagaagccagggagagguggugguggccgacauagaagacagaggaccccuggguuccaguccgccacggcuaccaaacaguggcuugguugccucaggugcugaacaggggaucggaucagcuacuauuucucaggcccagggucagccagccuggcaaaggcagaggacccaggccccuuggcagccccuggccugggguuggcagcggaaagccugagguuaccagaaaguucccccuucuugugacuuucccccugugauugccugacugcugagcuaggacauuccugggcaaacgugggugccucagcugacauccaggaugcgguugagggggcugaggcucggacaggagggcauggaggagugggggaagagcagguucaaaaccuuccuagcaccugaggguauuuacaaucacagccagcuuccgcuauuaucaaggauagggaauggcugaugguuccaucucucaggccuggucuggaggcaguguugaggauucuaggcuguguccaagcucaggagaaaacaguucugugcugagaaagacucaggggcuguggccugccucacugggaauuggugcugugugugguuagugaugucucuguugcuuguggauagugggaugauggugagaugaggugaucuuucuugccuaugccuccuuuuuuuuuuuuuuuuuuuuugauggagucucgcucuguugcccaggcuggaguccaguggcuuguucucagcucacugaaaccuccaccucccggguucaugcaauucuucugccucagccucccaaguagcugggacuauaggugugcgccaccacaccuggcuaauuuuugcauuuuuuuuuuucuuuaguagagacaggauuucaccauguuggccaggccguucuugaacuccuggccucagaugaucugcccaccuuggccucccaaagugcugggauuacaggcgugagccaccacgccuggccuugccuaagccuuuauauuuuacacaccaagauuauugugauuauucccacuuagcaaggaauccaggacucaggaaaaaugacuugugcaugaggccagacugugccucugagguucuguaucagccgcaacacccaaagggcaguugauuaacuugcguggggagaggcuucccuucucccauugggucuuucuguguagcucagguggccaagcaucacugcacgugccagcuccccaaacggcugguaagggggccuggauacuuaacuguaacuugcaaaucguaucccuagcgggcccaacacaaauccuggagaaucagagcugggguggccuuggaaacuggcaaguccagcuucaucuucacagggcuagggaaacagggcccagggaggucgcccugccagggccacacagggaggagguguguggcuccauguggccucaggccugaauucuauuauuauuauuauuauuauuuuugagauggagucuugcucugucacccaggcuggagugcagucgcguaaucucggcucacugcaaccucugccucccagguucuaagcgauucuccugccucagccuccugaguaguugggacuacaggugugugccaccaggcccagcuaauuuuuuguauuuuuaguacagacaggguuucacuguguuagccaugauggucucagucuccugaccucaugauccgcccaccucggccucccaaagugcugggauuacaggcaugagccaccuugcuuggccaucuuuuuuuuuuuuuuuuuuuuuuuuuuuuuuuuuuugagacagagucucgcucugucacccaggcuggagugcaguggcgcgaucucagcucacugcaagcuccaucuccggguucacgccauucuccugccucagccuccccaguagcugggacuacaggcgcccaccaccacacccggcuaauuuuuuuuuuaagaggcggggucuugcuuugucacccagggagugcaguggcgggaucacagcucacugccgccuugaauuccugggcucaaugguuccuccugccucagccuccugaguagcuggggcuauaggugugcaccacugcacccggcuaaucuuuuuauuuuuuggagauggagucuagccaucuugcccagguuggucuugaacucucaggccugaauucuaccccaugcuggcuguaugagccuggacuacucuauuguccucucugggcauuaccucaggguugggcgaaccagggaggugacggugugaagggaccagguuucaguccugggccuuugcagcuauucauucacaccuauugugugacuucaggcaagugcugccccucucugggucucuaccuccccuuggguaaagggaggaggcaggaccugauggccucuaagggccuuuccugcaguucccugugugaccccagccagcugggagaugcuaaaucagagcgagaccccagugcuggcuacaggccugaccccuccuggacagacagcaauucuaaccucccagcugcucacugaccucuacaguguauaccacuugauuccaccaaaacccugcgaggcagguauuguuccgauccuuuagaugggaaaguggagacccagagagauggaguggcucaccccaggucacacagccugagaaaacagagaugcgacuuaaacccaagcuugacucccaauccagugcuccuuucccuguuucccacaccccaccuuugggcccaaagucacguggaugggauccccucugcucucuucccauucgccuagcaucuguacugucucugccaacaggcccaaggaagcagcuggagaggaggaagaauuagagacagggccaggagguacugaacuacguuucggcuuggaacccggcuuggugacaagcugggugauggcgucagagacucugaccauccacccuuccccagugccugcucccugccaggucuugagauggguggccucaagcacccagagcugacucagccucucccugucugguggagagacagcaaggaaauacaacccauuacacacaggggugggggucccuaacaaguccuagggaucagggagggcuuccuggaggaggagaugucugcacccagggccgaaggaugaguaggagucugccaaacaaaguagaggggagugaggggagagaaauaucauggggugggagguggcucagaggcaagaaagcgcgggugggaggaagugaaagaaauucuguguggcuggagcacagaguggagguggcaguggugggaaaugggcguggggcuggacacacagggccuggggugcugggagggugggucuggacuccauccuuaggauaguagggaaccauggaagguuuuuuuuuuguuugcuuguuuguuuuuguguuuguuuuugagauggaguaucacucugucgcccaggcuggagugcagugucgcgaucucggcucacugcaugcuucaccucccggguucacgccauucuccugccucagccuccugauagcugggacuacaggugccugccaccacacccggcuaauuuuuuguauuuuuuaguagagacgggguuucaccauguuagccaggauggucucaaucuccuuaccuugugauccgcccgccucagccuccuaaagugcugggauuauaggcaugagccaccuugcccagccgaaccauggaaggcuuuaaucuggcugguggcauggucagauucgcguggugcaaagauuguccagcugcugugugggaaugagcugagaccagcagggaggugugcugggaccuccccagguguguguaggguggugagggugaccacuuaagaggccugcauuggguugggcgugguggcucacaccuguaaucccggcacuucaggaggccgaggcagguggaucaccugagguuaggaguucgagaccagccugaccaauauggugaaacucugucucuacuaaaaauacaaaaauuagcugggcguggugguaggcgccuguagucccagcuauucaggaggcugaggcagagcuaaucgcuugaacccaggaggcggagguugcagugagcugagauccugucacugcacuccagccugggcgacagagcgagacuccaucucaaaaaaaaaaaaaaaaaaaaaagggaaaaaaaaaaggccugcauugaaagguaggaucggugagguugacauguaaacgucuccagauaguaucugaaaggucaggguagccagcagaucucauaugacuuuuccagguaggaugggagugcacagaggcccccaaggagagcuaggugggcagccagggccugagcccccuaggauuuggagugcuaggcagggaaacugaggccagagcccaggcuaagccggcauguucagcaguggggggucgcagcucaggggucaccccaugaagccacuggucuucaccguggauccgcacaggggucuaaagcugccuggguccugaccuggcacucuggguccacccagcuacccccagcgaaaccugggugaccccuaagacucuccugcuuaagggccacaguggcugccccugucaggggaucucugcaagcgccaacuuccuucugucccacuccuuccuucccugugagcugccagacccccugacugugugggcugggaggagcuggggaguuuccugagaagcccuggacuguccccaccuuggccugagucacacugagaacucagcaaggauuccuugaguaucugcgaggugccaggcgcgguucuaggcaugggggaggccgcggugaaucagguauaaguucugcccucauggagcuggcauucuaaucgggggguugggagggacagacacugaacaaauaaccaccauauaugugagugaugacaauuacacauggggaaaccugagguggggaagggacacagggaguguguguguguguguguguguguguguguguguguguccguguguguaucagggguugcaaauucuaaacugagugaacaugagauuugaagagaccucaggaggugauggagcaaacuuuguggauaucuagggaacaaggaugccaacagaggccaugcgucguggcucaugccuauaaucccaacacuuugggaggcggaggcaggcggaucgcuugagccaaggaguucaagaccagccugggcaacaugaugaaacucugucuguacaaaaaguacaaaaauuggccaggugugguggcaugcaccuauaguuccagcuacuagggaggcugagguaggaggaccacuugagccugggaguuugaggcugcaaugagcugugaucgugucacugcacuccagccuguaacggagugagugagacccuguauaaaaaacaaaaacaaaaacaaaaacgccagcagagggaccagccagugcaaaggcccuggagaggagcgugcauccuguguugaggaagggcggguguggcugaggcaggggaaacaaaaggaagccaaguagggcugagguuggagaagggaugcuggggagcacuuucuuuuuuuuuuuuuuuucagacggagucucacucucgcccaggcuggagugcaguggcacaaucuuggcucacugcaaccuccgccucccggguucaagcgauucuuuugucucagccucccaaguagcugggacuacaggcacgugccaccacgcccggcuaauuuucguauuuuuaguagagacgggguuucaccauguuggccaggcuggucucgaucuccugaccucaugauccacccgccuuggccucccaaagugcugggauuacaggcgugagccaccgcgcccggccacuggggaucacuuucugcagcacuuugugggccauggugacaacucuggcuuuacuccagugagccgugggaagguccugagagaggugugacaugagcugacuuaacacagcuaccugugucacccagggggaaagugaggcacagaaagaguggcugaccuaucagaaccacacaacuagagagcgagaccacccccaaaaggccccaggugugucuggcaccaagguccaugugcuuuccauuucugcaccuugucccugggagacaccccgguccugccagaaugugucagaggcugagccaacccgugaggucaacccuguagacagcucaaggaaccaggacuuggaucuggcuuuugcccucugcuguccacaaaacugggugaugcucuuuccgauacgguacguguuuauaggaugcuacagcucagaucacaaagcaucuuccuuuguuuucuuuuuauuuauuuauuuuuuuugagauggagucucacucugucacccaggcucccaggcuggagugcaguggcgcaaucucggcucacuguaaccuccaccucccagguuuaagcaauucuccugccucagccucucaaauagcugggacuacaggcaugcaccaccacgccugggcuaauuuuuguguuuuugguagagacaggguuuugccauguuggccaggcuggucuugaacuccugaacugaggugaucugcccgucucagccuccuaaagugcugggauuacaggcgugagccaccgcgcccagccuaucuuccuuuauuuuccuuggcuucuuaucacugcccccuccccuuggagacagaugagaaaacucagguucucauggcggagaaccugagaggauuggcaaaguagauccuaucagcuagagacagagaggacugcugcuuuaaaggggacuuugggagaugguccccuucuccagcccagagcaaugaccacugacccuccacgaguuuuauucaccuuuuucuccccauuaccaaguacauguuuggcaaagagcucaauaaauaguuguugaaggagcauguggcugucaggccugugggagggaggauuaggagaugagaggcccucauuggucuagggauggcugccccaucugccuagggcaugcugaguuaguauggggcagcccccaggagguugggaaaacuuucccaaaacagaggucuagaugaaggaggccuggggagagaggggacuggcugauguuguaucuuacggggugcuggaugggcuuuguguaaaggcauuuacuggugcacauaugcuguguguacuuuucuguauguagguuauacuuuaagaaaaguucugaaaaauuggcugggcacaguggcucacaccuguccagcacuuugggaggcugaggcggguggaucaccugaggucaguaguucaaaaccagccuggccaacauggcgaaacccugucucuaaaaauaaaaauaaacuaaaaauacaaaaaauuagcugggcguggugacaggcaccuguaaucccagcuacuugggaggcugaggcaggagaaucccuugaacacgggaggcggagguugcagugagccaagaucgcgccccugcacuccagccugggugacagagugagacucugucucaaaaaaaaaaaaaaaaaaaaaaaaagaaagaaagaaaaagagaaagaaaaguucugaaaaaucaaaucaaaggcacauguccaagccccauguggaagaauggucaggagaggcacaucuauucauuuggugcacacuuacugagccaucuacuauauaccaggcacugauuuaggcauauugaugccguggugagacagggaaggccucugccuucauuggcuuccguuuugguggaggaggagugggaaggagaaacaaaucauagaugaggaaccaagcaugagaaaugcagaagaggugacuguuacaaggguuaauaggcgggguuaugugaugugacacagaggcguuuagccagaauggucaaagaggaccuccugaggaggugacauugggcaaagaccuaaaugaugaggagucaccauggggcuagaacaguaaagagcacagccugugcacagcucccgcggcuggaaggagccauucaaggaggccuguggaccaauguggagagaggaagguggcagguaugaaucaguucuaagauagcagaggccuugaauggcaagguagugaguuuggauuuuauucuaaaugggaaaccaaaaacaaaacagugacuuugaccuccuuucuacccuaggucugcagcccagagggcaccuucugcaaacaugucuguggauccccuauccagcaaagcucuaaaggugaggaggcagccucugucaacccagugaagcccucccucccugcccaugcagagccuccucaucccaacuuccccuucuuuccuggaauccccuggguggcucagcaggcaccaggccuucaugaugccaaagggaagggccacagccaugggcugggaccaggaggccugggcucuggucacaggcugcaugucccugggguaggucacuucccucuccaggccuccuuccccaucgggucaauguccccuggggcauucaaaggugcuuuccgaccuggguuucucuggcugaguccagggcuuggcgcuagguuagaauucaggcugagccccgggguggccuccuuuugugucccgauccuagucuggcccgguuuccccuucccggauuccugcuccccuucgggguuuuggaucaaguccacccaccaccucggcggcuaaggcggugaaagaggaacaccgcggguggagcgggggggcccguccccaguccccuggaccucaguuuccucaugcccgcagaucaagcgagagcugagcgagaacacgccgcaccugucggacgaggcgcugauggggcugucggugcgcgagcugaaccggcaucugcgcgggcucuccgccgaggaggugacacggcucaagcagcggcgccgcacacucaaaaaccguggcuacgccgccagcugccgcgugaagcgcgugugccagaaggaggagcugcagaagcagaagucggagcuggagcgcgagguggacaagcuggcgcgcgagaacgccgccaugcgccuggagcucgacgcgcugcgcggcaagugcgaggcgcugcagggcuucgcgcgcuccguggccgccgcccgcgggcccgccacgcucguggcgccggccagcgucaucaccaucgucaaguccaccccgggcucggggucuggccccgcccacggcccggaccccgcccacggcccggccuccugcuccuagugcccgcccccgccaugccucagccacgccccuccggccucagcucccuccccaaagugccugagcgccgccucugugcccaggucccauuucucugcagcacuggccccuuggugcacacacauucccuucgugggcccugucuuccucuugcagccccccaaacugggaccgaaugacccugggaaggggaacuuggguagguuggggauggggcagaggucuggaucugggaucgcccuuggcugaaaguuuagccuuuuuagauugagagauacagagccggcuuagagaacagcuguugggggagaagagggcaccccucaucuuggaaacugcucuuauugugccaauaugcccuccaaacccucccaggauucaaagcuagguuuggcugucugugacuuacgggaccguccugcugagaaauugcacugaagagaugcccccaccucugguugggccugggggugccuggccuuccgaaacuaaaagagugggugggaagacuagugaaacccaguucacggauggggaaacaggccugaggucacauuucacuuagugguuguguugggaccaaaaccuggguguccucacugcugcccugaguccagccaugguuuucagggggacaguggacagggacucagaaauguggugggagggccucccuggcuugggagaccgcucucugcaagggagggggagagaagcagagggagagagaaggugacacggauggaagagugggaaggagcuggccuggcucagcccuaggcugucccugcagccaggguguccgggggcuggccagucagagaaagggggccauggacugcuguggcaaauagggagacaaggagacagacccugcaguccuacuacagucuggagugggguccuaagaagaagggucccaccucaaccccugucaguguccacuguggggugggggcugaccccugccuuugauugucauucuccugggaagcccagucucagucccucccccaacacuguccacacugccccuccccacuguuuauuuauugcacggaucuaaguuauucuccccagccagagcccgagcuccugcucccugggaaaaguggcguauggcccugagcugggcuuuauauuuuauaucugcaaauaaaucacauuuuaucuuauauuuagggaaagccggagagcaacaacaaaaaauguuuaagccgggcgcgguggcucacaucuguaaucccagcacuuugggaguccaaggagggggaucgcuugaguccaggaguuugagaccagccuggacaacauggugaaaccccaucucuacaaaaaauacaaaaauuagccaugcaugguggcucaugccuguagucccagcuacuugggaggcugaggcaggaggaucacuuaagcccagaaggcagagguuguagugagcugagaucgcaccacugcacuccagccugggcaacauagcaaaauccugucucaaaaaaaaaguuaaaaaauauugcccggcuccuagaauuuauuuauuuccugacuuacagcaagcgaguuaucgucuucuguauuuuguagacuuucuaaauaaagucaaauucuuucuuuuuccacagagaa

SEQ ID NO: 17865 - RNA, 53980 nt, Homo sapiens
agagauuucaauacaaucuauauuaucucauauauagauuucuuccucacuuuauuugcucacuucugucacgcauuuaaaaugucacagagaccaaaauagaguggcuuucugguggaacucauggcagucauacaacaagauacaaaacuaggagacucugucuucucauacaucauacaauuaauuuuucaaguauucuuuauguacaaagagcuacucuaccuggaaagaaaauuaaaaaaaaaaaagacaagguagguuaugcauccuaaggaggaggaggggauggagcggucgggcacauguucccguccccacgaccccacggaccgcugauucccugccacugagcuccccccacccuccacgcaaacagcaacgcugggcaggcgaaaaccaagggagugggaaucagcagcacuuuggccuggagggagaagggaagccacgguggagagacagcuuggugaaagcagauggcggggcagggccagggcugguccucagccugugucugcacccacccucccgggcagcuugggcccaacugcuccgcccccccaagauggagggggagagcuggccucuggcacccacaugcaggccucugccacgaggaaaggaaggaggccaggaagacggcugggccccaacucuccucacagguggcagggagggaaccuguucauuccaggaaggaccaaaagaaagaauccccagugaacaccggcagggucccucucccuuacccuaccagcuucuccaggugacugcagcccaaacccagggauaaucuggguuuuaaaugccaggacacuuugccuguagggacacguguugugacacgaggcucuuccuaagucaggagcuaguauaagcccagccugcuggggguuccggaggccccaggucuagagguguggagggggagaggaggggcuuggugguccugaccacuccugaggccuguccaagggcucugggcccagcacugcaggauccugcgagugccagcagcugaacuaagagccccagggagcgugugggacagauggggagccagggaggggcgcuuucauaugugacuaaggcacagaagagaugggccaggggccagaugggguagaacaccaggcccuguguggauaggggccccgagaggagucugggaccauuccccccaccucccagcuccccacuguguggccaccccucccggucucccugccggacugccuucccccagaagcuggucugaaacguggagacucagaccuuuccccugaaacgggagggagaagccccaaagagagagaggacccagcaucagccugggaaggagggcugggagccccugagcccugaagcagccaggaagcaagggcucugcccaaagcuaucgaggaaggacccaagugagccggcagugcgggcugugggcuguccuugguaggccagggggaaggggcaugaggcaggcagagguguggccacgacagguggggauacccaggggcccagaagccccugcuucaacagaagcggugcccaggggcccugaaugcccuuccuggguggggccugugacuccuggugucuggcucugauccuugcagcaugccacagaggccugggucaggaggggaggaccacagagcgcccacauccccacuccugcccggggugaggugaaucuagcacuggacaaagguggacaggggagggaugcaggcgggaagagcccaggucagacaggguauugcacggugugugggggagccacggcuugccgaccucagccugagagucucgcggggaggaggggcuagaaggcugcagccgcugguccacacacaagcauuggggccugggugcggcuggucccagcaugcccccagcacaggacgggcagcaggggcauaagccuugcucccaguguccucugcccucgcccgggcagugcaggcugggccauguauaaauauuccugaaggcccaugggcgagccuggcugucccccguuccucuggaagugacaugugaguguuucugguccaauaaauaaaggcggcgugagcacugugccagcugccuccuggccugguggugaggcuggagguggggcacagccugaccguggcuauggcgccagcacuuccgccacugcagcccgcaccuagaauucaucaucagagcugagcaggagagucuucucguugucgcgggcgccacugaggcugugggagcgggagaggccgugggcgccaccacgccaggugggcccaggcuccaggguggacugcugcguguacugcugguaggcaggugagaaguuguggauggcguccugcacgaugucgugcggguucauggucuccuugaggcugcuggagaugcucuucaugggggcacagcggccugccgggcagggagcgggaggggcaggugaggaggcugggacggugagagggagguggcucagccccugcccgugauccugggacagacaccccccaacccaaagcuaugcccuucaaccaucccuucugggacagagaaugggguccaggauaugagaaggggcaggaaaaaauggacuucuuuggcuggggagccccaaggggaggcuggacugugaagaggagcagacauaaacccccacugggagcugggcuggcugcagggaagggacccaggguggagacuggcaagcuaugggcagugagccuagaaugccccagagaggccagagcaggcucagcacugacugaaguuggggcauguggggccagagggccuggaagccaggggugcccgguuccacaggugccaggcgcgucccccaccaccgggggaagugcugugcucccucuacucuggagaucaggaccaggcuggccugcacccccaggggagcagaugcgacucacuggcucccucuaagagggcuuccuccucaucucucuaaucaacuguccccauccucaggggcucagagcagaaagguggcccaggacaccuggauguaagggacgagcccaccccuggaacccaggauuccugacucagcuugugaacucuuggaaacaucgugaaaugccccgauaucccaugaacagcacugugcccccagaagaaggcggggcauauuccagaacgagaaacgaggacggaagcaggcaagcucuacagaggguggcccuugacaggugcucugggcgcucccacccagggggugccgguggggaggagaugaggacacggagaagagcuacagagagacgcaugccagugacagugaccagaacugacaugcaggacagacaugcagaccaagagcgggaccuaccguaagggccguauguuggcacugcccgcggccaaaccccgggcaaaagcagggcaaggggggcggggagagaagccaaagaaauagagaagacaagagacagcugagugaacaaugugugcccaccaccgaggcccaccagcacgacacaccacacacccuguccccacccccccaggccccacagggcacccaggaagcuccaggugccuccuggggccuggcaggggggauauccaccuagggaugacuccuccccugguguucacgccaacaggaaacauccgucuggcgacugaguuccgccuccacgucuaggucaggacgucccauccccacuucuuccccggcuagccuggggccacauccacaccucacauuuuacaaaccucacaacacuucccagaccaggacauggaggcucagagggagggguuacaaucgcacagcugagccagcucugcaccuaagccuauccugagggcugagggucugggccuggguuagaggguagcagggggcucaggaccaguggggaggcagaagagggcaagcagcuuccccggccgggcguggguaugucuagagggacagcucaggccaggcagcagagccccucugcugagccccaguggugcaggaaugguucucugccaugggcccccuugcuccuugggguggccccaggccccaggcccaaggaugauguucccacgggcacaggguauaccacaccagguccaagggacacugcccucaaugcuggguguguguuugcuagauccuuccaacugggccaccagguggcaaccccuggccuuugugcaccugcucuuugggcacagaguaggucuucccccaccagggaaggcacagaggaaggggggcgggaagugggccgcggagccccgcugcaggcagacauuucuacaguccacaccacccaccacggagccuguguggggccugcagguaggcccuggggaaguggguuucuugccuccagccacucgggcagacagcuggcagcagccaggcuccuggguggaugugucagagaaggaggcuccccucuccccagucccuccugccccuuuacuggcucaaucagucucaggcauucccagccuccucuuccccauccuccaaggacaacccccuucugcccaguggccagaggcagcccuuccagcccaguggagcgucccgggcagcagcacuuucacaucacccugggagugcuuaaagcacagaacucucacagcacacccagccugccagcccggacccauuacagcgggaucuccgaggguggggcuggguaucagcacuuccaaaagcucuccagggcauuuuccaguacaacuggggcuacuuaccacuguucuagcaaggaggaagauucgcagguguaaaagaaagcuguuaaaaccuauuaccauccgagucuguuucucagaaguauucuuuuuuuucuuucuuucuuuuuuuugagacggagucuugcucugucacccaggcuggagugcaauggcacaaucucgcucacugcaagcuccgccuccuggauucacaccauucuccugccucagccucccgaguagcucggacuacaagcacccgccaccacgcccggcuaauuuuuuguauuuuuaguagagacaggguuucaccguguuagccaggauggucucgaucuccugaccuugugauccacccgccucggccucccaaagugcugggauuauaggcgugagccaccgugcccggccagaaguauccuuuuuuuaaaaaauagcauaugagaugagggaauuacaggacaaaaugguaaccacaguguugggaguuagaagcccgagggaauuugucuauucauuacagucucugucuguaucagcccuggaccgccacacuuggaccugcugcaagggacagguggccugagcuuccaggaccgaaucggucgugcugguggcaccugcucuuccccgaccucuguggccccauuccugcauauagaguggggaucccauguccugacccagccgcaccuguaggaugcugggaggugggaggguccugggauguuuggggcucccugcuucucccagcgggggucgccuaggacccuggcucauaccuugugcguccagccucuugucagcauagaccuuguaggugaaggcgugccgcagggccagggcugcaaagaacaucuccacacagaugaugaaguccugguagccggcagccacggugcccucgcccaccgacacgcgggccgaguggauuuuggggauggccccacacuucuccaggauggccaggagcaugccuggauggggaggcacgggugucuggacccagaaugauuccuuuccugcucccccuucuuccacaaugccccauucagcugcccacaugccccagugaggaugugagcagggccacagcugcuccugcagggcagggguagcgacacaaggccacagccuccggaaaccccacucucccagcucuuugccaccgaaacugagaugccagcaauuacgcagggucuccugggcccucucauccauguagcggccccaccaaagcucucccuagccccugggaaaggcccucgagggcucagauuucacccccagcaagugcccagugggcugaggccccucugaacaggcccuacaggcaccagggaccauaagcagaaggggcagcaggaagcgcagaggacaggguggcaugggcagccuccaggugcugggagggggcucaccuugccagaaggaaagaaagaugacggacuugaccaugaagaacuugaggacggggcuguaggggcugagcagcucccggguggcgaaguagaagaggaagagggcguagagggccaggcugacggagauguuguagaugauggucacguagagguagccacuggugacgcugcgggacggggagcauuuucuggcugggacagacccuuggagggaaggggcucuccucgacugcaccacacacaguccccauggcucucagccccacaccuccagcagagcucaacgagccacugaaggggucagaaugggugaucaaagcgacagacagggguggggguacauggggugcgccugcaggccagaccagcucuacugccucugcguggcucguggacuugucuaagcccuggugcccacacuccuaacguuggacaccaguguggaagccagggccgggcccgaggccauagccugacacucagauaacaggcgucaaaauaggugacgcugcucagcucugcugccuuuucacucggucggcugcaucccccugaccuccuuuugcccaccugcccuggcagggcuguuacacaguucacagacagugugugccgagagcuugaaagcacagggcuagacacauggucacuuuuuuuuuuuuuuuuuuuagauauggaguuuuguucuugucacccaggcuagagugcaauggcgugaucuuggcucaccgcaaccucugccuccuggguucaagcgauucuccugccucagccucccgaguagcugggauuauaggcacccgucaccacgcccgguuaauuuuuuguauuuuuaguagugaugggguuucaccauguuggccaggcuggucuugaacuccugaccucaggugaucuacccgcguuggccucccaaagugcuaggauuacaggcgugaaccacugugcccagccacggggucacuuucacuaagcccagaaugaaauggguguggacaauuuacacagcacgggcuuuguaucuguggacuugagccgaccucuuggggcucugacccucucgcucccugccucagcaguggucacugucccuuuguggcccaucccuucaugguaccacucugcagccuggacaugaacgugacugcugccaauggcucacuccggggcuggcagcggggccaacugcaaggguguccacugcugggcucagacuucagggggguugugagcaccagacacccaggaaggucauggcugugcggccacucuggcugcccccuucccugagccaaggcaccagccugcgccaacacuccucccacacaccccggggagcacccgcugcuuacucaaaguccccaucccgguacuugccgaaggccuggaggaccacagugcugaccgccaugaguggcuucaccacacagaacugcaggguggccuguuggggggaaaaggagguugaguguggaggaggagcacagaaggcaugaagcaagcccugccucuggcagacggaacuguaccggauggagggacagagaggaugaaggagacggagaggacggagggauggagggacggaggggauggagggacgaagggauggaggggauggaaggauagaggagauggaggagaugggggguggcuacguguccugcucccaggggacugcugucugcgcggggcggggggcagaacauauaggagaugcagccagcgcaaugccguaugugauaugagcauguggaggaagggagggaggaagggaggaaugguguggcagggcacgauggaggcgggagacaggagaugcacacaaggaagcuucucgagccaggaccaucaggugggugccggagaugagaggcucgacaggcagagggggcagcuugcaccaaggccccgaggcagaggguggacaggugcaaggggcugcgcacuagagagguggcugaggagauggcagggccagguccuggagaccuuggugcccggggcaaggcuagggcccugcucaaggaaccagccaccgggaagccggcgcaggugagggccuccucccauccuccauguccacccccgaucugguuccuagcccuacucucugggccuggguccaggguuucuggucagcagaggucacucuggggauggaggugaccugcaggagcccagagcacguggacuccagagucucaaaaucugaguuugaacucuggggacagcuugggcagacacuuggccucugagcacagacucccugaugaaaaggauguagucacuccccacaccacagggccacugcugcggggauggcacagccaggaagcgcagcaucuucucgggagucucccgccucuguacaugcacuaacggcgccugcuagcuggcugagccacggaaagaguuccucagccagguuuucccgauucccuacgggcggacccauggugcccauaacaucacuaguaucaccauuaucuagaaagcaaauaaaucuaagcccuaagaccccuucugaggagcugggggagguuaaauccaauccaaaaggcucaacuaguguagcugcaaagaggacgaggagccuggagugggaaccgugauccgugaaaccugcagcuucugccccaacuggggaucugagugggucuugcaggggagccccaggcagcccacaccauggggcugccauacggagaggcccgcgugauggggcagacgugcagucccacucucagaaagccccacagaacgucccuggcccugucaucccgccuagagaagugggacuggcaccuucuggggaaaagggaagaacggcaguuugcaugaguuccaguuaugagccuagcaacaggcugguguuucccugggucagcucaccugguacucaugacagcccccugacgugggugcugucauuauccccaugguacaggugaggaaacugaggcagagagaagcugaagcagcagcagcagcagcagcagagcccaggccagcaggccccagaaucaucaccugaccauacccuggaccagucagcaguucccaggcugggcuggacaucagaacccccagggagcuuuagacaugugccagguuccagggcuccauuccagaacuucuccuaugggcuaggguagugggugguugaucugggaaucucuacuuuaaguagggaaucucuccagaaggucuggauauugagcacuggcccugaggagucaaaggccugucucugugccucuaggacaaagcuguggggugugcucucucgcccugguaaagaaaggaagaggccucuuuuguucucuuucuucuuauaucucucccugccaccgccaggaacaagaacagaacaucugagcccacagggcuggggaauaauuucuaacaaggccacacuagcuaacaaucaugaaaucaaaauuuuguagacaauauaaucaucaaacaaggcagugagucacagcuggccggaaccuggguggcugcaccaacugguaaacaauggcucucaaugccccacccugaacccaggauaguuuuaacucuuucccugcagguccaguggugagauucugaauuuaggaacaugcuagggaaggaaggucuggaagcagaacuggagacuuggcauguucagguggaggcuuugugggugugcccgcccuguggccugggcccugcacagaagggagcagcaggccccgcccuccagggccaucgugacuuggcuguggguuucauguacuuucgugacuacucuuggcgaagcuggaggggcugacaugacagagccccuacggagccccagaggagacuaacgcaaggucaugaagagugggcgugauccccucagacucugccucccugaacaggaggccgugggcuccaccacgccgggcugaaagcucuacauccaugaccucaucugauccucacaaccaucucuagagaggaguaucauuacacucauuuuacaguggaggaaacuaaagcucagagaggguaagccaauuauccaaggucacagagucagaggaaaagcuggaaaucaggcucagauggucagacacccaggcccacacacugagcgaccccaccacacugcccccacccaggcuacucuagaccacagggaggucagcccaggaagcuagagcagcuggauugccaaggcuacucuagaccacagggaggucagcccaggaagcuagaguggcuggauugccaaggcuacucuagaccacagggaggccagcccaggaagcuagagcggcuggauugccaaggcuacucuagaccacagggaggucagcccaggaagcuagagcggcuggauugccaaggcuacucuagaccacagggaggucagcccaggaagcuagagcggcuggauugccaaggcuacucuagaccacagggaggucagcccaggaagcuagagcggcuggauugccaaggcuacucuagaccacagggaggccagcccaggaagcuagagcggcuggauugccaaggcuacucuagaccacagggaggucagcccaggaagcuagagcggcuggauugccaaggcuacucuagaccacagggaggccagcccaggaagcuagagcggcuggauugccaaggcuacucuagaccacagggaggucagcccaggaagcuagagcggcuggauugccaaggcuacucuagaccacagggaggccagcccaggaagcuagagcggcuggacugccaaggcuacucuagaccacagggaagucagcccaggaagcuagagcggcuggauugccaaccaggaaaugcagggagagacgaagagacggcagaggccuguucuggcgugugucuuuaaugccaaaacccuccugcccccuagcugcagcugaugagaaguuuucaaauggagguucuagaauccccacgcacuucuucugauuuucacacacacugagacuuggucacacgagcaagagucugggaucagcucuugcccacagugcaacagacacucccaggaugucggucgcugccccuccaagcacacccugcuaaugugguaucugccuaacagcuucggggggugggugcugggggccuggggugccucauaggaaaggggaccucuaagguggggcccagggcagcccacggcagggccucccagaccccgcccugcuccuccugagcuaggcagcugcugggggcacacaccuguuugcagaaccucagaaauccgauggaauaagucuuuccccagaggcagcaggugccauacauacagcuggaccuggaagagacaagcauagcaggcaguggcagugagugaagagccaggacuugggaacagugggguggggaaggccgcccucccacccauccagacgagcuggggcacacauucugggcagacuuugaacccgaggccaagcacagggagaggcauggcagggcauccgcacaugccauaggcggagggacacagggcugcacuggcccuggggugacaaaccaacuuggagagcucugaauguaaaaacugcaggaggcagaaacagacaggaaagcacuaagacugagacaggaagagacagagagagaaagacugagccgcagaggcccuccuaaaacgcccagaagaauggcguugcucaggaaauguggugaggcacagcaggucaaggucacgggcagacauggucuguguccagcuggugccaggacggcucgagguacaccaggcccaggaaacggggugguuuagggcucugggaagacuccauacucacucaauggguuuuccucugaucuccgacaugauggaacuuucuccuccuagguacucauagcacaggcucaggaaauuauagaugaccaaggcugcgaagagaguguccaggagaaaccagucaaaucagcagaauggguccgcagaugcugggauucuaaacagcaauggaggugaaagagccacagcuguguguggcaacagggaggaggcugggggacauaagguugugcaaaaggagcccgucaagaacacagacaucugaccucccacuccuaaguucaaaacccggcacaccuaaauuaucuuaucccgggaugcaccccugcacuggcguaauacuaugaagggacugucgugaguucaggguuauguggggaggccagaggaggcugagguaaggguggguacucaggagguuugggagggcuggcagugucgacccuggggcgaaacaguauugccuuuauuaguuuuuccgggcgcaguggcaugcgccuguggucccagcuacugcugcggcaggaggacgucuugagucugggaguucugggcuguagugugcuacacugaucuggugucugcaccaagucuggcagcaguacggugaccuccugggagugggggaucaccagguugccgaaggaggggugaaccagcccagguuggaaacagagcaagucaaacuccagagugggaucgcaccucugaacagccacugcacuccagccugggcaacauagcgagaccucaucucuaauguauuuauaaauaaauauuugucuuacauacuuguguguuacaggucacaauuuuauaagauaacaacaaaacagucucugugaaaaucuugggagaaauuccaagcaggagugagagggaagaaccuucauccagucaacaaccuguagcgguauccggaauacgcacagcacuaugagcuacaacaaagcacacggcagcacacagaacacaguaaaaaccuugggaagcuugggcugcucauucuaaauugggacucggcucaacaucuccacaaagacccaaaauuugccaccgggagugauggcacagcaagucugcuguaaauguugaugcuauaaauacagcaacacgcuguaacgggucuccuggucaggugguuccuucugggucagcaaaaugaaggcugcugccugcagggugcuagaggcaaauggacaugccaggauggaggagaguguggagaaggcgggggaaggggugcagcagacgguacccaaaaugaaagaacgcaagaggaagagccagggugaggacaugggaaugaggaugggcauccaguaaaggcacaaggccaaggggaggggcagaacagggucagaacaggucgagggagccacgguggcccuccagccagagggcuucuucucaucugaccccgccagccccugcaguacagaguccuuuuaggcucccuggugccgcccagcuuggcacuugaucuuucaaugggugaccuggucccugcccaagcucccgccacucccgagcagcacuaaugcugcacuucuccccagagcagguucucuuauccuucggugcuucugcacucccagaucccagagguucuagcacccuucccgcuguacucucaggauccaucaaccccagcugggauggcacccagugugacaaguccccggugaccaucguggaggugagugcccuccuacccacggaaccugauuugcagacacuucccacccugugucacaaugacuggucucccccucucgccuuccucaggacacaggugccacucauggcacacacggggcacaccacaacaguuucacugacugaacuggagcguggaaagcccuggugauguuuuuuaggcaaagcuggccuucagcgauuuggaaaggaacacauuugcggcauuuuaugcuacucacgguugcccuaauccauuaagggcucccaucuccagguggcauccccauguauaugucccccagcacugaccacgccuuguugugacugucccuucacccuucacacacauacagcagagguaugcgaugugugugagccucuuuggguucaguuuccucaucuaucaaaggggaucacaggagcaccaacuuggcagguggcugugaggcgugagcaugaaaguguucagaaguguguccggggcucacugcgcuggguguuggcugucacgaccauuaccgucuaucugcugccugcagggccaggagccccuagacagggcugagggcuguguguacugccugccugugcuggaggcagcucaggaugucucaggacagacaagucuccaccaaucuccagaugacucuucaccagcaagaacuauggggcaaagggaaaggggugggcauuaagccaaaccugaugucagccugccaguaaccucuguucaaaaccucacaaggccaagcacaaugaccguguccauucuaagccggguccagcuauaucaugaugguuguauuuuuuuuuguuguuuuuguuuuuuguuuuugcuuuuuuugagacagagucucgcucuauccccuaggcuggagugcaguggcacgaucuuggcucacugcaaccuccaccucuaggguucaagugguucuccugucucagccucuggaguaacugggauuacaggcgcacaccaccacacccagcuaauuuuguauuuguaguacagacaggguuuuaccauguuggccaggguggucuugaacuccugaccucaggugauccgcccaccucggccucccaaagugcugagaugacaggcgugagccaccgcgcccggccgacgguugcauuuucuagacugccacaccucgugaugcugacaccccuccucugagagguggggucuuguucccucccuuuguaucugguggcccugaguaaccacagccaaagugauguuuugugacaucugauguagggguuggaagaggccucuuuccucuggcucuuuuucccuugaaugccuguccuugcacucagucaccaugcagcggggaagcacgagcuagccuuuggagacaccgcacagagaggcucaugugagggaaccgaggccuucagcugacagccagcaucaacugccaggcacacaagggagugagccuucaggugauuugccccagccuucacgcucuccugccaaggcccagaggucauggagcagggacaaacuaucuccccugcacccaguccaaauucuugaccuauaauauccaugaagaaacuggaugguuguuuuacacuaguguguuuuggcaguaguuauuugcacagccaugguaaguggaauacagauaaaaccaugacugaagcuccugggacgugcugugaucacucacgccugcaugcaaugguacauucuggucccucugcucaccgcagaggcagaccccacugagaugccgccucuucuguccugcacccugcuuacuucacacaucaccccucucugggcucugccugaucccuccggcacaaaagcaacauuaaguaagguaaagagccaugggcccuggagacagccugccuugguugugaacuguggucccaccucuuaggagcuguguggccucaggcaagugucuuaagcgcuccaugcccgaaucuccucaucuguaagcgggauaacuccucccuugguggggucaggggcugugaacgugcagagccuuagaugagcugagggcacagucaagaguccacgguguguuaccuacugcuuuuuccagacuguaaacuccuugcagguagaaugcaguccuaccuccaaugacuaccggagggccuggcagcuacaaacaugucaucaacacugaaggaaggaauggacagacguacauggaccaucuccccaggggagccugccaugacaacaggcucaggcagggcaggaggggacaccccacucucauuccaacacuggaggagcuccucucagaggcuggccccaagacuaucagcuuuccagucucgaacaacaaaacccuccagggaagccacaggggccccaggcccauaagcccucucuaucuggaagcucccucccgggagagcccaucccugcaguccucucccaagaaaggcuuggcaucugggcucguguccuuuccugcaucaaaacacaugucagcagucagcacacuuuugaauuacguggccgaggucccuccguaaccggcucugcacacaacugaucagaaucaucaaaugucaucaucccucucaguucaagauucuugaccuuuuggaggugcucuggggccagccagucuguaaaguaccaauuugcugacaguucccuuuaaacaaucauuagugagucgauaauggacucccuaauucuuggagaagaugagacagaaucuccucagacgugacgcaaccggcccaagccuggccccacugaccaacuggacacaucagucucccuccuggaaaguacagagccaugugaaacaccaccuccaacaucuuagcaaagguguuuaaaauggaaaacucaacacauccccuggaaacaaauaaaagaugcgugcguggauguaagaagagcggagaagcugagacggggcuggagggaggugcuugaccgggaagcucacugcccaccgcccuucccaccacggcuccaguaccagaccccuggagaggccucggagacacacaaugacucuacaucucccuaaauaucuaccacagcuggugugccaggcucugugcuaagcccucucauaaaugaccaaggagcccucaggccaaguccagagggcagcaaccagcgugagggaccggagggccucucucuccuggccuggacaaucaggcugugucuucucuggaggguuuugucuuuggagacuggaaaguugauggccuuggggccagccucugggaggaacuccuccaucguuggaaugagaguaggcuguccgcuccccacccccaugccccaucuggaacuuucugcuccauucuagacaccacaucucaaacuagagacaaaugcacaguaucaggagagaaggaccaggaugaacacaaaacaaggacugugcuggggacgagaagacaucaggggucacucucuuaauagacgugacaaccaccuucuucccaggggcagaugggacucccaggggcagaucccagaaggacugcagcucaauauacucaauauacgaaaccauuuccuuuuuuuguuuuuuuuuucuugaugcaggaucucacucuguugcccaggcuggagcacacagaugcgaucacggcucaccgcagccuugaccucccaggcucaaucaaucuucccaccucagccuccugaguagcugggacuacaggugugggccaccaugccugccuaauuuguguuuuuuguuuuuuuguaaagacagaguuuuaccauguugcccaggcuggucuugaacuccugggcucaagugauccgcuggucucagccucccaaagugcugggauuaagggcaugagccacugcgccuggccuauaagaaaccauuucuaacgggcagaguccagagguggaagucgugagcuugcugccaacagaagcaaucaggcuggguaaccccucagcagacuuucuaaagcagucccuuccaaacccgaggcuccaggcuucucccucgugacuuuccugucccuuguggauccuguuauuccuguuugucgcccucccaaaugcugcuucugaccucuccucuacuggcuucuucugaauggccuucuuuccuauuggcagcuccuugagccuggguaggaagcuguaggccaagagacugcuccccacccagccucucagcugccccgugaccuaauaaaugcuacaggacccagcaguuguaaggcucuacauguucacauccccccgcaacggccacccucauucccccacaaggaaggaguuauccccgcuuacagauaaggaaauucaggcauggagcaccuaagacacuuaccccaagagcccccgggcuuugagaaaagacucaguacuugcccucucacguuucugcgugcagcucccagggucaggaggcagacacacucauauaacuugcuauaacuucaauacacacucgcugugugccuacugugugccacacacugcgugcgggaccccgaugacccugggcacacugggccauucuaagcucacccccugugcacaccuucagcgccuaaagcuggccucauggcccagccuucugcugcagagaaacacucugguuacuuggaaagacugggggcauucuguauuucagauaacggguggaugagccuggaaaaguuaauuuugcccacuuugggcagaaaucuucucugcucagaaaauaggggccucagaacguucuuaugccucuuuucagugaugggugaucauccuggacaagaaugggcacaguguguugcaaccaagggggcaggggucugcgugguacaagugaccccagacucuaagcugugccaaaugguuccucuucuccucccuacugucuuuuuuuuuuuuuuuuuagacggaguuucgcucuuguugcccaggcuggagagcaauggcaauggcgcgaucucacugcaaccucugccuccuggguucaagcaauucuccugccucagccucccgaguggcuggaaguacaggcaugcgccacacgccuggcuaauuuuguauuuuuaguagagaugggguuucuccauguuggccaggcuggucucgaacucccgaccuuaggugauccaccugccucggccucccaaagugcugggauuacaggugugagccacugcgcccagcccccucgcggcuuuuuuauccucugcugaucaugcuuauuccugcuucuuucugcccugaaugcuguuucugaccucucuucuacuggcuucuucugaaugucuuucugcacuuggaucuaucaacuucuuuuuuuuuuuuuuuuuugagacagagucucucgcugucgcaggccggagugcaguggugcgaucucggcucacugcaaccuccgucuccuggguucaagcgauucuccugccucagccuccugaguagcugggacuacaggcaugcacgaccacgcccagcuaauuuuuguauuuuuaguagagaugggguuucgccauguuggccaggauggucucgaucucuugaccucacaauccgcccaccuuggccucccaaaguggugggauuauaggcgugagccaccgcgccuggccacuaucgaggucuuauaauccuuggcucuaucugcaagagccacagccagccagggaguccuucuggcagcaaacuggccucuggcucuuguguggcccugcaccugcggcccucggcugugcucaccccgguuggacagugaaugaagcaucauucucuguugcugucaugcauucaaaucucuuucccuaacaggaguucacacuuuuccaggggagaaacuuguccuguccucucuuucaccaugcuggcacagagcccuaggauucagagacccagcugcaaguuuggccuuuggccauuacaagaucugggucacucuggacaaguuucagagccuauucaaauuuuuuucacauuuguaaauggggauaauauauauacucugccagguacuugggaggugagaaugagcuaacagugaugaaaaacacgugggaaaacugugaaaugccacgcaaacauuccuaacaaacagcaacugcauaaagcgacauacggacaccgccuccugccucugaaccccaaggcccugugccucugaucacagaacuccccagcacugucucagaguugucuuuauggcccacccccaaccccacaaucaaacacugaaugcauauggggggugguucccacccugcccccaucugccugccccuccacacccucuggugacacaugccagcacuaugaauuccagcccucgcagaugguacguggcacuaagcccucuuccaagacucagcccucucuuugagaacaggaagcacuagucacaggguucacaggcuaaacacacacuuaucuccacuaucccccuccucgcccuccuaacgccacugaaaugagaaggaaugagggugggguggggagcaaaccuucaaggacaagaggaguggcaacagccaagcgacaucaacaaagcucugaacgccacaugcccaccgcuccauggucaccgaguggcggaugguugggggugggggugggagucagagcccuaggaaaaaucagcacugcacaugccaggcagcucugguggcugugggugagggugcagacgcagaagcugguuaaaagucuccacguggagccacugcauuacaaguuucaacagaggcugagacagcucuauccucagaacacgguccagcugagggcaguaaugggacaacuuggagaaaauccaaagacuaagccugaauacgaagggcgagagguccucucagaucucugccacgcuguaccagucacucagccugugcaguguuuugaggcaggagaugaaaaauuauucucuacagaaacaggucccagaauuuaaaaaggcuucauuugguaccugccccccaugcugcauacaaacagccaaggaaacaccccauguuccaucacccaaucaggagguccagcaauuuuuuuuuuuucuggggcggguagagaugaggucgaggucucgcucaguugcccaggcuggagugcaguggcacgaucacagcucacugcagccucaaacuccugggcucaagccauccucccgccucagccuccugaguugcugguauuuuaagcccuucuuauauauaaaaaauagccaaggauacugauauuugaggagcgcuucuaacaagaaggucaaagaccaaagcgaccaaacagaagaaaggaauucaagagauagagacaauguagggaacagaagaaaacugcaaugaccauccccagagaccaaaaaacaauacucucucacguaccaagaacaaggcaucauaaagaaaaagaauggagagagcuacugacauucuaaaacaugauaaaggaacuaaaacauucaacagaaaagcucaaagguaagauuaaaaaaacaaacaaucaaaaacaaaaaacaaaacaaaacaaaguucauggaaaacaguaccaaaaaagagccagaaaauuauaaagaaaaucugaggcucaauccagaagcgcgagguccuacuagcaggaauuccagaaagggagauuggaagaaaguggaggggaagaaaugaucaaagaaacauacagaaagacuucccagaaccuuaaggcaggagcauccacacuggaagggcccgccagguugccgagcacaaugacuaucccaccuccugugagauuucaggacacuggggauuaagacaagauccuaaaugcaaagaggagagggggggaaaaaaaggcaaaaaaaaaaaaaaaaaaaaaaagcacaagcaggucacacacacauacaggcacuagggaucaaauacagcagacuuuccagaaauuacaucagaaucuaagacagugaagacaugccuucaaaauucaaagggagaaggauuuccaacuuaggauuguauuucccuugaauaccaaucaaauacaacaauauacuaaagauauuuucagauuccacaaaauagaccucccaugcacucucuuucucaggaagcugcuggaagacgugcuccaaccaggcagggagagcaaaccaugaacaaggaggaaacagccuccacggaacaggugacucagcacaggagaagcgguuuccaggcuuauggugaaugaaagagccagggcaacagcugagcagcgggagccuggaaagcaggcauuccugacugcagcacagggagaaggcaccaggagaagcgucacggggaaaauggcagagcucagggauuccuggauuggccuggcuuuacugagagcagggcugguugguugguuuguuuuguuuuguuuuuuaaauucaacugaaguauuuaggaauaaacuagugauagguauauguagaaaacucagcaaacuaaaagaaggcaaguaguaacuggagcaaaaacaaaaaguuacauaagaaaaggaaaugcauuggaugcaguggcucaugccuauaaucccggcacuuugggaggucgaggcgcaaggaucauuugagcccaggaguucaagaccacccugggcaacacagugagaccucaucucuacaaaaaaaaaaaaaaaaaaauuagcggggcauggugguggcacacgccugugucugucagaacaagaccugucucuucagugccaggcacggugcucaugccuguaauaccagcacuuugggaggccgaggcagguggaucacaagaucaggagaucgagaccauccuggcuaacaccaugaaacccuaucucuacuaaaaauacaaaaaauuagccaggugugguggcgggcgccuguagucccagcuacucaggaggcugaggcaggagaauggcgugaacccaggagacagaguuugcagugagccgagguggcgucacugcacuccggccugggugacagagcgagacuccgucucaaaaaaaaaaaaaaaaaaaaaaaagaacgagaccugucucuuaaacaaagcccuuccauaguaggaagucaccauguaacaucauauaaaacugaaaaacaaacaacaacaaaaaccaguacaagcauauuuuaggucauucuaggaagaaaacagcugaaagaguugaaaguacagugaacuucagagugaggaguuaggggaguuucguguuucaaccauaugccuauauuacuuuaauaaauguaauuuuuuuuaguguuuuuuaaaagcagaauuuuguuaacaaagaaaaaaagcagggccaggcuugguggcucacgccuguaaucccagcacuuugggaggccaaggcgggcggauugccugagcucaggaguucaagaccagccuaggcaacacggugaaaccccgucucuacuaaaauacaaaaaaaaaaaaaaaauuagccgggcgugaaggcgugugccuguagucccagcuacucgagaggcugaggcaggagaauugcuugaacccaggaggaggagguugcagugagccaagauugcaccauugcacuccagccugggcgacagagcgagacuccgucucuaaaaaaaaaagaaaaaaagcaaaugaccguagugcucagcucugagcagguccucaggaagggcuggcuggaucugcagaguucuccagcccaggugaaucccacucccuccugggcccuccuggccccucuugggcacugagaaggaagggugagaggggaaauacaaggaucgggggggacugccccaucacugacucugcagaggcagcugcaagagaggggcuaggacccagagcaguggugcagggacaaggcaaggagcaggccccgcugccucugaugcuaaaagcuggugaacuuggccaggcacgguggcucacaucuguaaucccaccacuuugggaggccaaggcgggcagaucacaaggucaagagaucaagaccauccuggccaacauggugaaaccccgucucuacuaaaaauacaaaaauuagcugggcgugguagcacacgccuguagucccagcuacucgggaggcugaggcaggggaaucacuugaaccuaggagguggagaaugcagugagcugagauugccccacugcacuccagccuggcaacggucucaaaaaaaaaaaaaaaaaaaagcuggugaacucgggggcagccugaacuucacugcagcugcuguacuguuuguaaacucccugggagaggccaggccaaagggauaaucgcguugcuaggagaugugcuucacaggguggccgacuuccuggaggaccucuccccgggcagggaggcaggucagggcaggcggggccugaacaaagaggcuucuggagugaggggugcccgccagccaucugcugccgccucuggggcacggagugagagugaagcggaggcuccccuggcugugugccccgccuucugccaugcgccugucuuuggggucccgccgagaagagagcccacacuugucccccgaccacacaggagaggccaccuuggcagggaacagcuuugugcuucugaaggaacaggugggcagaggcugccccuggguacccaugcgaggcuggcagcugaauggaaguggauucucagccccacacuucgccaauuccagccuuuauggugccccagggacccagagguuucccuggagacuuggcugcuuccagaaauaucagacaccagagccccaguuaagcccugagcagguccccaucuggccucaguauucucaucuggaaggacaggauggaacgccagccugcgaggagggagcaugggauguuacugaggccccacauggaggaaugcaaggcacagggcagggguuugauuaagucccuuauucauccaaaagggaggaaguaggcaucucccaugggcccggcucugucugggcauggcugcaccccauccugcucuggcagggcuaaucaugcucaggaagauggaacacgaagcaagggagcugcagacugugguggggccgaggaccuggaugggugcugggagugagaguggcggggaacagacggauggaaaggagggaccccacgcagagcagaagagcuucccaggccggggacacagcacguaucaagcccuugaggcugggaagcaccugccugauguggccgcaguugggggugggaaggcagaaauaugaaaggcuggggugcaaugggcuccuguugggcgccuccauuuucuugccaaaccuaaaggcauuuccugugcccuaugaguucucagggauacacaaguuucaacguggagaggaagagagacuccagcugcuugggggaugagcaugcuucacuccaauauccacagagugcaggccuggggcagcacccucccaggucaaggaaacagacaacuucugggcauggccagagcugcucugccugagauuaggaaaaccacauccggucacuuuaccuaaaaccagcagcacagguguggguaggagacaggaaaccucacacucugagaauagcauggguaucaauguaggggucuuuuuuuuuuuuugagacagaguuucgcucuuguugcccaggcuggagugcaauggcacgaccucagcucaccacaaccucugccucccagguucaagugauucuccugccucagccuccugaguagcuggaauuacaggcaugcaccauuaugcccggauaauuuuguauuuuuaguagagacgggguuucuccauguuggucaggcuggucucgaacucccgacuucaggugaucugcccgccucggccucccaaaguaaugggauuucaggcgugagccacugcacccagcccaaugcaggggucuugaggaaccccuccucuccauuccugcuggccugucuagggcagaccugggcauugcuggccucuaacagaugaggaaugccugggaccugcccaagacaggucagaggccagcucccaugagagcagcauccuggucuccuuguggugacuguuuaggggccacagccucccgcagggcagcaggggugaggcuggcuucuccucuuggcaacccagcuccuggccuguggucggagcucaggaugggagcaggugaugucuccacuccacauccagaaccaaguccccggaaggaaucgagucuucuuccuggguggcacaguagggcacccacucgugggacaaagcccucagaauuaagacccauggggacagagccccagcccugccacugacuugccagggaucccuggaagggucccuacccaacugcaccuggggccaccuggggucucuacaaacagaccacuugcuugcugcccccacccugccugagacgccagcauugagaagcgagacccagggggagggcccuugcuuccagguaccugccugagacgccagcauugagaagcgagacccagguggagggcccuugcuuccagguaccugccugagacgccagcauugagaagcgagacccagggggagggcccuugcuuccagguaccugccugagacgccagcacuaagaagcgagacccagggggagggcccuugcuuccagguaccugucugagacgccagcacuaagaagcgagacccagggggagggcccuugcuuccagguaccugccugagacgccagcauugagaagcgagacccagguggagggcccuugcuuccagguaccugccugagacgccagcauugagaagcgagacccagguggaggguccuugcuuccagguaccugccugagacgccagcauugagaagcgagacccagguggagggcccuugcuuccagguaccugugaggugagacucuagcugcaugugcuguuaccugucaauuugggacagaaacccuguaguagguaaagcagcaaggggugugucaagacaguccucaugaagccccucggggaggaauguggggacaggggcucccagccccccagccccccgccagcccuccccacuccguccccauccucacccucauagcagucgcggacggugccgaaguacacguaguacuggucguuggugaagaagaggaggcugagccaggagucaaaggcguagaugggcacgaugaagaggaugcgcacgauguagcgcugcucguuggggcagcuguagcagcgcaggugcauguagaucugggggcagagguguggggucagcuggggacccuccuguccacagggacgggagggcaggugggcuuccagcucugccaccgacucaucugugacccgaugcacgugaccuaccccugagccucagagcccugcucugcaaaaugcgggaugacaggacuugccucccaaggccauugugagacucagaccagcgggcgugcacaaggcucguggagugcaugcagcagugccuguggggcagucuugcaggugcagguggcagugagcccacaccccugcccacaggaaggccaaggaugaggauggaaaugcaguuuccacaagcuccccaggggaccucacgcacuggcagcucugggccaucagugugugcccuuucccucuaccucacuccggcugugacuguggcagcacugagcuaaaucacugccaccuggguugcagccuugccccgucccuuaacuuauggcaagacagacgcagcccucacgcuauggcggguggacacacuuccuggccgaguggcugcagggauguccucagguugugccuccuccucccaucugguaaacagaggcagcaccacugcugcucuguuuaguuaggcagcuaccucaccaggaaguuaggagaaugaaugcuacuuuuaggaagcagaggaaaaaaguaaaagcuacacacaaaugccaagagcugcucuaccacaguccucaguccaggcagccccugggugucucgucccagcucucaugacaucacacuuggcccagccgagcccugggcuggggaggaaaagaacaaaauauucuccaucugcuaugagccaaaagccuuggacgcaaauggguucuaaaagggauggggacacagggcagcuggcaaggggcugacuagggaacacgagcagacucacccugccccucuccacuggaccaccuucaaaccucugcagccaccaaggcccgucccagcccacaucagccuccucuggggccacaaguacaggcagacgggagacuugacuucuaucccacucuaccaccaacuuccaagugaccaggcuaguuccucucccccucccucucaggcucuccauuuucucaucugcaaagcggucccugucccugugcuccugcaguucuaggcucucuguuguuuaggcuggacacgagacuaguuccagccaauggaaggugaacagagugacgagugucaccucuggcuggaggugguuaaauauacagagugccuucgcacauucccugcugcuaggugucagaugggcgaggcuugaagccagagccacacgucggaaccugcgcugcacugggcccugggacgcaggcaagaaagcgacuucuuggcgcacgccuguagucacagcuacucaggaggcugaggcaggagaauuguuccaacccacgagacagagguugcagugagccaagaucgcaccacuguacuccagccugggugacagagugagacucugucucaaaaaacaaacaaacaaacaagaaguagacuucuaucgagggaagccucugagaacagagggcuuaccuacuacugcagugcagccuggccuagccuagccuaacccacacucuguucagccaggaaccuuucuggaccuuucuagaggccccuugccaggcuuggguaccugguggcaugugaugagcagggccguccacacgaagaagccagagauggccugagcggcaguugucaucaggaacacaggcugcuccauggcaguggggcugcccucggggaucacggagacgcugggcgaggcugcugcggucgugggcgacgcuggauccggggccagcacauccccccucacugucauggugccuggcagcaggaggcucccugagggaaaccuuugcagaaagugacaagcuagccuagagagaagaaauugcaaugugagucuccucccagggcaaguggcagcauuggaaagaaucuuccaggucucuccacccaccuccugaccaugucuguauugaccccaaccaucacccugucccagccagccucuccccuggauugaugcaacaggccccugaccaguuucucugcuucugccccugccucuaaugaccaguccccacucagcauguuugugagucuuccaaggauuagccagaccaggccgccacugcucaaaacucuccaauagcucccagcuccccuagaguaaaaaccauaguccguacccaaggacucgaugggaccuccuguccucuaugaucucagcuccuacaguucccacuuccauccucagcugcagccacgcuggccucuuugcuguuccuugaacauauuaagccugcuucugccacagggccuuugcacuggcugucucugcucagucaaauaccucccucccacccuuccuuuaggucucuaccuugaccaccaugaaaacaugucagccucucccaggcugggcaugccugacucccugcuuuccuuucuuuuccuccagagcacucauuacaucgacaccacccgacuaacucgauucacucauguauuuauuaacuguuccccccaccccaccuagaaugcaggcccccuggggacagcggcucuguuugggacuauacaggcagcacugggaaccguggacacacaacagaaauucgggagcuuccuggugggccugaacaucuuuauacccuggagccaguaaaaccacuuuacugcugaggccuccuccgagggccugugugcguucuucgccauuucucccccuuuccuuaauggcugacccacuccccaucauccagcugugcuguuuuggagacucuguggcuccuccccaaucuguguaccucuaaacucucaucuuuuaacccagcccaugugccaccccuccugaaagccugccugcacaccuucuccaguucugagacuucuagccauuccgcauccucgaacacgcgggucugucaccacucacauguucauccuccugccuacucuuugaggcaagaucucacacccccagcccacuuacaauacuuaacuugauuauuauuauuuugacacagggucucgcucuguugcccaggcuagagugcaauggugcaaucucggcucccugcggcuuccgccucccgggcucaagaauccuccugccuuagccuccugaguagcugggauuacaggcgugcgucaucaagccuggcuaauuuucuaauuuuuuguagagaugggggucucccuaugcugcccagguuggucuugaacuccuggccucaagcaauucuccugucucauccucccaaaaugcugggauuauaggcgugagucacugugccuggccuaucuacugauuuucacugcuuguuuccaaagaucgugaggugccucacagugaaacaaagaauaguggguggggcccucaugaaugagauuagugcccucauaaaaggaaccccagagagcugccaugccccuucuaccacaugaggacacagggagaaggcaccgucucugagccaaaaagugagccuucuccacacacugaaucugccagcaccuugaucuuggacuucccagccuccagaacugugaggaaggaggcagucgauuuaugggauuuugucauaguggcucaagaagacuaaggcaggagccuggcugcacccucuacccaagcccugauggggcggcccuuucaguacagccaccugcugacaggcuggucagugccauccagcaaacaccucugcccaaaucaccaacucuggcaauaaccugcaaugcaaccagagaaacacccgacaauuuuaaaagaugcaaagugcaguauguaggcacugaggaaagagccuggcuggagcgugagcaccagcucccccgccaaccagccacguggguucccugcuccaaaaaugagcucagagaaugagcgaacaccaaccccgaccgucucggucugaacccagaggucaaccuagaugaucucauggucccuuccaaauucgcaagcugguauucaagucagaauauccugacaccaacggagguuucccugggccuuccugggugcggcggccugcagccuggccccgcgaugcagaggauccugcgcccgcugucugucugcacugcccgccugcaccccggcuccucgccaacggccgcagcaucuccgccaccaugucggcucuuagcuguaagugugcacccuaggagagcccuguacauuucuauuuucccacauauacaugaucucuuaacacaccaauugagacacaaaucgagacuaaaacucaaaacuggagaaggcgucuauauaaagaaauucaaaaauggagaaggugucuauauaaagacugguggcaagcuuugaaaaagagacacagugacaaguccaagaauagcuccuguaaguaugguugcaaaacugaaaaccagugccagaaauauuucuugaaaaagacugggguuguaaaucaucaucuuugucuaucaucccaaauuaaaugaauaaacauggggaauuguggggggaccaaaggaaguacaaauacgcucaaaucuucaccuuccaagcaagguguggggggaugucgaaggcuguuuuguucaugacuaagggcgguguugagaaacccccagcuuggacucccaggcagaggggcaaccccagagagcagacccgagccagggcugggaugugggugaaggcuacaggccagcuuccuccugcggcucugcccacucacgugcccaugcccacuuggcauucagggccccuucacguucuucauauaggucguuuauuucacaagaggaaaugcacccagagaugugagugacuuacccccaaaucagagccaggacucaaggccagguccuaucaacacguugucuccucaccuccuacaaaguggggggaccuagcugagccaccccuccugcuccagagccuccuaacaagacauggccauacccuuccucccauagccuccagacucuucuagcaggaggggaggcaggucccccaggguggaggagaagccaccauggcugggaguguuuccgcagcccaacccaugcuggccacguuucugcaccgaggccaauucauaaacaacuuauuuuacucuugggcaaccccggugguuuacaaagcauuuccccaaacauuaucucauguauuuucucaaggcaacuuugaagaaaguaacauuaucuccaucuuagagaugaggaaaacgaugcagaacuugguuuuacagccacccaggguggcaacaauucaaggguuuucauaauuccccaaaauacuuaaagccguauucuggcucauagacgcaugguccccaauacccaagaaagcaggugcaggcagcugcuugaaggcccagagcucgccuugcucccuggacccaaggcagcagacggaggcugucaaacguacucccaagucagugaccacaaggccagacucugcaaacuguucacaguguguuggggcuggggcagggugggcacuggauucugacccuuucacacucuguacaggcacugaccgggaagcugccugcccaggucccacaggcaagcaggacguucaccuggcacagccuguggaccuuggggaagcaggggcaaugccaucuggugcagccucuuuacucccguggggaaagggguggggaagggcuccauccaugucuccccuuuuccaaugcaguccaugcaaacagaugaggcucagaauuccagcugcucuggcaggaccagauccagaugaugcuguuuuuuuuuuuuuuugagacaagagucuugcucuguugcucaggcugcagugcaaugacaugaucacagcucacugcagccuugaccucccuaggcccgagugauccucccaccucagucucccaagcagcugggaccacaggcaugugccaccauguccaacaaauuuuuuuuuuuuuuugagacagagcuucacucuguugcccagacuggagugcaguagcaugaccuuagcucauuacaacuucugccuccuggggucaagccauccucccaccucagccucccaaguagcugggacuacaggcaugagccaccaugcccagcuaauuuuuguauuuuuuuggagagaugggguuuuaccauguuacucacgcuggucucgagcuccugggcucaagcgauccucccaucuuggccucccaaagugcugggauuacaggcgagagccaccacaacugucucccauuauuucccuaauugaccaaguguuaaacuucugccaggaacaugacagagggcccugauggaagaugcugaaaucaucuuucuaacaaguccugaggccucuggacuccaugccaggcaccggcagacccagccucagccuuuaaggugcuccaagccauucuucaugccuucucuaugccacaggcaggagugaccuggaggccucuuccccuugcacugcugaggugaguguccagcacuacaggagccuagagcaagcaucgggcuugggcaggcuggggagggggucagagaaggcuuccaugugguggggacauaaccaggcuucugcugugagucacccuacaggacucccacuagacuccaccacgugcaaccugcgcggguacuucucucggagccucaguuucuucauuauaacauuucaggggaauuacauaauuaacaagggacaguucuagguuauagaagucccauuaauaaauggagaaagggcccagcaaggugccucacgccuguaauccuagcacuuugggaggccgagcuggguggaucacgaggucaggagaucgagaccaaccuggcuaacauggugaaaccccaucucuacuaaaaauacaaaaaauuagccgggccugguggcaggcgccuguagucccagcuacuggggaggcugaggcaggagaauggcgugaacccgggaggcagagcuugcagugagccgagaucgcgccacugcacuccagccugggugacagagccagacgcagucucaaaaacuaguaaauaaauaaauaaaaauaauaaugggagccgcgguggcucaggccgguugcccuggcacucggggaggugaggcuacacauucgaggcuaaccugaucaacacugauuaaaaaauaauaauaauaaaacaacauugguugggugcgguggcgaagaccuguaaucucagcacuuugggaggccaagguggguggaucacuugaggcuaggaguucgagaccagccagggcaacauagcgaaacccugucucuacuaaaaauacaaaaauuagccagacguaguggcaugugccuguaauccccagcuacuugggaggcugaggcgggagaaucacuugaaccugggagguggugguugcagugagcuaagaucacaccacugcacuccagccugggcaacagagcaagacuccaucucaaaaauaaauaaauaaauaaauaauaaaaaaccuuaacauaaacccuuacacauauacaaaaauuaauucaaaauaaaucacacauuuaaauguaaaauguaaaacucuaaaccuuuuagaagacaggagaaaauauuugaaaccuagagauggccaaguguucuuagacuugacaccaaaagcaugauccauaaaaggaaaaaaucgauaaacugcaauauaagaaaaguaaaaacuuaugcacuaugaauaaacaagccacagaguggaagaauauauuugcaagucacagaucugguaaaugacuagcauugggaauguaugaagaaugcucaaaaagcuccaugggccaggcgcggugguucacaccuguaaucccagcacuuugggaggccaaggugggcggaucaccugaggucaggaguucgagaucagccuggccaacauggugaaacccugucucuacuaaaaauaaaaaaauuagccaggugugguggcuggcgccuguaaucccagcuacucaggaggcugaggcagcagaauugcuugaaccaggaaggcagagguugcagugagccaagaucgugccauugcacucccgcccuuaggggacagagcaagacucuugucuccaaaaaaaaaaaaaaaaagcaccaugguaaaaagaaaaccaaacaaucccacuugaaaauaggcaaaauacaugaacagauaucucaguaaagaagagauacacagcaaauaaguacauggcgcaguggcucaugccuguaaucccaaaacuuugaggggcugaggcagguggaucacuugaagccaggaauucaagaccagucuggccaacauggcgaaacccugucucuacuaaaaauacaaaaauuagccggguauggugguacaugucuguaaucccagcuacucgggaggcugaggcagaacaaucgcuugaacccgggagguggagcuugcagugagcugagaucacaccaccgcacuccagccugggcgacagagcaagacucugucuccaaaacaaacaaacaggcaaacacaacaaaaguuaaacaucauuagccauuaaggaaaugcaaacugaaaaacugaaaacaccuucacaucccauaccuggguaccaaaaaauauauaucauauaccuauaaaauaaaaaauacugacaauaucaaaugcuggcaaggaugcagagaaaccugaucucccacacauugcuggugggaagauaaaauggugcagccaccauggaaaacaacuuuggcacuuucuuuuuuuuuuuuuuuuuugagacagagccuuggucugucgcccaggcuggagugcacuggcaccaucuuggcucacugcaaccucuaccucccggguucaagcaauucucugccucugucuccugaguagcugggauuacaggugcccgccaccauggccagcuaauuuuuuuuauuuauuuauuuuuuugagacggagucucacucugucgccccaggcuggaggggcaguagcacgauccuggcucacugcaaccuccaccucccugguucaagcuauucuccugccucagccuccugaguaggugggauuauaggcgcgugucaccaugcccagcuaauuuuuguauuuuuaguagagacgggguuucaucauguuggucaggcugaucuugaacuccugaccuugugauccgcccgccucagccucccagagugcugggauuacaggcgugagccaccgcacccggccucauggccggcuaauuuuuuuuguauuuuuaguagugacgggguuucaccauauuggccaggcuggucuugaacuccugaccuugugauccacccaccucagccucccagagugcugggauuacaggcgugagccaccaugccuggccccggcaguuucuuauaaaacuaacaugcauuuacuacacaacccaguaaucacuguggacauuuauucuacaggaaugaaaacguauauucacacaaaagccuguacacaaauguucacggcagccguaucuguaaucaucaaaaucugggaagaacccauguacuucaacaggcaaaaaguuaaacucugguauauccagaccauggaauaguacccagcaagaaaaaagaacaaauuacugauacacacaagugaucuggauggaucucagggguguuacauuuugugaaaccagccaaucucaaaaggucacauacugcaugauccauuuauguaacaugcucaaaaugacaaagcuauaaagauggagcaugguguaguaguuggcagaggacagugacgaugauggguggggguguguaauuuuaaaggguaccaggggaguuccuuccaggugaugaaacaguuuguaucuugauagugguagugguuacaugaaucuacaugugauaaaauugaagagaacuacacauacacccuacaugaaaaugcagaaaacugaauaaggucuguacuucaguuaauaguacuguugggcugggcaugguggcucacgccuguaaucccagcacuuugggaguccaaggcggguggaucaucugaggucgggaguuugagaacagcuugaccaacaugaagaaaccccgucucuacuaaaaauacaaaaauuagcccaggggaccuuuuuuuuuuuuuggauuuggagucucacucugucacccaggccggagugcaguggugugaucuucaacucacuguaaccucugccucccggguucaagcaauucuccugccucagccucccaaguagcugggauuacaggcacccaccaccaugccugccuaauuuuuguauuuuuaguagagacagguuuucaccuuauuggccaggcuggucucuuggacagggugguaucaaacuccugaccucgugauccucccaccucggccucccaaagugcugggauuacaggcgugagccaccaugcccggccaacaauccuuauugauugcuuuuccacaagauaaccaauaaaucucugauacaaacugagucccuccccaucuuacuacacauuucauagaaaaaucuguuguucugcugucuaaagcuuuuuauuauggaacauuucaaacauacaaaacuggaacaaauaguguaaugaauuuuuccaccucuccaucacugagcuuuaacgguuagcaacacugcgcaaucuuguugcaucuuucccugucccccagauguaauguuaaauacuucggugugcaucuguacuugauaaagacuuuuuaaacuuucuauuuugaaauaaucguagguucacaggaaauugcaaaaauagaaucuaggguccuguaugcccuucacccagcuuccucaacgggugacgucuagucuagcuguaguacaguaucaaagccuggaaguggacauuaauaguuuuuuuuuuuuuuuuuuuuugagauagaguuucgcucuuguugcccaggcuggagugcaauggcgcgaucucgacucacggcaaccuccaccuccagaauucaagugauucuccugccucagccucccaaguagcugguauuacuggcaugcaccaaaacaauaugucugucacugacuuuaaaaagaaaaaaaaaauccucucauagcugaacuccuaaaaagcuacguaacagaauuuucuaguccauuaaaaauuuuccaaagcauuuuaguggguuuuggacucgcuuguuaagaauuuuaaaauaaaauaccuuccauuucguuuacaaaaacgugauuggcaucagggaggauggaaauguaccggccaaauuucaacaaauccuuugcauacucaguggacgggauggaaaaaugaguaacccgauuuagaaagaaagccaaggaugcgucugcuccgugugcagcuuccugucccagacaggaucuuuugcagggaaagcagccauuaaaacccagucucuaaacaagccgaacgugaagccagccagaccuuccaaacucucucucacugaucacgaaagcgcacguuccaaaaaaugaccccguguaugaacccaggagguuucuguaccgucaacaaaguaaaaauuuucuuuauuacaucuuuagcuuggccuuugguuucuguuuuugguguagguuuuauuacguacacacugaaacaguaaaguaauauacguguauacuuauuguaacauacacuuauaauuacaccaauauccacauauugggggugcauguucaagagguuuuguucugguuucuuuuuuacugauagggcugugugauccaaggaaguuuggagagcagugcuauagugauaggcaaaggcccaaggcuuccuaauggcugcugcuauuccccucuccucugcaaucucucugccucucuguccuuccccagacaaggcccccuggcucaguuccaggcugcagaucagacagaaaacaaauucaaggacccccaccucccccacauacagccuaccugccagugagugcagucuccacaccugucucucauucacacgccacccagcagguggcaaagaggccaggccacgcagucugcacuuugucccaggcucugagacagggaacugaguuggaaccucagcauuaucaccuaagcugggccugaggcaggugacuggaccucucugacuguguuucuuagggagaaaaguccaggugcacuguccuguagcuaaggcuuuuggacuaaauggguuuaagaauuuagaauuuuuccaaauuuuuuuuuuuuuuuuuuuagacuaagucucacucugucacccagacuggaguacagaggaacaaucucggcucacugcaaccuccgccucccagguucaagcgauucuccugccucagccuuccuaguagcugggauuacaggcauaagccacaugcccggcuaauuuuuguauuuuuaguagagacagaguuucaccauauuggccaggcuggucucgaacuccugaccucaagugauccaccaaccucagccucccaaagcucugggauuauaggcaugagccaccgugcccagccgaauuuuucagauuuuagaaaggauuaugcugcuagacacagugacacuccuggaagggugggugcaacaccccaaaagcaaacauauaguacuuucauaggaaaacauacuguuagucacccuaaggaagauaguuuuaaaggccauaauuaguaucacaucaauucaggucagauuuuugcagcagaaauuagucugcugcagacuuagaagaaccuuugggauuucugagcguucugaauucuagaacagcagagaaggggaugugggccuggaccgucuuccagaacuguagggaggcugaugaggaagcagacauccagugucguuuauuucuauguuuauuuucaacuguaaugguaucccuccucccaaccugaaauccacugagaauguggcaggagcuggccgugggacccaaagucucacuucucccaagacugccccaccucccuccucuuccaggaaagacgucuuccggcuggccccccaucagagacauccuuucucagauaagcuacgcagcuaugucgucacugaacuuggccaccugccuuggaguuuauuucgggagcaucccaccaucucacccagauucuaucgucagagucauuuuaacucauguuugagggacaccuuacugcugcuauccccucugcccauggauuuuauuaugugcugugugguaggcugaagaauaaucccccaaagauguugacauccuaacccccagagccugugaacaugcuaccuuacauggcaaaagggacuuugcagaagugacugaauuaaggguccugaaaugagagauuauccuggauaaccugggugggcccaugucaucacaaggguccucguaggaggaaggcaggagguagagagcgagaagagggcagcgugacaaaggaagcagagagaggaaaguggaagcugcuacgcugcugcccuugcagauggcgaaaggcgccacaagccacagauggagguggucucuaggagcuggaagaggcagggaaauaauucucccccagagccuccagaaggaguauggcccugccaacaccucgauuuuaguccagugaaacacauucuggaccugaccuccaaaacugugagauaauuaaugugugcgcaugcauuuuauugguuuuucuuauuguaaguaaucuauaauuuguguuuguuuuguuuuugagaaggagucucacucuguggcccaggcuggagugcaguggugcgaucucggcucacugcaaccucugccuccuggguucaagcaauucucccaccucagccuccagaguagcugggguuacaggcacgugccaccacgccuggcuuuuuuuuuuuuuuuuuuuugugagacggagucucacucugucacccaggcuggagugcaguggcgugaucuuggcucacugcaaccuccgccucccaguaacugggacuacaggcgcgugccaccacguccugcuaauuuuguauucuuaguagagacaggcuuucaccauauuggucaggcuggucuugaacuccugaccuuguguuccgcccaccuuguccucccaaaguucugggauuacaggcgugauccaccacacccggccaaaugccuggcuaauuuuuuauauuuuuguuagagacaggguuucaucauguuggccaggcuggucucgaacuccugaccucaagugauccacucaccucagccucccaaagugcugggauuacagaugugagccaccgcacccgaccuaauuuguguuuuaagucacuaaguuucugguaauuuguugcagcagcaagcagcuugcagaugcaaaacagagguuugaagggcugacgucauuugcccacaaucaccugacaaaugguucuuccgacugccacugccgugcugugaaauccgcagaacucuggagccugaccaccuagaccugaccuccagcuuugccacuggcuagcuuugugucugugagcaaguuacacaaccucuccuugccuuagcuuccucaucuauaaaauggggaagcagccauaccugccucugagagagagggacggaauaaugagugaacacagaaagcacugagaaggucuggcaccaugugaugucagcugccauugcucucccacuuccuccuucggccagccugggauuucaugcucccaacagucucugggacccagguucuguugcuggguauuugcucucuuuaaaucuucugaggucauauuuucauucauuaguuucagauccaaacccuuuagagcugcagccacgaagugcucacucaggcggcugccacccacaggccaagcuaaacuggcaacccguucacauauauaucccuggaauauucaugcagccugggagggcuuuuguucucuuauuuaauauagauggagaaccuuccaucuuaccauaacucgcugguuggggucagacucgagcacuguucaucugaacugaccgcucugcucccacuccagccgccugggaaugacaacgggaaugacagccggcccuccugccuuuggggguugccugggcucucugagcuucugggcagcugcauuauugggggaggcugauccacaucagagcaggucagcaacccacagccuggcccuucuccagaggggauuagagggaaagagcggccccuggccaggcacuucugccuggugagccuuuugaaaaggaucacaugcccucacaaggggucagggguccacagcucuccuuccgucuccccuucaaucaacacaaacaagcggaggccacucuagcggcuccacauuucucccccuucuccugggccaaguucccaggaaucucucaaccaggaaagcaaaaucauccaaucauguacauaucugucacuugggugggggugcagaaauaaaggggaacaacaaagaaauccaaagucccucagcgagggcuuacucaauucagccuuguaauuagguucuuuccuuuaguacauaccaguccuaauuuugaugaucucaguuuucucucaaauugagaacaauggaccaacgcucagccucuuuagcuggauuguugagccccucuacaugugaccaccuuuccagccagcuaaaaucccacugggcacugagcggauagguccccugcagauucagcauccugcaccccaacaaugcuaccaccccaugggagcaggcugucuaaaccaggaucccuguaccugcucugucccuguaaucaagaagccuggcuccagccaggacacccuagauuucucauaccaaccugaauuucauucaugcaaacacauucugagucagguaagccaucaacccacccuggguguauacccagcaaagagcgcacacgcgcccccaaagacaagaaugaauucaccgaagaggcuggacauaacccaaugccuguccacaggagaaugaauaaauagugguauauuuggugaacuccuacgcagcagagaaaaaaaccaaagggccacuacaggcaaccuggaugaucugacagugcugcgggaaggcagccagacaccgaggaguccguucuguacacucugugugugggaggcccaaacaggcagcggcaggcaccacgcgaaagugccaaggugugaguggugacuaccggcgaagagcgaguggccaggagggggccccagggagcuuccuugggugcaggaaccauuguguggcuugaucugggcaguuuacacagaagccagggaggucagaaggcagugcagaaguggaaacuaagcuggcccuugaaagucagacaggaccugggcacguggagacugcucuggacggaaaggcaggcaaagggaacuauaugagcaaaggcacggagguggggaguuaagagggcagacagaggaaggggugacaggccaagugcggcucaagaagaggcccaguaaagagggccugggaugcccagugcugaguuaaaguguaucuuucugucaguggggaagcccccaaagguuucagaaaucaugacgugagccaaucggagcaaggguugaaaaugacaaagucagccaacagcaguguguccaaggggcccagagagggcuccaucucuccaaggccgggaccgggggucguauuuaccaagcaacacccaagcccucacacucggccccuuugugagaaccaagcacauauuuuuugauuaguggucuggggccugagugaggcuccuguacuugagaaguagccagaaccuugaccuuccuacacugggcaggaggcaagguuacaguccuuauguuuuuaauuuauuuuauuuuauuauuugagacagagucucgcucuguagcucaggcuggaguacaauggcaugaucuuggcucacuguaaacucagccucuaggguucacaugauucuccugccucagccucuagagcagcugggauuacaggcauguaccaccaugucuggcuaauuuguguauuuuuaguggagaugggguuucaucauguuggccaggcuggucucgaaccccucaccucaagugauccuccaacaucagccucccaaacugcugggauuacaggcgugagccaccgcaccuggcccauuuuaauuucuuggaaaggcguacauucaccugcuucagcaaucaaaagguacaugggaucuccagcaaacaagcaaucucccaugaccagcacccccuccagaggcaucacaaucaccgacuugcggugucugcccagagacccccugggcauagacaagcaaagacacuuuugauucucuucccuuuuacacugauggcagcuccgagacacaccgcccagaccugcuucuucccucggcaauccaccuugcugcucaauccggcacagugcguugagcguccaucuuauguauuauggccacgcgguaucccauguuuagacgggccaugguuuguucauuggccccugcgaaugaacauuuaagcugccuccaaucuuuugcuauuaaaaauaaggcaacaaugacgaaccuugcaaauaaaucauuuugcacacguguuaacccauccguagaauaaauucugggaggcagagcugccggugaaaguauagaaacaucuguaauuuuggaaaauauugccagagaggcacaguacauuuaaauuguucauccaagaaaugagccucaauguugggggaaauauagaaaauauguagguuucuguuuguuuuuugagaugcagucucgcucugucucccaggcugaagugcggugaugcaaucucagcucacugcaaucuuugccucccaaguucaagcgauucuucugccucagccucccgaguagcugggauuacaggugcgugucaccacgcugggcuaauuuuuguauuuuuaguagagaugagguuucaccauguuggccaggcuggucucgaccuccugaccucaaguuaccugcccaccucggccucccaaagugcugggauuacaggcgugagccaccgcgaccagccaauacauaguuuaaaguuguccaagugaagaaacgguagagaaaggcuguuuucaacaaauggagcucuggguagggacacggugcugaacccacaccggccccaacucacuuggugcucugguccacacgcuugcauuucccagcugucaguaaaaggcuaggcccacuuggccccuugacccuucucagggcucugauguccuggucccaggaagugugaacggugaccugagccacuaugacaagcagccauaauuggucuccccaggcgcccaugaagaugagcaggcaggccaggugggagggggugggggugcagagcccaagagggccaagugcuuccagucuagccauuccagaugaguggugagcaccucuugccacauacccugcacaagcugcaggggacaccacagccaugcaagaccacucccacuccaugacauucacucagcuggcucugcuccuggguccaucacagaucuguuauguaacuccugugcccaacagccaucaccaccuaagcaucaagccagggaguugaggagauggaggcgggucucuggaaggcacaccgaguaucaagucaggacagccaacucuauguagaagcagggcaggccuuucucccacuuccacaaaucuggcccaacuacugcaaacugggaaaagaaggaaaagucuucugcccccggccgaguaggagauaccucuuagcaaaccaaaggaagcauuugagagaaagaacccuugucaaccucaucucccagcccaagccgugcucccacugacugagacggccaggcacuccaguaaaucaaaucauacuuacaugcucugagguuacugcuauuaaaauuaucuaaccuaugcauccugcaucuaccuuucuucucaaagcaaauauguacuguuuuggaaaaucuagauuuucccacauccuauuuaaacuccauugacaaaucuguguauagaugcacuuucuccuccuggagaugaggcuaggaccccacaugcucugggaaguggucacgagaccucugcuccuugaguaaccugccugucucauuccucugugugugcucaagguggucccacucccugcaaagaccuccugcacuucaccugccaaccuccacuguccacugagccucagcccaacuacccuuguuccagagagcaccggcuccucagcucacccccaggcagagccgacugcugccuccuggaacccccaugguuuuaaccugaagcuuuauucacgugcuuuccaggucuaagcagcaauccaauacacuggccuucccaguguggcugcaagcucuccaagggcaggucuguguuggggguagcuacucagcaggaagggcccaggacucaaaaccagaaaaccugggugcuuccucccccaggaucuuaggcaauucaccccucugagccucagucucuccaucuauaaaauaggugcaauaauuucaagguuucagggcaguuaaaaggauuacauaaaaccauauauuugaaauauaacuugcaaagccccacaaauuccaaugagaauauuaauauaacuagcauguuaauauuaauuaauauccucacacauacccuucaccaacaucuaucauugugccucgcaggcacccaaacugacugcugaugggaucccagauucacugcucacucugcaugaaacaaaaaccacaggcgcuagagguggggaccaggaggcucugccaguagcuacagcggcgccaugggguuaguuauuuucucucggagcuuuucgguaaauggggaacagcccugcugaguggaguggagguucucagccacuugccagcaggagaggccccauucugggugcaggcaguccacagggguuggagcaggagauaaauaaagguaccaagcuccacacacgucccuuggaguaggggggcugucugaucugaaaaucccuuugaggguaacagaggcaguaacuuccggaggucucacugcacccccucuguuggggagggggaccaucugggacugcccaugacccgcagguaaagggucuguggauccuggcuucccagagaggaggcuggagucuucaggagaucaccaagcauuuuaaguuggaaaagaagcaacaggcacacgugcuuccacguuucuccuucagucuucauggucaugugaccugcccuaucuccaaaccacaaccuugggagcuaaaggcguucaaaucaaggacuucaccagagccugugaggugggcagacaggguacgaauagcgccccuugccuuagcaggagugaagcucaaagagggcaaguggcuugcccaaggucacagcuggguuuccugacucaauccagugcccuguucaccacugcugcaacggugccguccagcuaaaaaaaaggcugaagaccucaucuuuccugcagagaauuugaaacaaagcgcaagagcuguuuuagaacuucucugauucuuuucuaucuauagcuaccuuucaaaugcuauggguaaauguuuauaacccgguguuaaguaaacaaugagauaacguguguucaugccuagaaagaacaucugcccaaaccugaaccaugauuacuucuugauuuggaaauuugggguaauuuuuauucuuauccccaaucuuuccugugcuucaaguuuacuaucaacaaguacggccggguacgguggcucacgccuguaaucccagcacuuugggaggccgaggcggguggaucaagaggucagaagaucgagaccauccuggcuaacacggugaaauccugccucuacuaaaaauacaaaaaauuagccgggcgccguggcaggugccuguacucccagcuacucgggaggcugaggcaggagaauggcuugaacccgggaagcggagcuugcagugagccgaaaucgcaccacugcacugucugccugggcgacagagcaaaacucugucucaaaaaaaaaaaaaaaacaaguacuacuucuaaucucagagaagccuauuguuuuucaaagguacaagacugagaucaacguggcaaacuuuucaccaaauauucacuuagugggaugugacuuuguaaaacaugguugagcuggaagugacgcagguucagcacaaaggcuuucuggguggaucuuccccugugguuuccaccccagagaaggaaaaggagguguccaccaagcuuccugucucccaucacaggccuaagaccucccacaccagccagccagacucaaggcuguuuagugagcaccaccggcuccuggaauaaccaauccuguuccaaccaccccuaauaucuuuuuuuuuuuuuuuuugagauggaguuucgcugucacccaggcuggagugcaauggcguagucucagcucacugcaaccuccgccucccagguucaggcaauucuccugccucagccucccaaguagcuggguuuacaggcacaugccaccacaccuggcugauuuuuguauuuuuaguagagacgggguuucaccauguuggccaggcuggucuccaauuccugagcucaagugaucugcccaccucggccucccaaaguacugggauuacaggugugagccaccgcaccuagccauauccgucauuuuucaagaauaauuauagcuuuauccugaguggcagugccacaaacccauccaaccauucauuuguuuauucaaaaaccacuucacuaccuacuguguacauuucgccagacacugagccaugauuaaccuaagacuagaaaagucaccaaccagaagccacgcaccauccuucuaugccauacccaagcauagggcuucagccacccuaaaacagcagcaaauagacacgugaacaaaugcuaccuggguguccgccuaauuccagcugucagccaccucugcauuuagauuuauccucuccagugcugaggacaagcaauuugggaaugagugcccgguaagaaugcuggcggaggccgggcagaguggcucacaccuguaaucccaacacuuugggaggccaaggcgggcagaucacaaggucaggaguucgagaccagcuuggcuaacauggugaaaccccaucucuacuaaaaauacaaaaauuagccaggcaugauggugggugccuguaauccccgcuacuugggaggcugaggcacgagaaucacccaggaggcggagguugcagugagccgagauccugccacugcacuccagccugggcaacagagggagacccugucucaaaaaaaaaaaaaaaagaaagaauucuggcagacucagacgcacuguuaguaccugcaccacauuaguaccugcuuuuccacagagacggaggccaaggggagggaaugaugagaaaaucuacaacuugggugacccuucaauucuucucucuguggccgccucccacucuaccucuucccguuucuguccucucugaggcugaggagauggcauucagcaaacauuuauuucaggucuacuaagugcugagacuuaguaucaaacaacuccauagacaugaacucagaccucugcuuugcaugugcucuuccuucuaccuggagcccacuucuuccuccaccuuaauacacaucaccucacuagacaagugcccgcccaggcgacaauggccuaagguucccuaagagcccccaggacaaucauaauugcuugugugucugauuucucucuccccagcugcacucggcuccugagggcggcuccccgcaaacagccuggcacacaggccugcgaugccuccuucucaaauaaaugaaugggccuguaaggucauaauaaaagcauguccugugugccagguaccgugcugagcuccaucagacauuggucaggccagccacgugacagccacacuguuauuacucccaucuuacagaugaaggaaagugaaucauuugcccccuauuuuuaaacagcaggaauuagaaccugguaagcaucuugcccaaggccacagggcuaauaagcgcacagauuuaaauugcaucucccaauucucucucugggucaccagaacugcucagcgcauuaccucccucucucccuccuccucccgugcuccuagugaccauuucuuuuuaagacggagucuuguucuaucacccaccagacuggaguguaguggcacuaucucagcucacuguaaccuccgccucccggauuaaagcaauucuccugccuuagccucccaaguagcugggauuauaggugugugccaccaugccuggcaaauuuuuuuuaguagagacuggguuucacuguguuggccaggcuggucucaaauuccugaccucaggcgaccugcccaccucagccucccaaagcuuggauuacaggcaugagccaccacgcccagccuaagacucugucuuaaaagaaaaaaaaguuccagcugaccaggcauggugguucacaccuauaaucucagcgcuuuagaaggccaagguggaaggaucuccugggcccaggagguagaagcugcagcaagcuacgauagcaccacugcaugccaagcugggcaacagagcgagacuccaucucaaaaaacaaaaaaaguuccagcucagagaagccaguucccagcaggcaaggggucagcaguggggcagacaccguuacaacagugggcuccagaaccugcccugagucacacagggucuucaagaccaaaagcugcuagaagacaacaagagaaaggcggcggggucuaaaagcgaugccaggggcuguaggaaagccaacggaacaaaggccuggucuuccagaaguucucugcaggaaugaaggagggaugagaagggaugguaauacugccccauaacacauggcugagcaugucacauccuuccagaaacuuucaaggccucccuguugacaucaggaucaaguucaaacuccuuggcggggccuccaaaggucuucaggacacagacccaacacagucacaggcaguucaagccucugcgucugagaggugaggcagcucagaccuccacaucugcccggaguucccucuaccuggaacgcccuccuucuccuucauagguggagcaccccucguccuucagggccaagacgacuuccagcaccccaggguuaugggggaggagcaugggcucugaggucagaccuacugguucaaaacucagcuguuccacucucugcugccuccccuacaaaaugcagacagugacagcccccaccacacugggugguaggaaaauuaaauacaguaauucaugaaagcgcuuugaacugugccuggcacacaguaagugcucaauaaacggacuguuguuccuauuguccucugggccccuuuagggcccucuguuuccaccacaaguagggcacugucuugcacauauuuguuacacauugggcucccucugccaaccaccuuuuagagggcugccccagcacagugcagggcagcauggucuucggugagugcuuacuacccggggcugcagggccuggugcagaccccacacagagcucucccaggggcccagcuauuggccuuccagaacucccacaccagauccccagucuaaaggcccagagcugugacucguuuucaaaacaauaaaaagcuguacccugccuugccggggcuguuuccacuccagggaauuuacagagagaaaaugagcacagcagggacuggaaauagcucugagcccuucucagggugagggacugggcaggccagccagagaccaggagcaaaaccucuaagacagagagggagcaaacagccuccggacagaagccccugcucacagaacucggccaauaggaaagaacuaggacaaguggcucauucacccuucugccucgaagcucuucuuucuacuugguuggagaaauucagaaggggcucuuugaauaacccaccaccaccgugggugcaacaaauaagacauccagaaucccaacgacugcacaaaugcuuugggggaauucacagcgccuucuccacccacauuagcuauuggagccucguauccagauuggggucacuaaaucaguguccaucuucccagcacugggagccccuagaaggcaggcaccaggucccauugaucaucagaccgcuaugccccagcauagugccuggcacauaguagaugcucaguaaguugcaagacaagaucuggcagcaagagagagguccugguuaaaggaugauuccauccaggcuugccacguaucguggagaagaacgucaugaauucccucugggccucaguuuaccgcaucugcaaauagggacaacuguuccuuacucacacagcugcugugcaaauuacacaggaaaauauauguggaaagcagaaaagccucagaugaacgucagucauccuucaggcuucagcucaaccgucuccuuaugagggagucuuuccugcggccacgaucccccuccccgggaacugaaccugccucuguacuccuucuacuccuuuguuugguauuuuucacaucaucgugaucaccuguuuccaaaucugauucccccaugcuugagagcuccuugauggcuugggcaucaaauguuucuguccaggugggcacacauaccuggcugcuggggcucucccaccccagcgucccaggucccaacucugauacgcacagcacccuaggcaagguucagaggugcagagccuagggguucuaccaaggaagcuaaauagguagauggaaagggacacuguaggcauaaccugucaacgaagucacaccucugagaccugcgcugccucugcaggugcaggugagcuuguuugccuggcugacucugcagcgcagggccuccagggcacagauugcugcuucuuuccuuacaaaagcaccagcagucagauaaauaauacauggccuucaccucaccacagguaucaggcaugcaaauaccugcuuugccccaaaaugcccuggaaaggagggaggaguaaaacgucuggccuuauacaacaccuccagaggggauauguauugggaauccaugcccaacccccagcauaacugccuugccuuggccuggagccacccagcacuggagguaaguggauccaagcgagguaccaagggugugcccaggaggaaauguacaauucacgggaaggauacagacacccaaaaccagucuccacggucccuuugggggcaaacaucuuucgagccccaggucccagucgauccccuuccaaaccugcggaccuguguggcgggcguguacacccuccacucacgacgcagccccgaaagccccccgccgaccacccucccaggucacugccacccgcacagggcacggacgccucccccacucacucggccgugccagucgccagcacacccacccgggagcacacaaucccucuugcaaagcgccuugguccauccgccucccucucccggggccgccccccggacagguccgauuacacuccaggagcugcccccgccacguuggcguggaaagggagcgggcacacccacgggcgaccucgcggggcggagaggaggcacggguggggagacggaugcccccucccuccgcggccgcaccggccuccguagugcccuccccgcccgggagccggcggccgaagccgggcgucccucgcgcgggccucuccgaaacaagcagccccccgcgcucgggagucgcagcucccccuuggggcucccgggcgaggccggccaggcgggauaccucaggagcccauggcgguggcggcgucugcggacgaugcgcggcagccggacucugcgggcggggcgggcggcgccgcagccccggagucuccgccgccgccggcgcgucccgggcccaguggagugcagccgcggcgcgcaugcgcucugggcucgccgccggggagggcggggcggcggacgcggcugagaucacugccugggccuuaaaggggccgcgccccgaaccccagcccgccgccccgaaccccagcccgccgccccgcggguuggggcgcgacccggguucucuugccacucacaaaaccagcuacgaccggcccccaaccgcgagagcuuucugggcugcgaucucugccccugacccucgcuggugcuucacuuc

SEQ ID NO: 17866 - RNA, 53980 nt, Homo sapiens
gaagugaagcaccagcgagggucaggggcagagaucgcagcccagaaagcucucgcgguugggggccggucguagcugguuuugugaguggcaagagaacccgggucgcgccccaacccgcggggcggcgggcugggguucggggcggcgggcugggguucggggcgcggccccuuuaaggcccaggcagugaucucagccgcguccgccgccccgcccuccccggcggcgagcccagagcgcaugcgcgccgcggcugcacuccacugggcccgggacgcgccggcggcggcggagacuccggggcugcggcgccgcccgccccgcccgcagaguccggcugccgcgcaucguccgcagacgccgccaccgccaugggcuccugagguaucccgccuggccggccucgcccgggagccccaagggggagcugcgacucccgagcgcggggggcugcuuguuucggagaggcccgcgcgagggacgcccggcuucggccgccggcucccgggcggggagggcacuacggaggccggugcggccgcggagggagggggcauccgucuccccacccgugccuccucuccgccccgcgaggucgcccgugggugugcccgcucccuuuccacgccaacguggcgggggcagcuccuggaguguaaucggaccuguccggggggcggccccgggagagggaggcggauggaccaaggcgcuuugcaagagggauugugugcucccgggugggugugcuggcgacuggcacggccgagugagugggggaggcguccgugcccugugcggguggcagugaccugggaggguggucggcggggggcuuucggggcugcgucgugaguggaggguguacacgcccgccacacagguccgcagguuuggaaggggaucgacugggaccuggggcucgaaagauguuugcccccaaagggaccguggagacugguuuugggugucuguauccuucccgugaauuguacauuuccuccugggcacacccuugguaccucgcuuggauccacuuaccuccagugcuggguggcuccaggccaaggcaaggcaguuaugcuggggguugggcauggauucccaauacauauccccucuggagguguuguauaaggccagacguuuuacuccucccuccuuuccagggcauuuuggggcaaagcagguauuugcaugccugauaccuguggugaggugaaggccauguauuauuuaucugacugcuggugcuuuuguaaggaaagaagcagcaaucugugcccuggaggcccugcgcugcagagucagccaggcaaacaagcucaccugcaccugcagaggcagcgcaggucucagaggugugacuucguugacagguuaugccuacagugucccuuuccaucuaccuauuuagcuuccuugguagaaccccuaggcucugcaccucugaaccuugccuagggugcugugcguaucagaguugggaccugggacgcuggggugggagagccccagcagccagguaugugugcccaccuggacagaaacauuugaugcccaagccaucaaggagcucucaagcaugggggaaucagauuuggaaacaggugaucacgaugaugugaaaaauaccaaacaaaggaguagaaggaguacagaggcagguucaguucccggggagggggaucguggccgcaggaaagacucccucauaaggagacgguugagcugaagccugaaggaugacugacguucaucugaggcuuuucugcuuuccacauauauuuuccuguguaauuugcacagcagcugugugaguaaggaacaguugucccuauuugcagaugcgguaaacugaggcccagagggaauucaugacguucuucuccacgauacguggcaagccuggauggaaucauccuuuaaccaggaccucucucuugcugccagaucuugucuugcaacuuacugagcaucuacuaugugccaggcacuaugcuggggcauagcggucugaugaucaaugggaccuggugccugccuucuaggggcucccagugcugggaagauggacacugauuuagugaccccaaucuggauacgaggcuccaauagcuaauguggguggagaaggcgcugugaauucccccaaagcauuugugcagucguugggauucuggaugucuuauuuguugcacccacgguggugguggguuauucaaagagccccuucugaauuucuccaaccaaguagaaagaagagcuucgaggcagaagggugaaugagccacuuguccuaguucuuuccuauuggccgaguucugugagcaggggcuucuguccggaggcuguuugcucccucucugucuuagagguuuugcuccuggucucuggcuggccugcccagucccucacccugagaagggcucagagcuauuuccagucccugcugugcucauuuucucucuguaaauucccuggaguggaaacagccccggcaaggcaggguacagcuuuuuauuguuuugaaaacgagucacagcucugggccuuuagacuggggaucuggugugggaguucuggaaggccaauagcugggccccugggagagcucuguguggggucugcaccaggcccugcagccccggguaguaagcacucaccgaagaccaugcugcccugcacugugcuggggcagcccucuaaaaggugguuggcagagggagcccaauguguaacaaauaugugcaagacagugcccuacuugugguggaaacagagggcccuaaaggggcccagaggacaauaggaacaacaguccguuuauugagcacuuacugugugccaggcacaguucaaagcgcuuucaugaauuacuguauuuaauuuuccuaccacccaguguggugggggcugucacugucugcauuuuguaggggaggcagcagagaguggaacagcugaguuuugaaccaguaggucugaccucagagcccaugcuccucccccauaacccuggggugcuggaagucgucuuggcccugaaggacgaggggugcuccaccuaugaaggagaaggagggcguuccagguagagggaacuccgggcagauguggaggucugagcugccucaccucucagacgcagaggcuugaacugccugugacuguguugggucuguguccugaagaccuuuggaggccccgccaaggaguuugaacuugauccugaugucaacagggaggccuugaaaguuucuggaaggaugugacaugcucagccauguguuauggggcaguauuaccaucccuucucaucccuccuucauuccugcagagaacuucuggaagaccaggccuuuguuccguuggcuuuccuacagccccuggcaucgcuuuuagaccccgccgccuuucucuuguugucuucuagcagcuuuuggucuugaagacccugugugacucagggcagguucuggagcccacuguuguaacggugucugccccacugcugaccccuugccugcugggaacuggcuucucugagcuggaacuuuuuuuguuuuuugagauggagucucgcucuguugcccagcuuggcaugcaguggugcuaucguagcuugcugcagcuucuaccuccugggcccaggagauccuuccaccuuggccuucuaaagcgcugagauuauaggugugaaccaccaugccuggucagcuggaacuuuuuuuucuuuuaagacagagucuuaggcugggcgugguggcucaugccuguaauccaagcuuugggaggcugaggugggcaggucgccugaggucaggaauuugagaccagccuggccaacacagugaaacccagucucuacuaaaaaaaauuugccaggcaugguggcacacaccuauaaucccagcuacuugggaggcuaaggcaggagaauugcuuuaauccgggaggcggagguuacagugagcugagauagugccacuacacuccagucuggugggugauagaacaagacuccgucuuaaaaagaaauggucacuaggagcacgggaggaggagggagagagggagguaaugcgcugagcaguucuggugacccagagagagaauugggagaugcaauuuaaaucugugcgcuuauuagcccuguggccuugggcaagaugcuuaccagguucuaauuccugcuguuuaaaaauagggggcaaaugauucacuuuccuucaucuguaagaugggaguaauaacaguguggcugucacguggcuggccugaccaaugucugauggagcucagcacgguaccuggcacacaggacaugcuuuuauuaugaccuuacaggcccauucauuuauuugagaaggaggcaucgcaggccugugugccaggcuguuugcggggagccgcccucaggagccgagugcagcuggggagagagaaaucagacacacaagcaauuaugauuguccugggggcucuuagggaaccuuaggccauugucgccugggcgggcacuugucuagugaggugauguguauuaagguggaggaagaagugggcuccagguagaaggaagagcacaugcaaagcagaggucugaguucaugucuauggaguuguuugauacuaagucucagcacuuaguagaccugaaauaaauguuugcugaaugccaucuccucagccucagagaggacagaaacgggaagagguagagugggaggcggccacagagagaagaauugaagggucacccaaguuguagauuuucucaucauucccuccccuuggccuccgucucuguggaaaagcagguacuaauguggugcagguacuaacagugcgucugagucugccagaauucuuucuuuuuuuuuuuuuuuugagacagggucucccucuguugcccaggcuggagugcaguggcaggaucucggcucacugcaaccuccgccuccugggugauucucgugccucagccucccaaguagcggggauuacaggcacccaccaucaugccuggcuaauuuuuguauuuuuaguagagaugggguuucaccauguuagccaagcuggucucgaacuccugaccuugugaucugcccgccuuggccucccaaaguguugggauuacaggugugagccacucugcccggccuccgccagcauucuuaccgggcacucauucccaaauugcuuguccucagcacuggagaggauaaaucuaaaugcagagguggcugacagcuggaauuaggcggacacccagguagcauuuguucacgugucuauuugcugcuguuuuaggguggcugaagcccuaugcuuggguauggcauagaaggauggugcguggcuucugguuggugacuuuucuagucuuagguuaaucauggcucagugucuggcgaaauguacacaguagguagugaagugguuuuugaauaaacaaaugaaugguuggauggguuuguggcacugccacucaggauaaagcuauaauuauucuugaaaaaugacggauauggcuaggugcgguggcucacaccuguaaucccaguacuuugggaggccgaggugggcagaucacuugagcucaggaauuggagaccagccuggccaacauggugaaaccccgucucuacuaaaaauacaaaaaucagccaggugugguggcaugugccuguaaacccagcuacuugggaggcugaggcaggagaauugccugaaccugggaggcggagguugcagugagcugagacuacgccauugcacuccagccugggugacagcgaaacuccaucucaaaaaaaaaaaaaaaaagauauuaggggugguuggaacaggauugguuauuccaggagccgguggugcucacuaaacagccuugagucuggcuggcuggugugggaggucuuaggccugugaugggagacaggaagcuugguggacaccuccuuuuccuucucugggguggaaaccacaggggaagauccacccagaaagccuuugugcugaaccugcgucacuuccagcucaaccauguuuuacaaagucacaucccacuaagugaauauuuggugaaaaguuugccacguugaucucagucuuguaccuuugaaaaacaauaggcuucucugagauuagaaguaguacuuguuuuuuuuuuuuuuuugagacagaguuuugcucugucgcccaggcagacagugcaguggugcgauuucggcucacugcaagcuccgcuucccggguucaagccauucuccugccucagccucccgaguagcugggaguacaggcaccugccacggcgcccggcuaauuuuuuguauuuuuaguagaggcaggauuucaccguguuagccaggauggucucgaucuucugaccucuugauccacccgccucggccucccaaagugcugggauuacaggcgugagccaccguacccggccguacuuguugauaguaaacuugaagcacaggaaagauuggggauaagaauaaaaauuaccccaaauuuccaaaucaagaaguaaucaugguucagguuugggcagauguucuuucuaggcaugaacacacguuaucucauuguuuacuuaacaccggguuauaaacauuuacccauagcauuugaaagguagcuauagauagaaaagaaucagagaaguucuaaaacagcucuugcgcuuuguuucaaauucucugcaggaaagaugaggucuucagccuuuuuuuuagcuggacggcaccguugcagcaguggugaacagggcacuggauugagucaggaaacccagcugugaccuugggcaagccacuugcccucuuugagcuucacuccugcuaaggcaaggggcgcuauucguacccugucugcccaccucacaggcucuggugaaguccuugauuugaacgccuuuagcucccaagguugugguuuggagauagggcaggucacaugaccaugaagacugaaggagaaacguggaagcacgugugccuguugcuucuuuuccaacuuaaaaugcuuggugaucuccugaagacuccagccuccucucugggaagccaggauccacagacccuuuaccugcgggucaugggcagucccagauggucccccuccccaacagagggggugcagugagaccuccggaaguuacugccucuguuacccucaaagggauuuucagaucagacagccccccuacuccaagggacguguguggagcuugguaccuuuauuuaucuccugcuccaaccccuguggacugccugcacccagaauggggccucuccugcuggcaaguggcugagaaccuccacuccacucagcagggcuguuccccauuuaccgaaaagcuccgagagaaaauaacuaaccccauggcgccgcuguagcuacuggcagagccuccugguccccaccucuagcgccugugguuuuuguuucaugcagagugagcagugaaucugggaucccaucagcagucaguuugggugccugcgaggcacaaugauagauguuggugaaggguaugugugaggauauuaauuaauauuaacaugcuaguuauauuaauauucucauuggaauuuguggggcuuugcaaguuauauuucaaauauaugguuuuauguaauccuuuuaacugcccugaaaccuugaaauuauugcaccuauuuuauagauggagagacugaggcucagaggggugaauugccuaagauccugggggaggaagcacccagguuuucugguuuugaguccugggcccuuccugcugaguagcuacccccaacacagaccugcccuuggagagcuugcagccacacugggaaggccaguguauuggauugcugcuuagaccuggaaagcacgugaauaaagcuucagguuaaaaccauggggguuccaggaggcagcagucggcucugccugggggugagcugaggagccggugcucucuggaacaaggguaguugggcugaggcucaguggacaguggagguuggcaggugaagugcaggaggucuuugcagggagugggaccaccuugagcacacacagaggaaugagacaggcagguuacucaaggagcagaggucucgugaccacuucccagagcaugugggguccuagccucaucuccaggaggagaaagugcaucuauacacagauuugucaauggaguuuaaauaggaugugggaaaaucuagauuuuccaaaacaguacauauuugcuuugagaagaaagguagaugcaggaugcauagguuagauaauuuuaauagcaguaaccucagagcauguaaguaugauuugauuuacuggagugccuggccgucucagucagugggagcacggcuugggcugggagaugagguugacaaggguucuuucucucaaaugcuuccuuugguuugcuaagagguaucuccuacucggccgggggcagaagacuuuuccuucuuuucccaguuugcaguaguugggccagauuuguggaagugggagaaaggccugcccugcuucuacauagaguuggcuguccugacuugauacucggugugccuuccagagacccgccuccaucuccucaacucccuggcuugaugcuuagguggugauggcuguugggcacaggaguuacauaacagaucugugauggacccaggagcagagccagcugagugaaugucauggagugggaguggucuugcauggcugugguguccccugcagcuugugcaggguauguggcaagaggugcucaccacucaucuggaauggcuagacuggaagcacuuggcccucuugggcucugcacccccacccccucccaccuggccugccugcucaucuucaugggcgccuggggagaccaauuauggcugcuugucauaguggcucaggucaccguucacacuuccugggaccaggacaucagagcccugagaagggucaaggggccaagugggccuagccuuuuacugacagcugggaaaugcaagcguguggaccagagcaccaagugaguuggggccgguguggguucagcaccgugucccuacccagagcuccauuuguugaaaacagccuuucucuaccguuucuucacuuggacaacuuuaaacuauguauuggcuggucgcgguggcucacgccuguaaucccagcacuuugggaggccgaggugggcagguaacuugaggucaggaggucgagaccagccuggccaacauggugaaaccucaucucuacuaaaaauacaaaaauuagcccagcguggugacacgcaccuguaaucccagcuacucgggaggcugaggcagaagaaucgcuugaacuugggaggcaaagauugcagugagcugagauugcaucaccgcacuucagccugggagacagagcgagacugcaucucaaaaaacaaacagaaaccuacauauuuucuauauuucccccaacauugaggcucauuucuuggaugaacaauuuaaauguacugugccucucuggcaauauuuuccaaaauuacagauguuucuauacuuucaccggcagcucugccucccagaauuuauucuacggauggguuaacacgugugcaaaaugauuuauuugcaagguucgucauuguugccuuauuuuuaauagcaaaagauuggaggcagcuuaaauguucauucgcaggggccaaugaacaaaccauggcccgucuaaacaugggauaccgcguggccauaauacauaagauggacgcucaacgcacugugccggauugagcagcaagguggauugccgagggaagaagcaggucugggcggugugucucggagcugccaucaguguaaaagggaagagaaucaaaagugucuuugcuugucuaugcccagggggucucugggcagacaccgcaagucggugauugugaugccucuggagggggugcuggucaugggagauugcuuguuugcuggagaucccauguaccuuuugauugcugaagcaggugaauguacgccuuuccaagaaauuaaaaugggccaggugcgguggcucacgccuguaaucccagcaguuugggaggcugauguuggaggaucacuugaggugagggguucgagaccagccuggccaacaugaugaaaccccaucuccacuaaaaauacacaaauuagccagacauggugguacaugccuguaaucccagcugcucuagaggcugaggcaggagaaucaugugaacccuagaggcugaguuuacagugagccaagaucaugccauuguacuccagccugagcuacagagcgagacucugucucaaauaauaaaauaaaauaaauuaaaaacauaaggacuguaaccuugccuccugcccaguguaggaaggucaagguucuggcuacuucucaaguacaggagccucacucaggccccagaccacuaaucaaaaaauaugugcuugguucucacaaaggggccgagugugagggcuuggguguugcuugguaaauacgacccccggucccggccuuggagagauggagcccucucugggccccuuggacacacugcuguuggcugacuuugucauuuucaacccuugcuccgauuggcucacgucaugauuucugaaaccuuugggggcuuccccacugacagaaagauacacuuuaacucagcacugggcaucccaggcccucuuuacugggccucuucuugagccgcacuuggccugucaccccuuccucugucugcccucuuaacuccccaccuccgugccuuugcucauauaguucccuuugccugccuuuccguccagagcagucuccacgugcccagguccugucugacuuucaagggccagcuuaguuuccacuucugcacugccuucugaccucccuggcuucuguguaaacugcccagaucaagccacacaaugguuccugcacccaaggaagcucccuggggcccccuccuggccacucgcucuucgccgguagucaccacucacaccuuggcacuuucgcguggugccugccgcugccuguuugggccucccacacacagaguguacagaacggacuccucggugucuggcugccuucccgcagcacugucagaucauccagguugccuguaguggcccuuugguuuuuuucucugcugcguaggaguucaccaaauauaccacuauuuauucauucuccuguggacaggcauuggguuauguccagccucuucggugaauucauucuugucuuugggggcgcgugugcgcucuuugcuggguauacacccaggguggguugauggcuuaccugacucagaauguguuugcaugaaugaaauucagguugguaugagaaaucuaggguguccuggcuggagccaggcuucuugauuacagggacagagcagguacagggauccugguuuagacagccugcucccauggggugguagcauuguuggggugcaggaugcugaaucugcaggggaccuauccgcucagugcccagugggauuuuagcuggcuggaaagguggucacauguagaggggcucaacaauccagcuaaagaggcugagcguugguccauuguucucaauuugagagaaaacugagaucaucaaaauuaggacugguauguacuaaaggaaagaaccuaauuacaaggcugaauugaguaagcccucgcugagggacuuuggauuucuuuguuguuccccuuuauuucugcacccccacccaagugacagauauguacaugauuggaugauuuugcuuuccugguugagagauuccugggaacuuggcccaggagaagggggagaaauguggagccgcuagaguggccuccgcuuguuuguguugauugaaggggagacggaaggagagcuguggaccccugaccccuugugagggcaugugauccuuuucaaaaggcucaccaggcagaagugccuggccaggggccgcucuuucccucuaauccccucuggagaagggccaggcuguggguugcugaccugcucugauguggaucagccucccccaauaaugcagcugcccagaagcucagagagcccaggcaacccccaaaggcaggagggccggcugucauucccguugucauucccaggcggcuggagugggagcagagcggucaguucagaugaacagugcucgagucugaccccaaccagcgaguuaugguaagauggaagguucuccaucuauauuaaauaagagaacaaaagcccucccaggcugcaugaauauuccagggauauauaugugaacggguugccaguuuagcuuggccuguggguggcagccgccugagugagcacuucguggcugcagcucuaaaggguuuggaucugaaacuaaugaaugaaaauaugaccucagaagauuuaaagagagcaaauacccagcaacagaaccugggucccagagacuguugggagcaugaaaucccaggcuggccgaaggaggaagugggagagcaauggcagcugacaucacauggugccagaccuucucagugcuuucuguguucacucauuauuccgucccucucucucagaggcagguauggcugcuuccccauuuuauagaugaggaagcuaaggcaaggagagguuguguaacuugcucacagacacaaagcuagccaguggcaaagcuggaggucaggucuagguggucaggcuccagaguucugcggauuucacagcacggcaguggcagucggaagaaccauuugucaggugauugugggcaaaugacgucagcccuucaaaccucuguuuugcaucugcaagcugcuugcugcugcaacaaauuaccagaaacuuagugacuuaaaacacaaauuaggucgggugcgguggcucacaucuguaaucccagcacuuugggaggcugaggugaguggaucacuugaggucaggaguucgagaccagccuggccaacaugaugaaacccugucucuaacaaaaauauaaaaaauuagccaggcauuuggccgggugugguggaucacgccuguaaucccagaacuuugggaggacaaggugggcggaacacaaggucaggaguucaagaccagccugaccaauauggugaaagccugucucuacuaagaauacaaaauuagcaggacgugguggcacgcgccuguagucccaguuacugggaggcggagguugcagugagccaagaucacgccacugcacuccagccugggugacagagugagacuccgucucacaaaaaaaaaaaaaaaaaaaagccaggcgugguggcacgugccuguaaccccagcuacucuggaggcugaggugggagaauugcuugaacccaggaggcagagguugcagugagccgagaucgcaccacugcacuccagccugggccacagagugagacuccuucucaaaaacaaaacaaacacaaauuauagauuacuuacaauaagaaaaaccaauaaaaugcaugcgcacacauuaauuaucucacaguuuuggaggucagguccagaauguguuucacuggacuaaaaucgagguguuggcagggccauacuccuucuggaggcucugggggagaauuauuucccugccucuuccagcuccuagagaccaccuccaucuguggcuuguggcgccuuucgccaucugcaagggcagcagcguagcagcuuccacuuuccucucucugcuuccuuugucacgcugcccucuucucgcucucuaccuccugccuuccuccuacgaggacccuugugaugacaugggcccacccagguuauccaggauaaucucucauuucaggacccuuaauucagucacuucugcaaagucccuuuugccauguaagguagcauguucacaggcucuggggguuaggaugucaacaucuuugggggauuauucuucagccuaccacacagcacauaauaaaauccaugggcagaggggauagcagcaguaaggugucccucaaacaugaguuaaaaugacucugacgauagaaucugggugagauggugggaugcucccgaaauaaacuccaaggcagguggccaaguucagugacgacauagcugcguagcuuaucugagaaaggaugucucugauggggggccagccggaagacgucuuuccuggaagaggagggagguggggcagucuugggagaagugagacuuugggucccacggccagcuccugccacauucucaguggauuucagguugggaggagggauaccauuacaguugaaaauaaacauagaaauaaacgacacuggaugucugcuuccucaucagccucccuacaguucuggaagacgguccaggcccacauccccuucucugcuguucuagaauucagaacgcucagaaaucccaaagguucuucuaagucugcagcagacuaauuucugcugcaaaaaucugaccugaauugaugugauacuaauuauggccuuuaaaacuaucuuccuuagggugacuaacaguauguuuuccuaugaaaguacuauauguuugcuuuugggguguugcacccacccuuccaggagugucacugugucuagcagcauaauccuuucuaaaaucugaaaaauucggcugggcacgguggcucaugccuauaaucccagagcuuugggaggcugagguugguggaucacuugaggucaggaguucgagaccagccuggccaauauggugaaacucugucucuacuaaaaauacaaaaauuagccgggcauguggcuuaugccuguaaucccagcuacuaggaaggcugaggcaggagaaucgcuugaaccugggaggcggagguugcagugagccgagauuguuccucuguacuccagucugggugacagagugagacuuagucuaaaaaaaaaaaaaaaaaaauuuggaaaaauucuaaauucuuaaacccauuuaguccaaaagccuuagcuacaggacagugcaccuggacuuuucucccuaagaaacacagucagagagguccagucaccugccucaggcccagcuuaggugauaaugcugagguuccaacucaguucccugucucagagccugggacaaagugcagacugcguggccuggccucuuugccaccugcuggguggcgugugaaugagagacagguguggagacugcacucacuggcagguaggcuguaugugggggagguggggguccuugaauuuguuuucugucugaucugcagccuggaacugagccagggggccuugucuggggaaggacagagaggcagagagauugcagaggagaggggaauagcagcagccauuaggaagccuugggccuuugccuaucacuauagcacugcucuccaaacuuccuuggaucacacagcccuaucaguaaaaaagaaaccagaacaaaaccucuugaacaugcacccccaauauguggauauugguguaauuauaaguguauguuacaauaaguauacacguauauuacuuuacuguuucaguguguacguaauaaaaccuacaccaaaaacagaaaccaaaggccaagcuaaagauguaauaaagaaaauuuuuacuuuguugacgguacagaaaccuccuggguucauacacggggucauuuuuuggaacgugcgcuuucgugaucagugagagagaguuuggaaggucuggcuggcuucacguucggcuuguuuagagacuggguuuuaauggcugcuuucccugcaaaagauccugucugggacaggaagcugcacacggagcagacgcauccuuggcuuucuuucuaaaucggguuacucauuuuuccaucccguccacugaguaugcaaaggauuuguugaaauuuggccgguacauuuccauccucccugaugccaaucacguuuuuguaaacgaaauggaagguauuuuauuuuaaaauucuuaacaagcgaguccaaaacccacuaaaaugcuuuggaaaauuuuuaauggacuagaaaauucuguuacguagcuuuuuaggaguucagcuaugagaggauuuuuuuuuucuuuuuaaagucagugacagacauauuguuuuggugcaugccaguaauaccagcuacuugggaggcugaggcaggagaaucacuugaauucuggagguggagguugccgugagucgagaucgcgccauugcacuccagccugggcaacaagagcgaaacucuaucucaaaaaaaaaaaaaaaaaaaaacuauuaauguccacuuccaggcuuugauacuguacuacagcuagacuagacgucacccguugaggaagcugggugaagggcauacaggacccuagauucuauuuuugcaauuuccugugaaccuacgauuauuucaaaauagaaaguuuaaaaagucuuuaucaaguacagaugcacaccgaaguauuuaacauuacaucugggggacagggaaagaugcaacaagauugcgcaguguugcuaaccguuaaagcucagugauggagagguggaaaaauucauuacacuauuuguuccaguuuuguauguuugaaauguuccauaauaaaaagcuuuagacagcagaacaacagauuuuucuaugaaauguguaguaagauggggagggacucaguuuguaucagagauuuauugguuaucuuguggaaaagcaaucaauaaggauuguuggccgggcaugguggcucacgccuguaaucccagcacuuugggaggccgaggugggaggaucacgaggucaggaguuugauaccacccuguccaagagaccagccuggccaauaaggugaaaaccugucucuacuaaaaauacaaaaauuaggcaggcaugguggugggugccuguaaucccagcuacuugggaggcugaggcaggagaauugcuugaacccgggaggcagagguuacagugaguugaagaucacaccacugcacuccggccugggugacagagugagacuccaaauccaaaaaaaaaaaaagguccccugggcuaauuuuuguauuuuuaguagagacgggguuucuucauguuggucaagcuguucucaaacucccgaccucagaugauccacccgccuuggacucccaaagugcugggauuacaggcgugagccaccaugcccagcccaacaguacuauuaacugaaguacagaccuuauucaguuuucugcauuuucauguaggguguauguguaguucucuucaauuuuaucacauguagauucauguaaccacuaccacuaucaagauacaaacuguuucaucaccuggaaggaacuccccugguacccuuuaaaauuacacacccccacccaucaucgucacuguccucugccaacuacuacaccaugcuccaucuuuauagcuuugucauuuugagcauguuacauaaauggaucaugcaguaugugaccuuuugagauuggcugguuucacaaaauguaacaccccugagauccauccagaucacuuguguguaucaguaauuuguucuuuuuucuugcuggguacuauuccauggucuggauauaccagaguuuaacuuuuugccuguugaaguacauggguucuucccagauuuugaugauuacagauacggcugccgugaacauuuguguacaggcuuuugugugaauauacguuuucauuccuguagaauaaauguccacagugauuacuggguuguguaguaaaugcauguuaguuuuauaagaaacugccggggccaggcaugguggcucacgccuguaaucccagcacucugggaggcugagguggguggaucacaaggucaggaguucaagaccagccuggccaauauggugaaaccccgucacuacuaaaaauacaaaaaaaauuagccggccaugaggccgggugcgguggcucacgccuguaaucccagcacucugggaggcugaggcgggcggaucacaaggucaggaguucaagaucagccugaccaacaugaugaaaccccgucucuacuaaaaauacaaaaauuagcugggcauggugacacgcgccuauaaucccaccuacucaggaggcugaggcaggagaauagcuugaaccagggagguggagguugcagugagccaggaucgugcuacugccccuccagccuggggcgacagagugagacuccgucucaaaaaaauaaauaaauaaaaaaaauuagcuggccaugguggcgggcaccuguaaucccagcuacucaggagacagaggcagagaauugcuugaacccgggagguagagguugcagugagccaagauggugccagugcacuccagccugggcgacagaccaaggcucugucucaaaaaaaaaaaaaaaaaagaaagugccaaaguuguuuuccaugguggcugcaccauuuuaucuucccaccagcaaugugugggagaucagguuucucugcauccuugccagcauuugauauugucaguauuuuuuauuuuauagguauaugauauauauuuuuugguacccagguaugggaugugaagguguuuucaguuuuucaguuugcauuuccuuaauggcuaaugauguuuaacuuuuguuguguuugccuguuuguuuguuuuggagacagagucuugcucugucgcccaggcuggagugcgguggugugaucucagcucacugcaagcuccaccucccggguucaagcgauuguucugccucagccucccgaguagcugggauuacagacauguaccaccauacccggcuaauuuuuguauuuuuaguagagacaggguuucgccauguuggccagacuggucuugaauuccuggcuucaagugauccaccugccucagccccucaaaguuuugggauuacaggcaugagccacugcgccauguacuuauuugcuguguaucucuucuuuacugagauaucuguucauguauuuugccuauuuucaagugggauuguuugguuuucuuuuuaccauggugcuuuuuuuuuuuuuuuuuggagacaagagucuugcucuguccccuaagggcgggagugcaauggcacgaucuuggcucacugcaaccucugccuuccugguucaagcaauucugcugccucagccuccugaguagcugggauuacaggcgccagccaccacaccuggcuaauuuuuuuauuuuuaguagagacaggguuucaccauguuggccaggcugaucucgaacuccugaccucaggugauccgcccaccuuggccucccaaagugcugggauuacaggugugaaccaccgcgccuggcccauggagcuuuuugagcauucuucauacauucccaaugcuagucauuuaccagaucugugacuugcaaauauauucuuccacucuguggcuuguuuauucauagugcauaaguuuuuacuuuucuuauauugcaguuuaucgauuuuuuccuuuuauggaucaugcuuuuggugucaagucuaagaacacuuggccaucucuagguuucaaauauuuucuccugucuucuaaaagguuuagaguuuuacauuuuacauuuaaaugugugauuuauuuugaauuaauuuuuguauauguguaaggguuuauguuaagguuuuuuauuauuuauuuauuuauuuauuuuugagauggagucuugcucuguugcccaggcuggagugcaguggugugaucuuagcucacugcaaccaccaccucccagguucaagugauucucccgccucagccucccaaguagcuggggauuacaggcacaugccacuacgucuggcuaauuuuuguauuuuuaguagagacaggguuucgcuauguugcccuggcuggucucgaacuccuagccucaagugauccacccaccuuggccucccaaagugcugagauuacaggucuucgccaccgcacccaaccaauguuguuuuauuauuauuauuuuuuaaucaguguugaucagguuagccucgaauguguagccucaccuccccgagugccagggcaaccggccugagccaccgcggcucccauuauuauuuuuauuuauuuauuuacuaguuuuugagacugcgucuggcucugucacccaggcuggagugcaguggcgcgaucucggcucacugcaagcucugccucccggguucacgccauucuccugccucagccuccccaguagcugggacuacaggcgccugccaccaggcccggcuaauuuuuuguauuuuuaguagagaugggguuucaccauguuagccagguuggucucgaucuccugaccucgugauccacccagcucggccucccaaagugcuaggauuacaggcgugaggcaccuugcugggcccuuucuccauuuauuaaugggacuucuauaaccuagaacugucccuuguuaauuauguaauuccccugaaauguuauaaugaagaaacugaggcuccgagagaaguacccgcgcagguugcacgugguggagucuagugggaguccuguagggugacucacagcagaagccugguuauguccccaccacauggaagccuucucugacccccuccccagccugcccaagcccgaugcuugcucuaggcuccuguagugcuggacacucaccucagcagugcaaggggaagaggccuccaggucacuccugccuguggcauagagaaggcaugaagaauggcuuggagcaccuuaaaggcugaggcugggucugccggugccuggcauggaguccagaggccucaggacuuguuagaaagaugauuucagcaucuuccaucagggcccucugucauguuccuggcagaaguuuaacacuuggucaauuagggaaauaaugggagacaguugugguggcucucgccuguaaucccagcacuuugggaggccaagaugggaggaucgcuugagcccaggagcucgagaccagcgugaguaacaugguaaaaccccaucucuccaaaaaaauacaaaaauuagcugggcaugguggcucaugccuguagucccagcuacuugggaggcugaggugggaggauggcuugaccccaggaggcagaaguuguaaugagcuaaggucaugcuacugcacuccagucugggcaacagagugaagcucugucucaaaaaaaaaaaaaaauuuguuggacaugguggcacaugccuguggucccagcugcuugggagacugaggugggaggaucacucgggccuagggaggucaaggcugcagugagcugugaucaugucauugcacugcagccugagcaacagagcaagacucuugucucaaaaaaaaaaaaaaacagcaucaucuggaucugguccugccagagcagcuggaauucugagccucaucuguuugcauggacugcauuggaaaaggggagacauggauggagcccuuccccaccccuuuccccacgggaguaaagaggcugcaccagauggcauugccccugcuuccccaagguccacaggcugugccaggugaacguccugcuugccugugggaccugggcaggcagcuucccggucagugccuguacagagugugaaagggucagaauccagugcccacccugccccagccccaacacacugugaacaguuugcagagucuggccuuguggucacugacuugggaguacguuugacagccuccgucugcugccuuggguccagggagcaaggcgagcucugggccuucaagcagcugccugcaccugcuuucuuggguauuggggaccaugcgucuaugagccagaauacggcuuuaaguauuuuggggaauuaugaaaacccuugaauuguugccacccuggguggcuguaaaaccaaguucugcaucguuuuccucaucucuaagauggagauaauguuacuuucuucaaaguugccuugagaaaauacaugagauaauguuuggggaaaugcuuuguaaaccaccgggguugcccaagaguaaaauaaguuguuuaugaauuggccucggugcagaaacguggccagcauggguugggcugcggaaacacucccagccaugguggcuucuccuccacccugggggaccugccuccccuccugcuagaagagucuggaggcuaugggaggaaggguauggccaugucuuguuaggaggcucuggagcaggagggguggcucagcuagguccccccacuuuguaggaggugaggagacaacguguugauaggaccuggccuugaguccuggcucugauuuggggguaagucacucacaucucugggugcauuuccucuugugaaauaaacgaccuauaugaagaacgugaaggggcccugaaugccaagugggcaugggcacgugagugggcagagccgcaggaggaagcuggccuguagccuucacccacaucccagcccuggcucgggucugcucucugggguugccccucugccugggaguccaagcuggggguuucucaacaccgcccuuagucaugaacaaaacagccuucgacauccccccacaccuugcuuggaaggugaagauuugagcguauuuguacuuccuuugguccccccacaauuccccauguuuauucauuuaauuugggaugauagacaaagaugaugauuuacaaccccagucuuuuucaagaaauauuucuggcacugguuuucaguuuugcaaccauacuuacaggagcuauucuuggacuugucacugugucucuuuuucaaagcuugccaccagucuuuauauagacaccuucuccauuuuugaauuucuuuauauagacgccuucuccaguuuugaguuuuagucucgauuugugucucaauugguguguuaagagaucauguauaugugggaaaauagaaauguacagggcucuccuagggugcacacuuacagcuaagagccgacaugguggcggagaugcugcggccguuggcgaggagccggggugcaggcgggcagugcagacagacagcgggcgcaggauccucugcaucgcggggccaggcugcaggccgccgcacccaggaaggcccagggaaaccuccguuggugucaggauauucugacuugaauaccagcuugcgaauuuggaagggaccaugagaucaucuagguugaccucuggguucagaccgagacggucgggguugguguucgcucauucucugagcucauuuuuggagcagggaacccacguggcugguuggcgggggagcuggugcucacgcuccagccaggcucuuuccucagugccuacauacugcacuuugcaucuuuuaaaauugucggguguuucucugguugcauugcagguuauugccagaguuggugauuugggcagagguguuugcuggauggcacugaccagccugucagcagguggcuguacugaaagggccgccccaucagggcuuggguagagggugcagccaggcuccugccuuagucuucuugagccacuaugacaaaaucccauaaaucgacugccuccuuccucacaguucuggaggcugggaaguccaagaucaaggugcuggcagauucaguguguggagaaggcucacuuuuuggcucagagacggugccuucucccuguguccucaugugguagaaggggcauggcagcucucugggguuccuuuuaugagggcacuaaucucauucaugagggccccacccacuauucuuuguuucacugugaggcaccucacgaucuuuggaaacaagcagugaaaaucaguagauaggccaggcacagugacucacgccuauaaucccagcauuuugggaggaugagacaggagaauugcuugaggccaggaguucaagaccaaccugggcagcauagggagacccccaucucuacaaaaaauuagaaaauuagccaggcuugaugacgcacgccuguaaucccagcuacucaggaggcuaaggcaggaggauucuugagcccgggaggcggaagccgcagggagccgagauugcaccauugcacucuagccugggcaacagagcgagacccugugucaaaauaauaauaaucaaguuaaguauuguaagugggcugggggugugagaucuugccucaaagaguaggcaggaggaugaacaugugaguggugacagacccgcguguucgaggaugcggaauggcuagaagucucagaacuggagaaggugugcaggcaggcuuucaggagggguggcacaugggcuggguuaaaagaugagaguuuagagguacacagauuggggaggagccacagagucuccaaaacagcacagcuggaugauggggagugggucagccauuaaggaaagggggagaaauggcgaagaacgcacacaggcccucggaggaggccucagcaguaaagugguuuuacuggcuccaggguauaaagauguucaggcccaccaggaagcucccgaauuucuguuguguguccacgguucccagugcugccuguauagucccaaacagagccgcuguccccagggggccugcauucuaggugggguggggggaacaguuaauaaauacaugagugaaucgaguuagucggguggugucgauguaaugagugcucuggaggaaaagaaaggaaagcagggagucaggcaugcccagccugggagaggcugacauguuuucaugguggucaagguagagaccuaaaggaagggugggagggagguauuugacugagcagagacagccagugcaaaggcccuguggcagaagcaggcuuaauauguucaaggaacagcaaagaggccagcguggcugcagcugaggauggaagugggaacuguaggagcugagaucauagaggacaggaggucccaucgaguccuuggguacggacuaugguuuuuacucuaggggagcugggagcuauuggagaguuuugagcaguggcggccuggucuggcuaauccuuggaagacucacaaacaugcugaguggggacuggucauuagaggcaggggcagaagcagagaaacuggucaggggccuguugcaucaauccaggggagaggcuggcugggacagggugaugguuggggucaauacagacauggucaggagguggguggagagaccuggaagauucuuuccaaugcugccacuugcccugggaggagacucacauugcaauuucuucucucuaggcuagcuugucacuuucugcaaagguuucccucagggagccuccugcugccaggcaccaugacagugaggggggaugugcuggccccggauccagcgucgcccacgaccgcagcagccucgcccagcgucuccgugauccccgagggcagccccacugccauggagcagccuguguuccugaugacaacugccgcucaggccaucucuggcuucuucguguggacggcccugcucaucacaugccaccagguacccaagccuggcaaggggccucuagaaagguccagaaagguuccuggcugaacagaguguggguuaggcuaggcuaggccaggcugcacugcaguaguagguaagcccucuguucucagaggcuucccucgauagaagucuacuucuuguuuguuuguuuguuuuuugagacagagucucacucugucacccaggcuggaguacaguggugcgaucuuggcucacugcaaccucugucucguggguuggaacaauucuccugccucagccuccugaguagcugugacuacaggcgugcgccaagaagucgcuuucuugccugcgucccagggcccagugcagcgcagguuccgacguguggcucuggcuucaagccucgcccaucugacaccuagcagcagggaaugugcgaaggcacucuguauauuuaaccaccuccagccagaggugacacucgucacucuguucaccuuccauuggcuggaacuagucucguguccagccuaaacaacagagagccuagaacugcaggagcacagggacagggaccgcuuugcagaugagaaaauggagagccugagagggagggggagaggaacuagccuggucacuuggaaguuggugguagagugggauagaagucaagucucccgucugccuguacuuguggccccagaggaggcugaugugggcugggacgggccuugguggcugcagagguuugaaggugguccaguggagaggggcagggugagucugcucguguucccuagucagccccuugccagcugcccuguguccccaucccuuuuagaacccauuugcguccaaggcuuuuggcucauagcagauggagaauauuuuguucuuuuccuccccagcccagggcucggcugggccaagugugaugucaugagagcugggacgagacacccaggggcugccuggacugaggacugugguagagcagcucuuggcauuuguguguagcuuuuacuuuuuuccucugcuuccuaaaaguagcauucauucuccuaacuuccuggugagguagcugccuaacuaaacagagcagcaguggugcugccucuguuuaccagaugggaggaggaggcacaaccugaggacaucccugcagccacucggccaggaaguguguccacccgccauagcgugagggcugcgucugucuugccauaaguuaagggacggggcaaggcugcaacccagguggcagugauuuagcucagugcugccacagucacagccggagugagguagagggaaagggcacacacugauggcccagagcugccagugcgugagguccccuggggagcuuguggaaacugcauuuccauccucauccuuggccuuccugugggcaggggugugggcucacugccaccugcaccugcaagacugccccacaggcacugcugcaugcacuccacgagccuugugcacgcccgcuggucugagucucacaauggccuugggaggcaaguccugucaucccgcauuuugcagagcagggcucugaggcucagggguaggucacgugcaucgggucacagaugagucgguggcagagcuggaagcccaccugcccucccgucccuguggacaggaggguccccagcugaccccacaccucugcccccagaucuacaugcaccugcgcugcuacagcugccccaacgagcagcgcuacaucgugcgcauccucuucaucgugcccaucuacgccuuugacuccuggcucagccuccucuucuucaccaacgaccaguacuacguguacuucggcaccguccgcgacugcuaugagggugaggauggggacggaguggggagggcuggcggggggcuggggggcugggagccccuguccccacauuccuccccgaggggcuucaugaggacugucuugacacaccccuugcugcuuuaccuacuacaggguuucugucccaaauugacagguaacagcacaugcagcuagagucucaccucacagguaccuggaagcaagggcccuccaccugggucucgcuucucaaugcuggcgucucaggcagguaccuggaagcaaggacccuccaccugggucucgcuucucaaugcuggcgucucaggcagguaccuggaagcaagggcccuccaccugggucucgcuucucaaugcuggcgucucaggcagguaccuggaagcaagggcccucccccugggucucgcuucuuagugcuggcgucucagacagguaccuggaagcaagggcccucccccugggucucgcuucuuagugcuggcgucucaggcagguaccuggaagcaagggcccucccccugggucucgcuucucaaugcuggcgucucaggcagguaccuggaagcaagggcccuccaccugggucucgcuucucaaugcuggcgucucaggcagguaccuggaagcaagggcccucccccugggucucgcuucucaaugcuggcgucucaggcagggugggggcagcaagcaaguggucuguuuguagagaccccagguggccccaggugcaguuggguagggacccuuccagggaucccuggcaagucaguggcagggcuggggcucuguccccaugggucuuaauucugagggcuuugucccacgagugggugcccuacugugccacccaggaagaagacucgauuccuuccggggacuugguucuggauguggaguggagacaucaccugcucccauccugagcuccgaccacaggccaggagcuggguugccaagaggagaagccagccucaccccugcugcccugcgggaggcuguggccccuaaacagucaccacaaggagaccaggaugcugcucucaugggagcuggccucugaccugucuugggcaggucccaggcauuccucaucuguuagaggccagcaaugcccaggucugcccuagacaggccagcaggaauggagaggagggguuccucaagaccccugcauugggcugggugcaguggcucacgccugaaaucccauuacuuugggaggccgaggcgggcagaucaccugaagucgggaguucgagaccagccugaccaacauggagaaaccccgucucuacuaaaaauacaaaauuauccgggcauaauggugcaugccuguaauuccagcuacucaggaggcugaggcaggagaaucacuugaaccugggaggcagagguuguggugagcugaggucgugccauugcacuccagccugggcaacaagagcgaaacucugucucaaaaaaaaaaaaagaccccuacauugauacccaugcuauucucagagugugagguuuccugucuccuacccacaccugugcugcugguuuuagguaaagugaccggaugugguuuuccuaaucucaggcagagcagcucuggccaugcccagaaguugucuguuuccuugaccugggagggugcugccccaggccugcacucuguggauauuggagugaagcaugcucaucccccaagcagcuggagucucucuuccucuccacguugaaacuuguguaucccugagaacucauagggcacaggaaaugccuuuagguuuggcaagaaaauggaggcgcccaacaggagcccauugcaccccagccuuucauauuucugccuucccacccccaacugcggccacaucaggcaggugcuucccagccucaagggcuugauacgugcuguguccccggccugggaagcucuucugcucugcguggggucccuccuuuccauccgucuguuccccgccacucucacucccagcacccauccagguccucggccccaccacagucugcagcucccuugcuucguguuccaucuuccugagcaugauuagcccugccagagcaggauggggugcagccaugcccagacagagccgggcccaugggagaugccuacuuccucccuuuuggaugaauaagggacuuaaucaaaccccugcccugugccuugcauuccuccauguggggccucaguaacaucccaugcucccuccucgcaggcuggcguuccauccuguccuuccagaugagaauacugaggccagauggggaccugcucagggcuuaacuggggcucuggugucugauauuucuggaagcagccaagucuccagggaaaccucugggucccuggggcaccauaaaggcuggaauuggcgaaguguggggcugagaauccacuuccauucagcugccagccucgcauggguacccaggggcagccucugcccaccuguuccuucagaagcacaaagcuguucccugccaagguggccucuccuguguggucgggggacaagugugggcucucuucucggcgggaccccaaagacaggcgcauggcagaaggcggggcacacagccaggggagccuccgcuucacucucacuccgugccccagaggcggcagcagauggcuggcgggcaccccucacuccagaagccucuuuguucaggccccgccugcccugaccugccucccugcccggggagagguccuccaggaagucggccacccugugaagcacaucuccuagcaacgcgauuaucccuuuggccuggccucucccagggaguuuacaaacaguacagcagcugcagugaaguucaggcugcccccgaguucaccagcuuuuuuuuuuuuuuuuuuuugagaccguugccaggcuggagugcaguggggcaaucucagcucacugcauucuccaccuccuagguucaagugauuccccugccucagccucccgaguagcugggacuacaggcgugugcuaccacgcccagcuaauuuuuguauuuuuaguagagacgggguuucaccauguuggccaggauggucuugaucucuugaccuugugaucugcccgccuuggccucccaaaguggugggauuacagaugugagccaccgugccuggccaaguucaccagcuuuuagcaucagaggcagcggggccugcuccuugccuugucccugcaccacugcucuggguccuagccccucucuugcagcugccucugcagagucagugauggggcagucccccccgauccuuguauuuccccucucacccuuccuucucagugcccaagaggggccaggagggcccaggagggagugggauucaccugggcuggagaacucugcagauccagccagcccuuccugaggaccugcucagagcugagcacuacggucauuugcuuuuuuucuuuuuuuuuuagagacggagucucgcucugucgcccaggcuggagugcaauggugcaaucuuggcucacugcaaccuccuccuccuggguucaagcaauucuccugccucagccucucgaguagcugggacuacaggcacacgccuucacgcccggcuaauuuuuuuuuuuuuuuuguauuuuaguagagacgggguuucaccguguugccuaggcuggucuugaacuccugagcucaggcaauccgcccgccuuggccucccaaagugcugggauuacaggcgugagccaccaagccuggcccugcuuuuuuucuuuguuaacaaaauucugcuuuuaaaaaacacuaaaaaaaauuacauuuauuaaaguaauauaggcauaugguugaaacacgaaacuccccuaacuccucacucugaaguucacuguacuuucaacucuuucagcuguuuucuuccuagaaugaccuaaaauaugcuuguacugguuuuuguuguuguuuguuuuucaguuuuauaugauguuacauggugacuuccuacuauggaagggcuuuguuuaagagacaggucucguucuuuuuuuuuuuuuuuuuuuuuuuugagacggagucucgcucugucacccaggccggagugcagugacgccaccucggcucacugcaaacucugucuccuggguucacgccauucuccugccucagccuccugaguagcugggacuacaggcgcccgccaccacaccuggcuaauuuuuuguauuuuuaguagagauaggguuucaugguguuagccaggauggucucgaucuccugaucuugugauccaccugccucggccucccaaagugcugguauuacaggcaugagcaccgugccuggcacugaagagacaggucuuguucugacagacacaggcgugugccaccaccaugccccgcuaauuuuuuuuuuuuuuuuuuuguagagaugaggucucacuguguugcccaggguggucuugaacuccugggcucaaaugauccuugcgccucgaccucccaaagugccgggauuauaggcaugagccacugcauccaaugcauuuccuuuucuuauguaacuuuuuguuuuugcuccaguuacuacuugccuucuuuuaguuugcugaguuuucuacauauaccuaucacuaguuuauuccuaaauacuucaguugaauuuaaaaaacaaaacaaaacaaaccaaccaaccagcccugcucucaguaaagccaggccaauccaggaaucccugagcucugccauuuuccccgugacgcuucuccuggugccuucucccugugcugcagucaggaaugccugcuuuccaggcucccgcugcucagcuguugcccuggcucuuucauucaccauaagccuggaaaccgcuucuccugugcugagucaccuguuccguggaggcuguuuccuccuuguucaugguuugcucucccugccugguuggagcacgucuuccagcagcuuccugagaaagagagugcaugggaggucuauuuuguggaaucugaaaauaucuuuaguauauuguuguauuugauugguauucaagggaaauacaauccuaaguuggaaauccuucucccuuugaauuuugaaggcaugucuucacugucuuagauucugauguaauuucuggaaagucugcuguauuugaucccuagugccuguaugugugugugaccugcuugugcuuuuuuuuuuuuuuuuuuuuuuugccuuuuuuucccccccucuccucuuugcauuuaggaucuugucuuaauccccaguguccugaaaucucacaggaggugggauagucauugugcucggcaaccuggcgggcccuuccaguguggaugcuccugccuuaagguucugggaagucuuucuguauguuucuuugaucauuucuuccccuccacuuucuuccaaucucccuuucuggaauuccugcuaguaggaccucgcgcuucuggauugagccucagauuuucuuuauaauuuucuggcucuuuuuugguacuguuuuccaugaacuuuguuuuguuuuguuuuuuguuuuugauuguuuguuuuuuuaaucuuaccuuugagcuuuucuguugaauguuuuaguuccuuuaucauguuuuagaaugucaguagcucucuccauucuuuuucuuuaugaugccuuguucuugguacgugagagaguauuguuuuuuggucucuggggauggucauugcaguuuucuucuguucccuacauugucucuaucucuugaauuccuuucuucuguuuggucgcuuuggucuuugaccuucuuguuagaagcgcuccucaaauaucaguauccuuggcuauuuuuuauauauaagaagggcuuaaaauaccagcaacucaggaggcugaggcgggaggauggcuugagcccaggaguuugaggcugcagugagcugugaucgugccacugcacuccagccugggcaacugagcgagaccucgaccucaucucuacccgccccagaaaaaaaaaaaauugcuggaccuccugauugggugauggaacaugggguguuuccuuggcuguuuguaugcagcauggggggcagguaccaaaugaagccuuuuuaaauucugggaccuguuucuguagagaauaauuuuucaucuccugccucaaaacacugcacaggcugagugacugguacagcguggcagagaucugagaggaccucucgcccuucguauucaggcuuagucuuuggauuuucuccaaguugucccauuacugcccucagcuggaccguguucugaggauagagcugucucagccucuguugaaacuuguaaugcaguggcuccacguggagacuuuuaaccagcuucugcgucugcacccucacccacagccaccagagcugccuggcaugugcagugcugauuuuuccuagggcucugacucccacccccacccccaaccauccgccacucggugaccauggagcggugggcauguggcguucagagcuuuguugaugucgcuuggcuguugccacuccucuuguccuugaagguuugcuccccaccccacccucauuccuucucauuucaguggcguuaggagggcgaggagggggauaguggagauaaguguguguuuagccugugaacccugugacuagugcuuccuguucucaaagagagggcugagucuuggaagagggcuuagugccacguaccaucugcgagggcuggaauucauagugcuggcaugugucaccagaggguguggaggggcaggcagaugggggcagggugggaaccaccccccauaugcauucaguguuugauugugggguugggggugggccauaaagacaacucugagacagugcuggggaguucugugaucagaggcacagggccuugggguucagaggcaggaggcgguguccguaugucgcuuuaugcaguugcuguuuguuaggaauguuugcguggcauuucacaguuuucccacguguuuuucaucacuguuagcucauucucaccucccaaguaccuggcagaguauauauauuauccccauuuacaaaugugaaaaaaauuugaauaggcucugaaacuuguccagagugacccagaucuuguaauggccaaaggccaaacuugcagcugggucucugaauccuagggcucugugccagcauggugaaagagaggacaggacaaguuucuccccuggaaaagugugaacuccuguuagggaaagagauuugaaugcaugacagcaacagagaaugaugcuucauucacuguccaaccggggugagcacagccgagggccgcaggugcagggccacacaagagccagaggccaguuugcugccagaaggacucccuggcuggcuguggcucuugcagauagagccaaggauuauaagaccucgauaguggccaggcgcgguggcucacgccuauaaucccaccacuuugggaggccaaggugggcggauugugaggucaagagaucgagaccauccuggccaacauggcgaaaccccaucucuacuaaaaauacaaaaauuagcugggcguggucgugcaugccuguagucccagcuacucaggaggcugaggcaggagaaucgcuugaacccaggagacggagguugcagugagccgagaucgcaccacugcacuccggccugcgacagcgagagacucugucucaaaaaaaaaaaaaaaaaagaaguugauagauccaagugcagaaagacauucagaagaagccaguagaagagaggucagaaacagcauucagggcagaaagaagcaggaauaagcaugaucagcagaggauaaaaaagccgcgagggggcugggcgcaguggcucacaccuguaaucccagcacuuugggaggccgaggcagguggaucaccuaaggucgggaguucgagaccagccuggccaacauggagaaaccccaucucuacuaaaaauacaaaauuagccaggcguguggcgcaugccuguacuuccagccacucgggaggcugaggcaggagaauugcuugaacccaggaggcagagguugcagugagaucgcgccauugccauugcucuccagccugggcaacaagagcgaaacuccgucuaaaaaaaaaaaaaaaaagacaguagggaggagaagaggaaccauuuggcacagcuuagagucuggggucacuuguaccacgcagaccccugcccccuugguugcaacacacugugcccauucuuguccaggaugaucacccaucacugaaaagaggcauaagaacguucugaggccccuauuuucugagcagagaagauuucugcccaaagugggcaaaauuaacuuuuccaggcucauccacccguuaucugaaauacagaaugcccccagucuuuccaaguaaccagaguguuucucugcagcagaaggcugggccaugaggccagcuuuaggcgcugaaggugugcacagggggugagcuuagaauggcccagugugcccagggucaucggggucccgcacgcaguguguggcacacaguaggcacacagcgaguguguauugaaguuauagcaaguuauaugagugugucugccuccugacccugggagcugcacgcagaaacgugagagggcaaguacugagucuuuucucaaagcccgggggcucuugggguaagugucuuaggugcuccaugccugaauuuccuuaucuguaagcggggauaacuccuuccuugugggggaaugaggguggccguugcggggggaugugaacauguagagccuuacaacugcuggguccuguagcauuuauuaggucacggggcagcugagaggcuggguggggagcagucucuuggccuacagcuuccuacccaggcucaaggagcugccaauaggaaagaaggccauucagaagaagccaguagaggagaggucagaagcagcauuugggagggcgacaaacaggaauaacaggauccacaagggacaggaaagucacgagggagaagccuggagccucggguuuggaagggacugcuuuagaaagucugcugagggguuacccagccugauugcuucuguuggcagcaagcucacgacuuccaccucuggacucugcccguuagaaaugguuucuuauaggccaggcgcaguggcucaugcccuuaaucccagcacuuugggaggcugagaccagcggaucacuugagcccaggaguucaagaccagccugggcaacaugguaaaacucugucuuuacaaaaaaacaaaaaacacaaauuaggcaggcaugguggcccacaccuguagucccagcuacucaggaggcugaggugggaagauugauugagccugggaggucaaggcugcggugagccgugaucgcaucugugugcuccagccugggcaacagagugagauccugcaucaagaaaaaaaaaacaaaaaaaggaaaugguuucguauauugaguauauugagcugcaguccuucugggaucugccccugggagucccaucugccccugggaagaaggugguugucacgucuauuaagagagugaccccugaugucuucucguccccagcacaguccuuguuuuguguucauccugguccuucucuccugauacugugcauuugucucuaguuugagauguggugucuagaauggagcagaaaguuccagauggggcauggggguggggagcggacagccuacucucauuccaacgauggaggaguuccucccagaggcuggccccaaggccaucaacuuuccagucuccaaagacaaaacccuccagagaagacacagccugauuguccaggccaggagagagaggcccuccggucccucacgcugguugcugcccucuggacuuggccugagggcuccuuggucauuuaugagagggcuuagcacagagccuggcacaccagcugugguagauauuuagggagauguagagucauugugugucuccgaggccucuccaggggucugguacuggagccguggugggaagggcggugggcagugagcuucccggucaagcaccucccuccagccccgucucagcuucuccgcucuucuuacauccacgcacgcaucuuuuauuuguuuccaggggauguguugaguuuuccauuuuaaacaccuuugcuaagauguuggaggugguguuucacauggcucuguacuuuccaggagggagacugauguguccaguuggucaguggggccaggcuugggccgguugcgucacgucugaggagauucugucucaucuucuccaagaauuagggaguccauuaucgacucacuaaugauuguuuaaagggaacugucagcaaauugguacuuuacagacuggcuggccccagagcaccuccaaaaggucaagaaucuugaacugagagggaugaugacauuugaugauucugaucaguugugugcagagccgguuacggagggaccucggccacguaauucaaaagugugcugacugcugacauguguuuugaugcaggaaaggacacgagcccagaugccaagccuuucuugggagaggacugcagggaugggcucucccgggagggagcuuccagauagagagggcuuaugggccuggggccccuguggcuucccuggaggguuuuguuguucgagacuggaaagcugauagucuuggggccagccucugagaggagcuccuccaguguuggaaugagagugggguguccccuccugcccugccugagccuguugucauggcaggcuccccuggggagaugguccauguacgucuguccauuccuuccuucaguguugaugacauguuuguagcugccaggcccuccgguagucauuggagguaggacugcauucuaccugcaaggaguuuacagucuggaaaaagcaguagguaacacaccguggacucuugacugugcccucagcucaucuaaggcucugcacguucacagccccugaccccaccaagggaggaguuaucccgcuuacagaugaggagauucgggcauggagcgcuuaagacacuugccugaggccacacagcuccuaagaggugggaccacaguucacaaccaaggcaggcugucuccagggcccauggcucuuuaccuuacuuaauguugcuuuugugccggagggaucaggcagagcccagagaggggugaugugugaaguaagcagggugcaggacagaagaggcggcaucucaguggggucugccucugcggugagcagagggaccagaauguaccauugcaugcaggcgugagugaucacagcacgucccaggagcuucagucaugguuuuaucuguauuccacuuaccauggcugugcaaauaacuacugccaaaacacacuaguguaaaacaaccauccaguuucuucauggauauuauaggucaagaauuuggacugggugcaggggagauaguuugucccugcuccaugaccucugggccuuggcaggagagcgugaaggcuggggcaaaucaccugaaggcucacucccuugugugccuggcaguugaugcuggcugucagcugaaggccucgguucccucacaugagccucucugugcggugucuccaaaggcuagcucgugcuuccccgcugcauggugacugagugcaaggacaggcauucaagggaaaaagagccagaggaaagaggccucuuccaaccccuacaucagaugucacaaaacaucacuuuggcugugguuacucagggccaccagauacaaagggagggaacaagaccccaccucucagaggaggggugucagcaucacgagguguggcagucuagaaaaugcaaccgucggccgggcgcgguggcucacgccugucaucucagcacuuugggaggccgaggugggcggaucaccugaggucaggaguucaagaccacccuggccaacaugguaaaacccugucuguacuacaaauacaaaauuagcugggugugguggugugcgccuguaaucccaguuacuccagaggcugagacaggagaaccacuugaacccuagagguggagguugcagugagccaagaucgugccacugcacuccagccuaggggauagagcgagacucugucucaaaaaaagcaaaaacaaaaaacaaaaacaacaaaaaaaaauacaaccaucaugauauagcuggacccggcuuagaauggacacggucauugugcuuggccuugugagguuuugaacagagguuacuggcaggcugacaucagguuuggcuuaaugcccaccccuuucccuuugccccauaguucuugcuggugaagagucaucuggagauugguggagacuugucuguccugagacauccugagcugccuccagcacaggcaggcaguacacacagcccucagcccugucuaggggcuccuggcccugcaggcagcagauagacgguaauggucgugacagccaacacccagcgcagugagccccggacacacuucugaacacuuucaugcucacgccucacagccaccugccaaguuggugcuccugugauccccuuugauagaugaggaaacugaacccaaagaggcucacacacaucgcauaccucugcuguaugugugugaagggugaagggacagucacaacaaggcguggucagugcugggggacauauacauggggaugccaccuggagaugggagcccuuaauggauuagggcaaccgugaguagcauaaaaugccgcaaauguguuccuuuccaaaucgcugaaggccagcuuugccuaaaaaacaucaccagggcuuuccacgcuccaguucagucagugaaacuguuguggugugccccgugugugccaugaguggcaccuguguccugaggaaggcgagagggggagaccagucauugugacacagggugggaagugucugcaaaucagguuccguggguaggagggcacucaccuccacgauggucaccggggacuugucacacugggugccaucccagcugggguugauggauccugagaguacagcgggaagggugcuagaaccucugggaucugggagugcagaagcaccgaaggauaagagaaccugcucuggggagaagugcagcauuagugcugcucgggaguggcgggagcuugggcagggaccaggucacccauugaaagaucaagugccaagcugggcggcaccagggagccuaaaaggacucuguacugcaggggcuggcggggucagaugagaagaagcccucuggcuggagggccaccguggcucccucgaccuguucugacccuguucugccccuccccuuggccuugugccuuuacuggaugcccauccucauucccauguccucacccuggcucuuccucuugcguucuuucauuuuggguaccgucugcugcaccccuucccccgccuucuccacacucuccuccauccuggcauguccauuugccucuagcacccugcaggcagcagccuucauuuugcugacccagaaggaaccaccugaccaggagacccguuacagcguguugcuguauuuauagcaucaacauuuacagcagacuugcugugccaucacucccgguggcaaauuuugggucuuuguggagauguugagccgagucccaauuuagaaugagcagcccaagcuucccaagguuuuuacuguguucugugugcugccgugugcuuuguuguagcucauagugcugugcguauuccggauaccgcuacagguuguugacuggaugaagguucuucccucucacuccugcuuggaauuucucccaagauuuucacagagacuguuuuguuguuaucuuauaaaauugugaccuguaacacacaaguauguaagacaaauauuuauuuauaaauacauuagagaugaggucucgcuauguugcccaggcuggagugcaguggcuguucagaggugcgaucccacucuggaguuugacuugcucuguuuccaaccugggcugguucaccccuccuucggcaaccuggugaucccccacucccaggaggucaccguacugcugccagacuuggugcagacaccagaucaguguagcacacuacagcccagaacucccagacucaagacguccuccugccgcagcaguagcugggaccacaggcgcaugccacugcgcccggaaaaacuaauaaaggcaauacuguuucgccccagggucgacacugccagcccucccaaaccuccugaguacccacccuuaccucagccuccucuggccuccccacauaacccugaacucacgacagucccuucauaguauuacgccagugcaggggugcaucccgggauaagauaauuuaggugugccggguuuugaacuuaggagugggaggucagaugucuguguucuugacgggcuccuuuugcacaaccuuaugucccccagccuccucccuguugccacacacagcuguggcucuuucaccuccauugcuguuuagaaucccagcaucugcggacccauucugcugauuugacugguuucuccuggacacucucuucgcagccuuggucaucuauaauuuccugagccugugcuaugaguaccuaggaggagaaaguuccaucaugucggagaucagaggaaaacccauugagugaguauggagucuucccagagcccuaaaccaccccguuuccugggccugguguaccucgagccguccuggcaccagcuggacacagaccaugucugcccgugaccuugaccugcugugccucaccacauuuccugagcaacgccauucuucugggcguuuuaggagggccucugcggcucagucuuucucucucugucucuuccugucucagucuuagugcuuuccugucuguuucugccuccugcaguuuuuacauucagagcucuccaaguugguuugucaccccagggccagugcagcccugugucccuccgccuauggcaugugcggaugcccugccaugccucucccugugcuuggccucggguucaaagucugcccagaaugugugccccagcucgucuggaugggugggagggcggccuuccccaccccacuguucccaaguccuggcucuucacucacugccacugccugcuaugcuugucucuuccagguccagcuguauguauggcaccugcugccucuggggaaagacuuauuccaucggauuucugagguucugcaaacaggugugugcccccagcagcugccuagcucaggaggagcagggcggggucugggaggcccugccgugggcugcccugggccccaccuuagagguccccuuuccuaugaggcaccccaggcccccagcacccaccccccgaagcuguuaggcagauaccacauuagcagggugugcuuggaggggcagcgaccgacauccugggagugucuguugcacugugggcaagagcugaucccagacucuugcucgugugaccaagucucagugugugugaaaaucagaagaagugcguggggauucuagaaccuccauuugaaaacuucucaucagcugcagcuagggggcaggaggguuuuggcauuaaagacacacgccagaacaggccucugccgucucuucgucucucccugcauuuccugguuggcaauccagccgcucuagcuuccugggcugacuucccuguggucuagaguagccuuggcaguccagccgcucuagcuuccugggcuggccucccuguggucuagaguagccuuggcaauccagccgcucuagcuuccugggcugaccucccuguggucuagaguagccuuggcaauccagccgcucuagcuuccugggcuggccucccuguggucuagaguagccuuggcaauccagccgcucuagcuuccugggcugaccucccuguggucuagaguagccuuggcaauccagccgcucuagcuuccugggcuggccucccuguggucuagaguagccuuggcaauccagccgcucuagcuuccugggcugaccucccuguggucuagaguagccuuggcaauccagccgcucuagcuuccugggcugaccucccuguggucuagaguagccuuggcaauccagccgcucuagcuuccugggcugaccucccuguggucuagaguagccuuggcaauccagccgcucuagcuuccugggcuggccucccuguggucuagaguagccuuggcaauccagccacucuagcuuccugggcugaccucccuguggucuagaguagccuuggcaauccagcugcucuagcuuccugggcugaccucccuguggucuagaguagccugggugggggcagugugguggggucgcucagugugugggccugggugucugaccaucugagccugauuuccagcuuuuccucugacucugugaccuuggauaauuggcuuacccucucugagcuuuaguuuccuccacuguaaaaugaguguaaugauacuccucucuagagaugguugugaggaucagaugaggucauggauguagagcuuucagcccggcgugguggagcccacggccuccuguucagggaggcagagucugaggggaucacgcccacucuucaugaccuugcguuagucuccucuggggcuccguaggggcucugucaugucagccccuccagcuucgccaagaguagucacgaaaguacaugaaacccacagccaagucacgauggcccuggagggcggggccugcugcucccuucugugcagggcccaggccacagggcgggcacacccacaaagccuccaccugaacaugccaagucuccaguucugcuuccagaccuuccuucccuagcauguuccuaaauucagaaucucaccacuggaccugcagggaaagaguuaaaacuauccuggguucaggguggggcauugagagccauuguuuaccaguuggugcagccacccagguuccggccagcugugacucacugccuuguuugaugauuauauugucuacaaaauuuugauuucaugauuguuagcuaguguggccuuguuagaaauuauuccccagcccugugggcucagauguucuguucuuguuccuggcgguggcagggagagauauaagaagaaagagaacaaaagaggccucuuccuuucuuuaccagggcgagagagcacaccccacagcuuuguccuagaggcacagagacaggccuuugacuccucagggccagugcucaauauccagaccuucuggagagauucccuacuuaaaguagagauucccagaucaaccacccacuacccuagcccauaggagaaguucuggaauggagcccuggaaccuggcacaugucuaaagcucccuggggguucugauguccagcccagccugggaacugcugacugguccaggguauggucaggugaugauucuggggccugcuggccugggcucugcugcugcugcugcugcugcuucagcuucucucugccucaguuuccucaccuguaccauggggauaaugacagcacccacgucagggggcugucaugaguaccaggugagcugacccagggaaacaccagccuguugcuaggcucauaacuggaacucaugcaaacugccguucuucccuuuuccccagaaggugccagucccacuucucuaggcgggaugacagggccagggacguucuguggggcuuucugagagugggacugcacgucugccccaucacgcgggccucuccguauggcagccccauggugugggcugccuggggcuccccugcaagacccacucagauccccaguuggggcagaagcugcagguuucacggaucacgguucccacuccaggcuccucguccucuuugcagcuacacuaguugagccuuuuggauuggauuuaaccucccccagcuccucagaaggggucuuagggcuuagauuuauuugcuuucuagauaauggugauacuagugauguuaugggcaccauggguccgcccguagggaaucgggaaaaccuggcugaggaacucuuuccguggcucagccagcuagcaggcgccguuagugcauguacagaggcgggagacucccgagaagaugcugcgcuuccuggcugugccauccccgcagcaguggcccugugguguggggagugacuacauccuuuucaucagggagucugugcucagaggccaagugucugcccaagcuguccccagaguucaaacucagauuuugagacucuggaguccacgugcucugggcuccugcaggucaccuccauccccagagugaccucugcugaccagaaacccuggacccaggcccagagaguagggcuaggaaccagaucggggguggacauggaggaugggaggaggcccucaccugcgccggcuucccgguggcugguuccuugagcagggcccuagccuugccccgggcaccaaggucuccaggaccuggcccugccaucuccucagccaccucucuagugcgcagccccuugcaccuguccacccucugccucggggccuuggugcaagcugcccccucugccugucgagccucucaucuccggcacccaccugaugguccuggcucgagaagcuuccuugugugcaucuccugucucccgccuccaucgugcccugccacaccauuccucccuuccucccucccuuccuccacaugcucauaucacauacggcauugcgcuggcugcaucuccuauauguucugccccccgccccgcgcagacagcaguccccugggagcaggacacguagccaccccccaucuccuccaucuccucuauccuuccauccccuccaucccuucgucccuccauccccuccgucccuccaucccuccguccucuccgucuccuucauccucucugucccuccauccgguacaguuccgucugccagaggcagggcuugcuucaugccuucugugcuccuccuccacacucaaccuccuuuuccccccaacaggccacccugcaguucuguguggugaagccacucauggcggucagcacugugguccuccaggccuucggcaaguaccgggauggggacuuugaguaagcagcgggugcuccccggggugugugggaggaguguuggcgcaggcuggugccuuggcucagggaagggggcagccagaguggccgcacagccaugaccuuccugggugucuggugcucacaaccccccugaagucugagcccagcaguggacacccuugcaguuggccccgcugccagccccggagugagccauuggcagcagucacguucauguccaggcugcagagugguaccaugaagggaugggccacaaagggacagugaccacugcugaggcagggagcgagagggucagagccccaagaggucggcucaaguccacagauacaaagcccgugcuguguaaauuguccacacccauuucauucugggcuuagugaaagugaccccguggcugggcacagugguucacgccuguaauccuagcacuuugggaggccaacgcggguagaucaccugaggucaggaguucaagaccagccuggccaacauggugaaaccccaucacuacuaaaaauacaaaaaauuaaccgggcguggugacgggugccuauaaucccagcuacucgggaggcugaggcaggagaaucgcuugaacccaggaggcagagguugcggugagccaagaucacgccauugcacucuagccugggugacaagaacaaaacuccauaucuaaaaaaaaaaaaaaaaaaagugaccaugugucuagcccugugcuuucaagcucucggcacacacugucugugaacuguguaacagcccugccagggcaggugggcaaaaggaggucagggggaugcagccgaccgagugaaaaggcagcagagcugagcagcgucaccuauuuugacgccuguuaucugagugucaggcuauggccucgggcccggcccuggcuuccacacugguguccaacguuaggagugugggcaccagggcuuagacaaguccacgagccacgcagaggcaguagagcuggucuggccugcaggcgcaccccauguacccccaccccugucugucgcuuugaucacccauucugaccccuucaguggcucguugagcucugcuggagguguggggcugagagccauggggacuguguguggugcagucgaggagagccccuucccuccaagggucugucccagccagaaaaugcuccccgucccgcagcgucaccaguggcuaccucuacgugaccaucaucuacaacaucuccgucagccuggcccucuacgcccucuuccucuucuacuucgccacccgggagcugcucagccccuacagccccguccucaaguucuucauggucaaguccgucaucuuucuuuccuucuggcaaggugagcccccucccagcaccuggaggcugcccaugccacccuguccucugcgcuuccugcugccccuucugcuuauggucccuggugccuguagggccuguucagaggggccucagcccacugggcacuugcugggggugaaaucugagcccucgagggccuuucccaggggcuagggagagcuuugguggggccgcuacauggaugagagggcccaggagacccugcguaauugcuggcaucucaguuucgguggcaaagagcugggagagugggguuuccggaggcuguggccuugugucgcuaccccugcccugcaggagcagcuguggcccugcucacauccucacuggggcaugugggcagcugaauggggcauuguggaagaagggggagcaggaaaggaaucauucuggguccagacacccgugccuccccauccaggcaugcuccuggccauccuggagaaguguggggccauccccaaaauccacucggcccgcgugucggugggcgagggcaccguggcugccggcuaccaggacuucaucaucuguguggagauguucuuugcagcccuggcccugcggcacgccuucaccuacaaggucuaugcugacaagaggcuggacgcacaagguaugagccaggguccuaggcgacccccgcugggagaagcagggagccccaaacaucccaggacccucccaccucccagcauccuacaggugcggcugggucaggacaugggauccccacucuauaugcaggaauggggccacagaggucggggaagagcaggugccaccagcacgaccgauucgguccuggaagcucaggccaccugucccuugcagcagguccaaguguggcgguccagggcugauacagacagagacuguaaugaauagacaaauucccucgggcuucuaacucccaacacugugguuaccauuuuguccuguaauucccucaucucauaugcuauuuuuuaaaaaaaggauacuucuggccgggcacgguggcucacgccuauaaucccagcacuuugggaggccgaggcggguggaucacaaggucaggagaucgagaccauccuggcuaacacggugaaacccugucucuacuaaaaauacaaaaaauuagccgggcgugguggcgggugcuuguaguccgagcuacucgggaggcugaggcaggagaauggugugaauccaggaggcggagcuugcagugagcgagauugugccauugcacuccagccugggugacagagcaagacuccgucucaaaaaaaagaaagaaagaaaaaaaagaauacuucugagaaacagacucggaugguaauagguuuuaacagcuuucuuuuacaccugcgaaucuuccuccuugcuagaacagugguaaguagccccaguuguacuggaaaaugcccuggagagcuuuuggaagugcugauacccagccccacccucggagaucccgcuguaauggguccgggcuggcaggcugggugugcugugagaguucugugcuuuaagcacucccagggugaugugaaagugcugcugcccgggacgcuccacugggcuggaagggcugccucuggccacugggcagaaggggguuguccuuggaggauggggaagaggaggcugggaaugccugagacugauugagccaguaaaggggcaggagggacuggggagaggggagccuccuucucugacacauccacccaggagccuggcugcugccagcugucugcccgaguggcuggaggcaagaaacccacuuccccagggccuaccugcaggccccacacaggcuccguggugggugguguggacuguagaaaugucugccugcagcggggcuccgcggcccacuucccgccccccuuccucugugccuucccuggugggggaagaccuacucugugcccaaagagcaggugcacaaaggccagggguugccaccugguggcccaguuggaaggaucuagcaaacacacacccagcauugagggcagugucccuuggaccuggugugguauacccugugcccgugggaacaucauccuugggccuggggccuggggccaccccaaggagcaagggggcccauggcagagaaccauuccugcaccacuggggcucagcagaggggcucugcugccuggccugagcugucccucuagacauacccacgcccggccggggaagcugcuugcccucuucugccuccccacugguccugagcccccugcuacccucuaacccaggcccagacccucagcccucaggauaggcuuaggugcagagcuggcucagcugugcgauuguaaccccucccucugagccuccauguccuggucugggaaguguugugagguuuguaaaaugugagguguggauguggccccaggcuagccggggaagaaguggggaugggacguccugaccuagacguggaggcggaacucagucgccagacggauguuuccuguuggcgugaacaccaggggaggagucaucccuagguggauauccccccugccaggccccaggaggcaccuggagcuuccugggugcccuguggggccuggggggguggggacaggguguguggugugucgugcuggugggccucgguggugggcacacauuguucacucagcugucucuugucuucucuauuucuuuggcuucucuccccgccccccuugcccugcuuuugcccgggguuuggccgcgggcagugccaacauacggcccuuacgguaggucccgcucuuggucugcaugucuguccugcaugucaguucuggucacugucacuggcaugcgucucucuguagcucuucuccguguccucaucuccuccccaccggcacccccugggugggagcgcccagagcaccugucaagggccacccucuguagagcuugccugcuuccguccucguuucucguucuggaauaugccccgccuucuucugggggcacagugcuguucaugggauaucggggcauuucacgauguuuccaagaguucacaagcugagucaggaauccuggguuccaggggugggcucgucccuuacauccagguguccugggccaccuuucugcucugagccccugaggauggggacaguugauuagagagaugaggaggaagcccucuuagagggagccagugagucgcaucugcuccccugggggugcaggccagccugguccugaucuccagaguagagggagcacagcacuucccccgguggugggggacgcgccuggcaccuguggaaccgggcaccccuggcuuccaggcccucuggccccacaugccccaacuucagucagugcugagccugcucuggccucucuggggcauucuaggcucacugcccauagcuugccagucuccacccugggucccuucccugcagccagcccagcucccaguggggguuuaugucugcuccucuucacaguccagccuccccuuggggcuccccagccaaagaaguccauuuuuuccugccccuucucauauccuggaccccauucucugucccagaagggaugguugaagggcauagcuuuggguuggggggugucugucccaggaucacgggcaggggcugagccaccucccucucaccgucccagccuccucaccugccccucccgcucccugcccggcaggccgcugugcccccaugaagagcaucuccagcagccucaaggagaccaugaacccgcacgacaucgugcaggacgccauccacaacuucucaccugccuaccagcaguacacgcagcaguccacccuggagccugggcccaccuggcgugguggcgcccacggccucucccgcucccacagccucaguggcgcccgcgacaacgagaagacucuccugcucagcucugaugaugaauucuaggugcgggcugcaguggcggaagugcuggcgccauagccacggucaggcugugccccaccuccagccucaccaccaggccaggaggcagcuggcacagugcucacgccgccuuuauuuauuggaccagaaacacucacaugucacuuccagaggaacgggggacagccaggcucgcccaugggccuucaggaauauuuauacauggcccagccugcacugcccgggcgagggcagaggacacugggagcaaggcuuaugccccugcugcccguccugugcugggggcaugcugggaccagccgcacccaggccccaaugcuuguguguggaccagcggcugcagccuucuagccccuccuccccgcgagacucucaggcugaggucggcaagccguggcucccccacacaccgugcaauacccugucugaccugggcucuucccgccugcaucccuccccuguccaccuuuguccagugcuagauucaccucaccccgggcaggaguggggaugugggcgcucugugguccuccccuccugacccaggccucuguggcaugcugcaaggaucagagccagacaccaggagucacaggccccacccaggaagggcauucagggccccugggcaccgcuucuguugaagcaggggcuucugggccccuggguauccccaccugucguggccacaccucugccugccucaugccccuucccccuggccuaccaaggacagcccacagcccgcacugccggcucacuuggguccuuccucgauagcuuugggcagagcccuugcuuccuggcugcuucagggcucaggggcucccagcccuccuucccaggcugaugcuggguccucucucucuuuggggcuucucccucccguuucaggggaaaggucugagucuccacguuucagaccagcuucugggggaaggcaguccggcagggagaccgggagggguggccacacaguggggagcugggagguggggggaauggucccagacuccucucggggccccuauccacacagggccugguguucuaccccaucuggccccuggcccaucucuucugugccuuagucacauaugaaagcgccccucccuggcuccccaucugucccacacgcucccuggggcucuuaguucagcugcuggcacucgcaggauccugcagugcugggcccagagcccuuggacaggccucaggaguggucaggaccaccaagccccuccucucccccuccacaccucuagaccuggggccuccggaacccccagcaggcugggcuuauacuagcuccugacuuaggaagagccucgugucacaacacgugucccuacaggcaaaguguccuggcauuuaaaacccagauuaucccuggguuugggcugcagucaccuggagaagcugguaggguaagggagagggacccugccgguguucacuggggauucuuucuuuugguccuuccuggaaugaacagguucccucccugccaccugugaggagaguuggggcccagccgucuuccuggccuccuuccuuuccucguggcagaggccugcaugugggugccagaggccagcucucccccuccaucuugggggggcggagcaguugggcccaagcugcccgggagggugggugcagacacaggcugaggaccagcccuggcccugccccgccaucugcuuucaccaagcugucucuccaccguggcuucccuucucccuccaggccaaagugcugcugauucccacucccuugguuuucgccugcccagcguugcuguuugcguggaggguggggggagcucaguggcagggaaucagcgguccguggggucguggggacgggaacaugugcccgaccgcuccauccccuccuccuccuuaggaugcauaaccuaccuugucuuuuuuuuuuuuaauuuucuuuccagguagaguagcucuuuguacauaaagaauacuugaaaaauuaauuguaugauguaugagaagacagagucuccuaguuuuguaucuuguuguaugacugccaugaguuccaccagaaagccacucuauuuuggucucugugacauuuuaaaugcgugacagaagugagcaaauaaagugaggaagaaaucuauauaugagauaauauagauuguauugaaaucucu

SEQ ID NO: 17867 - RNA, 45527 nt, Homo sapiens
aaagggcugccugcaucacuuuaucuuuucuacuuuauuacuucaaauuaacaaccacgauaaagcucaaaaaaguccaauauuuacacaggaaaaaaguacaaaauuccccccaaaguucuucaguuuuuuuuuuuucaguuuuuuaaauuacaaaguaauaaaaagcuuugcucuuuaauuaaaaaaaaaaaggaaaaaggggaaacagagguaaauaaauuaggaaaacacacacacggagaaaacaaacaaaaauaaaauaaaauaaaaacaaaaagguguuaacuaggaaggauggguuaauccaaaacccagcccugacuccaggcuccuccucagaaagguggaaccagggagaggggggaccccaggugacugucaggaccagggaaguaauuuauaacucagagccagaugccuucuggaagcagucuccauggauucugcccuaaaaccaggaauggaagauggagcugccaccggcugaugacgggcuagggggggaccgguggcagcgaggacccucugagcucugagggaugcggaggucaccgcccacccccauguccuuguuaguagacacaggagaacgggaauucgggcuggcaggcggggcgggccguggcaccugcugucuugggaaacacaggucaauacauccacacacacacacacacacacacacgcaggggacgccggcccccaccaccuccccacccacuccauggagaggcagaggaggagccuggaggccagggggacaauggaaaagcccagcacgggaagucagccacugucaucucagaguggguggggcugugcguaucuccuggauucugaggcucggaaaacucggugggaacugccuucaacugacuacaccacucccugaugaugcuugagggccggcuuuggcucugggaccugucacuucuccgacacggacccgacccguuccucuccaggcagguggugggugggggcaggaacaggaggccgggcaggcccuggcgucuggcuccuguagccugguguugucaggggagcaucuggcagccugaagguugggggcagcgggcaccacaagggggcaagaauccucagugcugagggcaucucaucuucuugccauuggcaaagaaaucaaagaaacaaacuccaucgucgguuuugugcuggguuuuuuuguuguucuuuugagugguuuauuuuugccuuuuuuuuuuuuuuuuuuuuuuuaaagaaaauacagugaagacacuagaagggagaagggaaaagacaggugagguacacagcugucucuggcuacuuuuuuuuuuuuuugagauggagucucgcucugucccccaggcuggagugcaguggcacgaucucggcucacugcaaccuccaccucccagauucaagcaauucuccugucucagcgucccgaguagcugagauuacaggugugugccaccacacccggcuaauuuuuguguuuuuaguagagauggguuuucaccauguuggccaggcuggucucgaacuccugaccucaagugacccaccugucugggccucccgaagugcugggauuacaggugcgagccacugcacuuggccccccaaacuccugucuucucgucccuuggucuaucucccucugggccccagagccuggcucaaggcccagcacgcuaggagauccaucuucaugugacagaaacggauucucucccuucucugcccuccuggugagcaucuccccaccccacccccaaauaucugcccagcccgccauggacagcuugguuccugggccugagauccgaggaaggccagcccuguucaugccuccacucucuuguguggaugaauuucuacaaaacagaccacacacagauugucccaguguaaaguugagucccccgacgugucggacuacugccuacaaauggacacacguuccccagagagcucagauuauacccucgagaagcccaaagaaccccugccgccuccccuuccccaagccaggccccagaguggggcguuuccauaccccgccucaaggccugguacaguccgggaagaaccagcaggcucacgcuggccagagggccucucucaguccuacuacagaggcauaaaaagggcuccuuugcuuccuccacagcccuguugugagucuugugcaggaauuaacuugcguaacagcccagaggcugagacagggcuaaugccgugggagaggucagagugugagcccauggccccgucucugcugggaaccaaccuuccaaaauauguuaaggcagaaggagauagagaccuggccgagggcagaaaaaguuuuuccagcagaaacuaauccaugaggggucaggccugagcauagaaacccuuggccccaagucaggcagccuccgagguuuuaaacuacuugaggccccuuagaguucuggggcgccugguaccaucugccacugccacugccacccaccccuccacaacacauuggucucuuucuggggcccugggagcuucuaggucggcugggcuggcugcaucugcagcagucauggacucaccuaagcaaacacugguccaaugggggcucuccucacuucccgagauggucaaauggcacacuugucuuuugaggguggggagggagagagggggagggagagagagggagguacaagcuucaagucaagucccuuagccgcuggcgauagagauuuggcaagucucuccccacugaggagguguacccccacccccaccuccaggcagccccucaagcugagggaaggccugugugauuccagugacucuaagaugucccugucuguagcuaagaauguugcccagggaggcaaaccugcuaccuaaguagauggccaaugaggguucucucgcaggacucccuccucgcccacaggcaggaggacgagggcagggcucccacccaccucugccaggccaccugcccugggcaacuacagauucccccuucccaaguguccccauccaaacauagccccaaagaggaugggaccucacugccccuacaccccaugcucuugccaaugcucacaggggcuccugggggcucccugaugucagggagcagcaacaccucaucucugagccccugcugcccacccuggcugggccccuggcagcgaggacuggagcccagcugugccacuugccagggaauguuacugcccugagccuuggugaaugacuuugcucaagagggcucaucagaccucagaggauuaaaugaggccaaguccuggcucuacagaagggguucacuccaaggcaagcagcgucgauggaaagggaagaacagagccacggccugaccucccacuggggggucucuaacucaguucugaggcccagagggacuggcaggggggcagcucaccugugaggcugggauccgggagaccucuugccgcccagugaggucugaggaggagacguuggcgggcgcaccccugugcagccucauacucaccuuccucucccggucgacccgcgagaucgcucugggagaaguauugccuggagggagagugggaagccacccucagaguaggcacaaacagagccccccacccacccugaacccagcccacugccugagucccugcucaccagccggcuggaugcgggaggcuggcguggaagccacgggcucggcggcacugcggagccgguuggcaguggcccccgugggugggccagggggcagggcucgggucgcggacccccguagcugccccauccucuccucgcguucguguucucgccgcucccgguccacauccucgggauuccgggcugcacccugcagggaugcaagaaaagacaccagucagccccagaggccagggugcucugggcccagcagcccugcagggcacagaaggggagggaggccagguggauaucucagaaaccuucugcuccagccucccugacaagcgcgggaagccaagacccacaaucacacagcacagagacacgaagccacacaaccaccagaggaaggagaaagcaggagucugggggcagagggaggucagucugcccugcucuccugggauggagccagagaaaggacaacuaaugcgcccaggaugaucaagagcaccucuuggcccuccugaccuggggcugggccugcccuggccccccucuguguaccaagagcccuuaacuacucaagguugcuaaaccgagcaggaaagcuguuuagaggccucuagcagacuggcuagggguguccagagggggaaaagaacaggcccagagucacaaaacuaguggaaggcugggcuaggacucagaccagcucucccgguaccuagccaggggcucuucucaucagggagcuguccuucccccugccgggaccuggcaauggcuucuggcaggugcaguggaggccacagccaggaggcccagggaacccacagacaccgccugccuugggacagaagcucaaggggagcuggagaagaaaauggggccacguuccccacggaggaagaagaggcccagcaggcaaagcuggagcagaagggguacccuaagcccccaggugcccugcuguccagccacugccgccccuggugcaggaggaagugagaaggggccagagaagagcauaugugggggcagcgcccgacugcguuaccuaguucauccuggggccguccacagggaagggcagggggcuggcaggaagggggccgcaucuguggaggagagagcucugggcugaguugggggccugcucaugggcacagggugugguuccugcaacccaugucucucccaggagacuggccaagaggugggggugggcccugucuuuaagcaacuccaggaaguaguggcuaggaccagaaugaucccugaaucuuagugaggcaccaaggcccagagaggccuugugaccugcccgggguugcacagcucagggcagagcuagggucugaacccaggccucugccaccuagucccacucugcucucugcaccccaagaggucacuguucagagucuugccuuagaacacucuagaagaugcaucuucccauccucccacccagaagccucucaggcaggccugggaccaccggggcucuaacuccugaccuccgguccucacccugggcucccacucgguugcaggcuggccaacagugacucagccagagccacagcaaagccuggggaggaacacgagcuguggcaccuccgugccgaaccuucugcgggcagagucacaucaacccugugaggcaggucaaucucauuuccaugcuugggauacagaggcugagugacucacuccaagguguggagcccugcagccagcagccaagcagagggcuggagccccugcccuuugugagcccagcaggcucaggccauugccagccccgaggcaagaagugggcgacucuccauggucccauccaacccauaggacgcaagaaacacacagcagggagcucucuuggccuuuauugcccauagaaaacauaaaaggucagcaaagucacacgagcauccacccgucaucauauggaccucuguccuuggcuguguugaauuccuucccggccagcugacuggaccucggaacacaguggcuguaugugcugagaguggcuuccaggccccagggauccacagaucccagcaccccggugcagccaacaacacaggguguccugucuacuguuggguagcaugggaagggccuggccucagggugaagguucccauugcauguuuuccaggugcuucugccaggggacugcuggaggugguucagcucacuacaguggccguggcauugagucagagauuggcaaaggauaaggcugugggugccucugcccagcuucuaacuccagggccugccucaagagggacuuccaggaaggcggucagaccagcagcaguggguggagaggugcuccuggccugguuggaaaagagaucuugcuggcuagacagucuugugagacuccauaagggaggaaccuagagcagugauguccacagaacguucuggaugaaggaaauggucccaucugccuugccggaugugguggccacuggagggcaguggcaugaucucagcucacuccaaucucugccuccuggguucaagcgauucuccugccucagccucccaagcagcugggauuacaggaacacaccaccaugcccagcuaauuuuuguguuuuuaguagaaauggguuucaccauguuggccaggcuggucuuaaacuccugaccucaagucauccgcccucuauggccucccaaagugcugggauuacaggcaugagccaccaggccuggccgacauuuccagucuugauuaauuuuaauucauuaaaaaugugucgcauguggccaauggcuaccaucuuggacaguguccgucuagagaauacaaaauccauucuugcaguugugcugagcuggagggccaagcccaucacgaaccagacgugggagugacuaucucgauaagaaagugcccagugcccaaugcccugugguggaaagagcuggucccaggugcucaaggccaugggccccauuuggagccagaaggucuagggugaagucagagaagacguccccugcccauaucccauuuccagccuugcugaaaagggcaacagaggccucucccugaggucccuagccugcgagacccccauucucugccugaccucuguguuacuccuuagugaacaagaaacccagagagaagagaagcccaagaccaaugugccgaccuuggcuuccaggagaacagagccuugguccuaaccaucuagcaggguggcugagggcccugccaugaaagaggcacaccaggaugaagcaagaggagguguuuaaugaguucugguucaacacagaggccgccaacggggucuagcuaugagucuguccugggacccguucccaccaggccccuugugggcaguggccaccaucccucccucaggcuguccuggcccucaaggaccccauggcagggccuuuuccaccauggccuccacugugcugccaucucuugggaacagggggucaucccauccucccaagaaacacuuccucaggccuggccccgaugggcucaggcacaccuggcgacaucagaaauggggcccuggaguccagaccacaggccaguaguuuuggggggacagcuccuccaccuccuccaccggccuaucuggggggcucugggugcccaggggagccgggcaccugaaagggacaaaaagcacagcugaggcucagccucuugcgcucacuggucaaguggcaaauuuuggaaaagccagaccucagaggauccuuaccaguacgugggugaguacgugggcccagcacagggacaggggcggggacagaaaggucccuucgcugucauggggcugucacggggcugagccuggcucgaggaagcccccuuuuccagaagagaugugaaacaagacauacaauuucacagauuccagagcucuggguacggccggccaaugcugcuccccacccaaccccaccccugggacucuuaaaagagggaaacagaacaacugccuagccagacccaggggcccaugaccaagaagaaagcaagcaccaugacuggguccaggcuggcccgaggggccauggugcagguagccaccugggaugugcagaacaggagcagcaggacgguguaggcagcaaucagggcagcagggggcgccgccagcaccacccaugcccugcugcgggcacccaggagggaccccaggugaagccagauccuccuuguuccgacgggagacagcgcccugccuggcccugcugcccaugguggcacaagcugucagcacggaugaggcuggagggcucugggaccccagugaggucaaccacacuguccagcucguaccucccgucugucgggagccccucccgccaccagcucacucuggcccucugagucagggccuuccccauccagucccccaagcccgccuuggccuccaggugacucacgaauuucagcauguuccagucaaagacguagucauaggagaagcccugccgguggaagagguugcggaagagcugacguagguaagaguagucgggcuugucgucaaaccgcagggagcggcagaaguugagguauguugagaauucggcuggaggguguugcagaggauagagaaggccacugugaggcccacgcucccagacccccugcagccagcacuguccuagccacccacugucccuagauacuuccaaucugugagaggcaagaaaaggaggcaacagagccauggccuucccuauccuacugugaugaaagccuagccugcccgugagcagagccucugcugcuuucagagcaagggaagaccugcgaacaguggccaggagccucugccagguagccggauccaggagccauccaugcccacagcucuuccgcugcccucgccaagcacccuggggcccacagaucaaucguugccauaaauucaaaggacugcaagagccugacgggaccuucuaacacaaccuaagcaagaagaggaaaacuuccaauuccuccucaaaaacacuggggagagggcccuugggagaugaggcaggaauguaggccgggaagcaacagguguaacagccaggacagggaaaccgggccuucuggcugugccaaggaguggcaaagagccagggauuacugcucaggugccaagggcuguggggcagcccagugugggcuuuguuguuguuguuuuugagaugaugucucgcucugucacccagacuggagugcaauggugcaaucucggcucacugcaaccuccgcuucccagguucaagcaauucuccugccucagccuccugaguagcugggauuacagguggggcuaauuuuuguauuuuuaguagagacaggguuucaccauguuacucaggcuggucucgaccuccugaccucaugauccaccugccuuggccucccaaagugccaggacugcaggcgugaaccaccgcgccuagccccagcgugggcuuuguauggccucaccuuucccuuagacagugccucaggggcccccaggcauguccccucccacugggcuacucacagggauagccuuugcagaggaccucgaugggcguugacaucuucuucucgcugauccguucauacuucuggcgcuugguggcugcuuugagccccugccagggcagggagcccagguugaaguacaugagcacguagcccaggcucuccaggucaucucgacggcuuugcucugcacagagagucaaagacuaggugagggacagggguccacucaggccccuaacucauccucugggucaugcuccucacaaugcaccaggacccuccugcccccacgucggauguugcucacugcacgcauuuuaaacaggcacugcuauuauccuccuccuacagagaagaagccugaggcagggccuucucaacuuaauuugggccuaguuuuuccaguucaggcacuuaaucauucaaugacuaugagagggcaccuacugcccccuugccuggcccaccccguggagaggucacaagcuucagcaucagacagggccggggucaaguccagcuuuggcauuagcuaagcugcaugaccuuaagcaacccauguuaaaccucugagccuguaucuuccagccugcaccaacagggcggaggaggaagcagggccagggaaggcgcccggcacacacagcuuggcuuacgaaggggaagacccgacugugcaaggacacggaauaagcacgagcuugggggcagacgggguggggacuuucucacuagaaaagagccugggggccuccaucaggguagggggugagagggcuccagagagcugggccccagccaguggccccgggugcacacugcuccaggccuggcucccucaccaaugcccaggugcguguugauggaagcguagcgggccgugccggucagguucuuguuuucccgguagggaaugugcuggugggugcgggcgucccgguacuucuuggccaggccgaagucgaugauguagaccagguugcccuucuuccccagccccaugaggaaguugucgggcuugacgucccgguggaugaaguucuuggaguggauauacucgaugcggcugaucuggggaggaggggggccauuuguucaacagaggggcccuugccuagcacucugggccaggcaggggcuggggccacagagguggaaaggcagagggagaaaggccugccuucgaccaugaaggauaacuaaggggcaggccagagaaggccuccuggaaaaugugacaucaggaugaacucuaaagggggaguucaccaaguuggcugugagacagagaaagagaguauugcaggaaagcuaaugggaagauccagaaaugaagagucugcuagaaaggcaacugguuccccauggaaggcuugccugcccggccccacacucacaggacuuagggagccagagaggcaacagaugugggcgaggggcaggcagggaacaugggggaagccuagaccaggaagaggugacagaggcagaacacaaaagacagggcuuccgaaggaugccaaacucagacaggcacauggcccucuuuccuuugauauuuuuuuuuuugagauggagucucggucuguugcccaggcuggagugcaguggcaaaaucucggcucacugcaacuucugccuucaggguucaagugauuuuccugccucagccucccgaauagcugggacuauaggcacgcgccaccacaccuggcuaauuuuuuguauuuuuagcagagauggcguuucaccaugauggucagacuggucucaaacucccgaucucaggagauccgccugccucggccucccaaagugcugggauuacagacuugagccaccuuuucagucgaguuuuuaaaacucaaacuaauauccauccacaugccguggccucuggcucuggccccagguucagcacagcucaacaucuccugcaccuuucuugaguuucacaccaugaggggcucuggcgacccucugcucacacaccuucagccuacaucgcagggcuuuugcagaccaagauuaaaaccccuguacgagaucuccacauuccauuccaaguucaaaauucuacaguuuuguauuuuuaagaagcuuuccucccuaugcugaugaagggcuuaguacuuaacaacagccuguuagaggggccuguuuuggcaaggcgcugaaugguaucucaccuaauccccucaacaaccaacaaaggagagacucucacaugaggccacugaggcucagagagguucggcguucaccuacggucacuggucuggaacaggaccaggucugugugaccgaccgcaggcuuuacauuacccagggcaggccagacgugguggaucaugccugugaucccguguuaauucccaucuugggaggccaagaugggaagacugcucaaggccaggaguuugagaccagccuggucaacacagugagacccccaucucuauuucuuacaauuaaaugauauuuuugaaauaaauaaauaaaacuaccccaggcagagucccaggcccugacucggcaggucuggaguugggccugaaaucacauuuuaaauaaacaacuuggcugggcacgguggcucacgccuguaaucccagcacuuugagaggcuaagaugggcggaucacuugguaaaacucugucucuacuaaaaauacaaaaauuagcccagcgugguggcaggugccuguaaucccagcuacucaugaggcugaggcaggagaaucgcgugaaccugggaggcggauguugcaacgagcugagaucgcaccacugcgcuccagccugggcgacagagugagacuccgccucaaaaaauaaauaaacaccuacaauucuauagccaguggacaagguccccuggcccaggcccauccucuggcauccucugggggcaggaggcagggcugguauccugggcccacaggcaucuggcuggggauggaggggacggggacucaccaucuggucggccaagagcagcaccgucuugaggcugaauuugcgggaacagaaguugaacagguccucgaggcuaggccccagcagcuccaugaccaucacguuguagucgcccucagcuccgcaccacuugauggacgggauccccacugggggucaagcagagggccucugucaggggucagaggcaggcagccagccacgcccggcccacccugugcucauggcugcccaccgccacccacccggcgcccgccgccgcccacccugcgcucaccgccacccugcaucaucuuguagaacuugcucucgaugugcagcugggggugcuuugucuucacacacuccagcuugauggcgacuuccucaccagaggcgauguuggcaccugcccggggcagggaggcaagggaccagggucacccucaaaggccaggcagucccaggcgccccacuaagcauuucugagaucuggcgugugccgggcccggggccaucugcccuugaggagcucuugggggaggcugggaagggggcaaaggagccccggcaaaggguuccugaggggaaagaaggucagcgcugugagggacagaggugacacacaagggcuacccagggccacagguuggggcgacaagaaggcccgaugugaguggggcaagggucagguaugcaaaaggcucacagaccaccuaagggagggggcugaguccuagagcaaauucaggcagugaggucugucggguugagaugguggcacgugcagaagaggcccaauggggcugggcugccgaacacaccagaacaagccaggaccacccuggccuacaggaugaggaugggacagccgcagcaaccccucagucaaugcugaugccuucagaggcagcccugcacauucuaauccagugucucauucgauucucaacccccuuguagagaugagaaaacagagacccagcuagagacccagcucaaggucaccugaccuguaaauggcggccuugagaucaaccccggcucugcuggccuccagcauaggucagagguccugccugcaccuccccgucucccccaguccacuccuggcuucucaaggggcucuaagaaaauacccucacacacaccaaggccccgcucucugccugggcccacugcccaacucaagaagucacaagaaagaccaagcccaaaguguaccuugccucaguuucccuggcuguauggguggaugagaugaagggcuggggcuaggcugggcgacagggugucuccuuccuggggccagcagcgagcccagcaggaggaguaggacagugucgcaacaggacacaaacaggccagaacaacccccagggacacagccucaggaggaguucaagacaggagaaaggcaggaccucacaucagaggaaaagaugagacuguucauuaauaaugucccugaacaaccggcuggccaccugagaaaagacaccauggcucacaccacaaccaggagaaaucucaaguagaggaaaaguuuguauauaagaaauaaaggugugggugugaguuggcacagccccugugcaccucuugggugaagcugaacauaaacaaacgcucgcccaagcaaccccacuccugaguguacauccuucagaaacacgugugcaccagggggacaggacaaggauggacacaggagcaaacagcccaagugcucagcagcagaagaacaggaacaguggcgcagucaccagggaaucccaggcggcagugaagaggaaaggaugccugcuucacacaaugacccuggucccaggggugcacuccucacagcagccagaggguggaaacaacaaacaucugucacagaugcaaggaugaauggaaugcagugccuccaugcggcggaauauuauucagcaauaaagaggaauaaaguaccgauacacgcuacgacacgagugcaccuugaaaacauucuacccgaggccaggcacaguggcucacgcccguaaucccaauacuuugggaggcugaggcggguggaucacaaggucaggaguccgagaccagcccagccaagguggugaaacccugucuguaccaaaaauacaaaaauuagccgggcgcaguggcaggcaucuguaaucccagcuacuugggaggcugaggcaggagaaucacuugaacccaggaggcggagguugcagugagccgagauugugccauugcacgcuagccugggugacggagugaaacuccagcucaaaaaaaaaaaaaaaaaaaaaaaaaagaagagugcaagcacaguucuacuuguuuccauaucaaaacaggcaacaagacuggacaauacagauuuaaacacgaaagaaaggaaaaagauuaaaugucagacggugguucccagggagggacaccuuaggccaugcagguauucuauacguauucuuugcauccacucaacguuuaauaagaaauaacaaugaaauguuagaagaagggagaauugccuuauagccuugggguuaggcaaagcuuuuauuuuuaucccugauucaaaauccuaaagccauuuaaaaaaaaaaaaaaaaagcuccuuccucuccaaaaaaaaaagaaucccuucugcauggcaaaaacaccggaaauaaaguccuaagagacauacucacuugcaauucuuaucacaggcaaagagcuaauauguaaugagcuccuacaaaucagucagaaaaagacucagcagaaaauaggccaaaggauuugaaacacacacuucacagagaaagaaaucauuaauagaaaagccuuacucauagggaaagaugcccaaccuccuuguaagagaaaugcaaauuaauaugaucgugaaagaccauguuucaccuaggauugucaaaagucuuacgagauaacacaccugucugucggcaagacugugggggcgcugagcacuccucccaggugguggaggcgucaacugcugagucgccacuggagggggauuugacgcuacucagcccugaccagcaaccccgcuucugggaguuuaccugacauccuagcacggugcaaaacaaggcggggacaaggcugucggcugcaggcuguuuggaacagcagaagcuuggaaacaacccaaaugucccuccugagggggcugauuaaauaaagaauagcccauccauaaaacagaauacaauggaaaaagaaccaggaagcucucucugcacacaaguggaaagaucuccaagauacaggaagugaaaaagcaaagcacagaacaguguauauuccacacucucauuucaguuuucuuuaaaaagguggggaacuaaguaucuguguuuggcucuagcuacauaaagaaacacugaacagaaacaugacuguacagggcuaagugggucagggaggaaggggugggggacgcuucacuggauacuguguuauaaguugcaauuucuuucaacaccuuuauugagauguaauucagauaacucuccaauugagucacucaaagugugcgacucaccguuuuuaguauauucacaagcuugcgcagccauuaccacaaucaauuuuagaacacaggccgggcgcgguggcucacgccuguaaucccagcacuuugagaggccgaggcaggcggaucacaaggucaagagaucaagaccauccuggccaacauggugaaaccccaucuccauuaaaaguacaaaaauuagcugggcguaguggcgcacgccuguaaucccagcuacucggcaggcugaggcaggagaauugcuugaacccaggaggcagagguugcagugagccgagauugugccacugcacuccagccuggcgacagagcaagacuccaucucaaaaaaaaaaaaaaaaaaauuaaaaauuagaacacagcaucuucuuaucagcugauaccuucguaucagcaucugcuguggguuccgcaucugccgauucaaccauggaucaaaaauacguggggggagaaaauaaaaaauaacaacacaacaauaagaaauagguugggugcagugaugcacaacuguaguacuaccacuuugggaggcugaggaggauuacuugaguccagcgguucgagaccagccuaagcaacauagugagacccuaucucuacaaaaaauacaaauauuagccaggcgugguagcacgugccuguggucccagcuaccugggaggcugaggcaggaggacugcuugaaccuaguaagucaagguugcggugagcuaugaucacaccaccacacuccagccugggugacagagcaagaccaugucucaaaaauaaauagguaaauaauauaaaaauuaaaaauacaguacaauaacuauuuacauagcauuuacauuguauuagguauuauaagugaucuagagaugauuuaaaguauauggagaaggccaggugccagcauuuugggaggcugaggcaggcggaucaccaggcaaggaguuccagaccagccugaccaccaugaugaaaccccaucucuacuaaaaauacaaaaauuagccaaggugcucccgugggagcgccuguaaucccagcucucaggaggcugagguaggagaaucucuugaaccugggaggcggagguugcagugagccgagaucacacaacugcacuccagccuggcgacacagcgagacuccgucucaaaacaaaaaaaaguauacagaggaugcgcguagcuuauauacaaauacuacagcuuuuuauaucaggaacuugagaaucagaggauucugguaucugagggggauccuggaaccuauuccccacagguaccgaagguggagggcuguauuuucuuuuucuuuuugagacagggucucaaucugccacccaggcuggacuguaguggcacuaacacagcucacugcagccucaaccucuggggcgcaagugagccucccacuucagccucucgaguagcuggacuacaggcgcaagccaccacaccuggcuaauuuuuguauuuuuuguagacaggguuugccaucucuaggcuggucuccaacuccugggcucaagugauucaccugccucagccucccaaugugcaggaauuacaggcaugagccacugugccuggcccaggagggcuguauuuucaucacccugaaaacaccuguagccuuuagugggguaagguccuaucuccucgcuccauccccugccccccaacuaaucuacauucugucucuauggauuugucuuuucuggacauuucacagaaauagaaucaaacagaaucauacaacgugauuuuuugugacuggcuucuuucacuuaacacauuuuuguguuuugauuuuugaguauuuggauuuuuaauaaaagaaaaagaaaaacagaaugaauaacucaaucuagccagcaacaggaaugaaaguacuuugcaaacuguaaagagcuuuugacacaucaaugcucgucacugggaugagccacacagguuuccaggggacagugaggauccuuagaguccccuggccaugcuccauuuccccaugagcagagaggcaggagagugcagcgguugaagugugaguuucagagccaaccuacuagagcccaaauccugacucggacauccccuggccaggggucgucggacaaggcacuucaccccucugagccccagguaccucauguguaaaccgaugacacuaucuggcucauugggauguucugacagacaaacaugcuuacaagagugccuggcacacagucaaugcuccaugauguucggcuuggugggaagugcagccccuaggcuagagaugagccgguguccacccagugggaggaggggaagagggaauaagccaugcuaugaggaaaggagagccuccgggagggcaggcugcaagggcuccuggcucccaaacaggacuguacuggacagacaagagaggucacggcacaagcagaggcccaacagcagcaggugcagcgggaaccaugggguggcagaaaaagacaguggaagaggugggcagggaagagaucugaagggucuugaauggccggcuaagauccuggccuucagccugaggcaccaagggccauguucaggugugugaucacaggaucucucaaccguggcacuacugacacuggagcuggagaauuccugguuguggggcugcccugggcacugcacagucuaacagcacccaugacuucuacccacuagaugccagggcaccccuuucccccugaauuguaacaaccaaaaggucuccagaucuugacauaugucuccugggggacaaaaaucacccuguugaggcuaccugguggauacgaaagggcuggaggaggcuagagggguaguggaaggccugggaaggccacuacagagaccaggcaagagcugacgguggcccugccugggcagggugcagaaacugauugacacuuuggaggcagggccugcagcacuuggugauucggcagaugugugcagggaggagaggugcuggggagguagugguagacagggcccucuuccccucgagcccuuacuccacucuucgaguacuacuguuuguauuucuuuuuucuuuuuuuuuugagacagcuucacuuugucgccugggcuggagugcaguggcaugaucucggcucacugcaacuucugccucccggguucaagcgauucucaugccucagccucccgaguaacugggauuacaagcagacaccaccacgccuggcuaauuuuuguauuauuaguagagaugggguuucaccauguuggccgggcuggucucaaacuccugaccucaaaugaucugcccgccuuggucucccaagugcugggauuacaggcgugagccacugugccuggccuacuguuugcauuucuguuugacauguggaaaaacagacaccaaaggucaaaugaucauaugcuacaaacuucccagggacagggacccaagcugcuaggcaaagccucugacccccgcaagugcuggaaaccugccagagcugccucccccugcagcagguccugccaccaaugaguuccuugguggccucuaaauucuaucaggaagccgccaggcuuuucucugagcucccuuaauucuuacaaccgcuaagcugagguucagaaacguuagguaacuggccuaaggucugacagaacuggauggggcacagccagaauuugaaacuuaguccccaaagucccuguguuuuuucuccacucaaacuccaggugaggcuuccuggcagaggcugugucugggagccggcugagcauagaugcaggggugccccacaugcgaaggccuagaagcuagaacugcccgauuucaggaacagaagaugccccaugagucagacacaguggagggaaugccaguucccaaaacaaacuuggacacagaaaagggcuuggacuuggcuggcccuagaggggcugggaacuuggcaaguuccagguggccacgggcguggccagccucacacgggggccuacuugacaccuacacagacacauggacacaaucggggacauggguggacuggaggacaggggaugaagcccaccgucccggcagcagcagcggcggcaaccucaguucccacccaucagaggccuggaguauuucccacacuaacucucaccccuggaaccaccugucagcgaacaacacuguucgccaccccuuucagagcugaggaccagagacucuaagaggucuagagaguuccccaggaugcaagucuagcaaaugggcccagauuuggccaccucuggacccugcaugggcaacagcagugccuuaacaaagcaggccccacucucuuggcugaccccuuaugaugcagagggagaaggggcagaagccacauccauagugugcuggcccucgggugauccuggaaagcagggcuuggaggacgcauccagccccaccggcagaggccaucuggagucaggcccuggcagagcacuggggauaagaauguggccagaguguugaauaaauggagccagcaaggcuggccggggacgcccuacaaucaccacuguccccaaaccaacaagacaggggcccaggagggugcuggcaggauggugagucagggcaggguccccugaggcccuugcaccagugaagaugggagagucaggagucugacucgccuccccagacucagacccagaggacccagacccuucgaaaucaacuccgaacuagaaacuaagaccaauggugggggcgcagcgcacagcacuacugcugggcccagcacacguggguauuuuacacgccacgaccucauuacuuugcacgaccccauuuugcagauggggaagccaaggauggacaaggucaucaccugcucaagcgcauacagcucacaaaaggaagaaccagcacccaaaccuaggucgaauuuacucuagagccaguacaaagaggaguaaaucuguacuuaguuuuuaaaaugaaugagaugacuaugcagauaaacaggaaguccuguccccagggaggucccaccacacaagauucuggauuuucugagugaucuugggcuguccccgcuccagccaugggccugucuccugucugcaaaaagagcgacgggaccugggaugggcgcugucuaggaacaagucugugccaagagcugucuccaugcccuuugaccuccagccaguggcuccagacuucagugcucagcccaacagcuucaauaauacgaggguccuuuacacccacuccaauuucacaaacaguaaggagcuggguacacucauuucagaugagaagacugaggcucagaaugauauggugacuuacuccaggucacacagcaaaugaggaacacgcuggggaucugaaccuggacuggcccccacaucucagcccuuuucuuuccuucuuuuuuuuuuuuuuuugauggagucuugcuuugucgcccaggcuggagugcaaugacacgaucucagcucacugcaaccuccaccucccagauucaagccauucuuccgccucagccuccagaguaccugggauacaggcaugugccaccacacccagcuaauuuuuguaucuuuaguagagacagcguuucaccauguuggccaggcuggucucgaacuccugaccucaagugaucugcccgccucggccucccaaagugcugggauuacaggugugagccauaucuccuggccuccuuuuuuuugagacauggucucacucugacacccacgcuggagugugaucucagcucacuguagccucaaccuccauggcucaggugauucucccaccucagccuccugaguagcugagauuacaggcgcgugccgccaugcccagcuacuuuuuauauuuuucuuguagagauggggucucaccauguugcccaaguugguuucgaacuccuggacuccagcaaucugucugucuuggcuucccaaagugcuggcguuacaggugugagccaccgcaccuggccaucccggcauuuuucuauucugcugugaggcuacugugcaugucugugcaugucacaauccccauuuucucauugguuugcuugacuagccuucagugaacacccacugcgcugggcacuagcagauauuaccaaaugccugccuccccgggaguagcuuggggucgcagagaaaaaccuuuaaaccagcugcaccacacacucucccucccucugagcuccaggguguccauaggggaggcucaucuacuaagcacucagcaaugaacugcacaucuggcuggcacuuuagaguuuacaaaauacuuucccaucugucauuucaucucugccuuggaacaguucuuggucagucaggcagcauuaucacaaacuacagauggggacacugaggcacagaggagcugcaugaccuucccacagccacacaaagccacgucuagaacgcagagcuagacgucuaacgucucccucggcauguucugucuuccacgcucucacucauguggagggcugugggcauacaggcugcuucugccaguuuucuagagcggucuugggaggccaacuugaccaucugugccucaguuuccugaugugccaaacaaauaaucugguacuaucucuaggggcugcagaaaguacccugcaaggaaguggucagggaacucccagucuccguccccgucuccauugaggcuuccuuagcacauuucauacuccaaggaacccuaaccaugggguaacagaaaccccgaaguucugagcugauggacacgacacacagacuugguguucucugcacuggacagagcugauuuucauuuuccaaggaggguaaccaaggcacagaggugugucuagccugcuucugagggugcagggacaggaaugaggauaacucguagaagggcuggccaccucacuccagcaacuucaagccuccacccgcuaauccacaagcaccaacacuaaauaccuucccuuuggaccaauaagcacaaaggaagggccaagacucaugaccgugccccucagaaguggcacugaaaggcgcaagccucauuucucccaggccaaggggaggacugagaggucagugauuuguuuaaaaugcaacaucacagcauacucauacuuucaacaggaagcacauccggagagaaaaagagagagagagaacucccuaaugaggagaccgcauccccccaccccacccccgagguuacaggggagccugcgucaucccaaagccugccugggcuggguuccaggaggccaggacauagagaggggggccuggcuagggguccagcagcaacccaagucccuucuaucuaccaauauccuucucccaggaagcaggggagaggaugugaaccccgccuggguuuucccacacccagcuggugacccagcugacccgggacacugaggcacaaaagaaccgcaugacuccugcagaaacuggagcuaaaaauacccuccagugcccagccuggccugcgagaggagcccccuggccugccucccggcaaccugcugcuuccuuccccaucugggauggcccuggggcaaaucaugccccuggagccacauucugacuucagauccccaaauccuggggucuuuccuccucuuggucccaugggcuggccccaggggcuccagcuggagcuaggaacacuuacccagguagauaucuccgaaggacccgcucccgaucuuccgucccaggcgguacuuguuccccacacguagcuccauggcucacucuugcugcagaggaagcaggaacaugagggucagcgacguggggagccgggaaagggguccaguccaccaaggccaggcagagccaccaggaacucgaaaaccugcauucucgaagaccacauucugcaggugucagguggcccacagccugcacuccacacaccuggggaacagcuaaggcaggcugaggacagguuucaguguggccagagaggaagcagccaagcaagcaugucuuugggggaugcucauucaggggccccucaaaagaagcuucucaagggaucacaacgggcaucagcccucuuacaccuccuaccccccaggcucccacagccuggccuggucuucccaaguacugccccugcccagaggccagaccucgccagugcccagcacgccuugcaggagaaagucgcauccccuacuggggggaaggcagaaaagaaugcccucgaccauccaccuuccagccaccuccccaucucuacgucaugacaccaagaccucacacggaggcccauagccgcuuggauaaacuguuuggagcuggcguccuuuaagacuaggagggucuccuaagagggcccucauagaacaacaaaggggacugagccaggguuuuagccgccugccccggaugggugggaggaggaguucugaugugagcagcuucucuccuuccucagggccaggggggagcccucugcucuggccuggggcagaggagggaccccucugcucuggccuggggcaaaaguccggacacccuguuccuggucagcagaggaggaaacugaaggccuggaggcagugcugccguggggacagggaccagggacugcaguaaacagggggagggguguuuacaagaggaccagcaucaaggacuagcaagagggaacuccuuucacagacaggguacucaggcucacagaggccaugccaccugucccacaccacccugcagaugguacagccucgccgaggacagggcuccggcugucccaccugguggucucccacacucacaaacagggcaaaacaggaagacugcagagcagcugugcuggcacagaagaucagccccuugcccgugccaagugcugcccccaacaaccaggccagccugggagggagauggauuccagggacagugggcagaucccaggagagacagggaaccccggcaccuggcucccaaggagcucaccagcccuccaccaauaaccacgaggcagggaccuccaccagagcuggccaaacucugggcucucaaucaagggccgcugcccauaugcuuggccugucucagcugaggugccacgcugccaggggaacacaguccacguuugcaggaaacccacacgccacacaucccacguacacacacguccagcuucccgaguguguacacuccaacggaagaaagaaaagcaggcacacacagugagcccuguugggggguaagggggggugugcacgcaacccccccccaacaccucaguccacuuucugccaacaccaauucagagaccacacauggcagccaggaaacccgcagguuaggaaaggaacauaaauauacccgcauccuauauuacauaaauacccacgccggguuauauaaauacccgugcccucugucugggugucuuacauaaauauacugcacaugaccccccagucucuccccacucaccggcugucugcagagaacgagagcgggaaggggcaagcccuucaggacccccugacugcuaugugccagccacccagacccccagucgcuccccaacaccccagggguccaaggucccugggggagccuagacugucccggcaccaauacccaaaaagccucccagaggagagcagaaaagcuucauucaggaauggagaggcuuuucaguucuuuugcugcuucucccaugggggagggggggagauaaacaaaguggggggaaaaguggauauaaagguucaagaguuucagcagguuaaaaaaauuagacaaacuaccaaccagcauggcacacgggcagugcuucuuacuccccgaacaccaucgccuaccccugagccggggcccuugucccucggacgauuaaaauaaaaauugaagggacaucauagaaacgaaggcaaaggagacccaaacacaggcauugcuuggaagcaacuugagacacuuguguccccuucuccucucuccaaauccuucuccaggaaggaggcuaugccaggaagaaaauaugcaagaaaacuaagggaaaaguuggggagggggcucaccccacuucgaguuaggguauuaacaagagcuugggaauccucuaacgacacccagacacuguuuugcguuccuuagagacuugcaagacaucaaucucucacacaaaaaugggagaauccgauccgacaaauaacccccaccccuuucuuucucuccacaaagaaaaacaaaucaguggccuggugaccacacaccucuucaccuuaggacccccaaacgcccgucauccaacgagcgggcgcagccuugcgaacccccagguccgggcgccggggccgggagagcagggggcgccggugauuguccgaugaaacgcuacgcgggcccgaaucaacaguauccggcgcccagcaccccaagcccccucccucagcguccccaaaucacagccgggguggccgccuggccggccggggccucggagggcccagcggggggaagcggaggcaggccggccggggggccucccccgcgagccugcaaaauaacaggcccccuccuccucguccccagccgcgccuuuguccucgccgggccgagcgggcggcgcccgggcugcccccccuacaccccagcgcgaacgcgcgugugucugcccucccuucccucccucuccagcaaaaacaaagaggcugagggagcccgauuccccccagguuugcacccuuccgcgggcccgcggccccccgauauuuaccccgccgggaaggcgccgaugccgggccacugcucggggggcugccgcgggcgggggcggcccgccggggcggaugccggaggauucgcggagccgcccggcgcgccagccucucccggcccagccgccgccgccgccgccgccgccgcgcuccgcucggccccggccgggcucuggcucugggcucucgccgccgccgccgccgccgccgccgccucccuccucccggccuccugcccgcccgcccgcccccgccgccggcucgcgcgcucucgcaccgcgcgcgcccgccggcucccauugagccccgggcccgcccgcugaugucauccccggcccgccgccgccgccccggaggauuuaaagggcccgcgcccuccgcgcugggggccgcagcugcgagacgcaguuccccagccucagugcaggcgcgcgggcuuacgcgugggggugggggagcacacagauacugacacccuaaugcaguccagggcacagguggaaaagacggggugcgggggggacagagggaagaggagggcgcacaaaaagcggaggugaggggaugggaggggagggucuagacccaaagucuccucuccccgccugccaggaucucucuccucuccaggcagagcacugggccccugcgaaaacaggcggcuauucacgacacugcaaaagauguuagacugcuggaggcucaguccgccuccagguuccgagugccgcagagaacacaggccagguugauucagggcaagagauuugaggagacagcuagggaugucgacacaaggcccagaaagguagccugggcucauacauucuccucccguggaaaaacgaagggcaaagaccucuucuucuuuucccugaagcucaaacugugaugggcacagagaggaccccucagaucccaaccucauucuccccuguugaaggaggggugccacaaguaccaaagcaccgacacuugagucugggcuccgaguggugcacguuuagccaagccaccucccagcucugagcuuggguuuccuuaaacagcaaaugggaggaaggacccuguccuccccaggucacagaauuaauaaaagcuucuaccggcaugcagagccgcgaugaaagguugcagaacaaagucauuaaagugaugauauuuacacugagccaugcaaagcuuccaauuaugacacaccuauauucacacaguugugacuguggacacgcaaaaugccugaggcccugcguccaaucccggaagcacaguuccugggaggagucacuucuauaauagccguaucuucccuccucgaggcugagggacugagucacacacguguccaaacgggcaggagccccacagacuaaguccuuucgccggccaggaaacuggcccagagaggggaagggcuuugcccaggaccacaaagcccaacaggacagcucuguucucccagcgaucaccaggaaacugggucuaucuagagcccauuuccaagagcaggagagugagaagccuccucccaggagggccugccuucagugacaccuuugccagagcagggggucaccagccagguggugggcuuuacuuggccugcgcggugcuuucuguuguuguuuuguuaauuaauccccaaaguuuuuuuuuuuuuuuuugcuuuuuguuuuuguugguuuugagauagagucucgcuguguggcucaggcuggagugcaguggcucaauaucggcucacugcaaccucugccuccuggguucaagugauucuccagccucagccucccuccugaauagcuggaauuacagaugugcaccaccacaccuggcuaauuuuugcccaggaccacacaguauuuuuaguagagacgggguuggccaggcugggcuggaacuccugaccucaagugauccgccugccucggccucccaaacugcugggauuauaggcgugagccaccaugccuggccacuccccaaaguuuuaaaacuggaagauuucauauuucagauccagauucccuguuucucugggggcauuaggagauccgguaacucugggcccaaguucucagccggccugagcgccaccccaccgccacccauuuuguuucuuuccucacaugagcccaggcagagaggccugggcacaauugagcagggggugaagucugccccuguguccuccaguccuuaccaccccuaaccuuccaaccugggcccugcuucccaaagcccuccucuucuucagcacuuucaaggcaaccagcccugggagaggagguuauuuguuaucucauuuaauccucucaaacaacaacagauuacacuguauucuuucagagaaggaaucaggcuccucccagugcuugccuaagggcacagaucaaccucucccuuaaacugggccuggcuggaacagacccccugccccuuccuaacccagccagaucgccaggucugacugcagcacguucacguucuccccucugcauucaggacuuguaaccacaccucccaccccagcacccccaccccacccccugccccaguuaagauccugcucaguucccugggccagccaggcugaggagcccggcucauccccaggccugcuagggagccucccugccuugccauuggaaggacaugcuguuguccacugccugaguugugggcccaaguccuuguccuuccuaucccuggaagaccugugugugggcccuuccaaagagcuuugcagugaagcuauaagggaaggcaaaccaugacacaaaacccagcugaggaggggagacugguccaaagugaaaaacaaaaccuuacguguuccagcagccccacagccugacuucucucuccgacuugguucacagugauuccucucagauuuaacuccuaacuuuaaaacccaacgguggggccgggcacgccccuguaaucccagcacuucagaggccaaggcgggugaucaccugaggucaggaguucaagaccagccuggccaacacggugaaaccccguuucuacuaaaaauacaaaaaauuagcugggcacgauggcgggcaccuguaaucccagccacucgggaggcugaggcaggagaaucacuugaacccaggaggcggagguugcagugagccgagaucguaccauugcacucuagcuugggcgacagagcgagacuccgucucaaaaaaauaaauaaaaaacaaaacaaaacaaaaaacccaaggguguggcaaaguuccccuagcuaccuucucugcaagccaacaagaagaugaaaucaggcuagaauagguguggggugaauugccagcucccaaggggcccacccuggguuucagcugcucugcauugguucaggaauaguggcucucacaacaccuuuccaaacuggcuuuugucuuuuuuuuagaggcucauucugucacccaggcuggagugcaguggcaggaucauaccucgcuguagccucaaauuccugggcucaagcgauccuccugccucagccuuccaaguagcugggacuacaggcaugcaccaccacacccagcuaauuuuuaaauuuuuuauagagauggggucuuacuguguugcccagacuggucugaaacuccugggcucaagugacccuucugccucgcccucccaaagugcugugauuacaagugugagccacuguguucccaaacugacauuuuuuaccugcucccuauuucagacccuucaagaucacuuggcacgcaggagcacugggcugggaucccaaggacagcccuggaauucccagauaaugacgauauggcugcagauaaacccagaaagauuucaguaccugccccaggaaucucagucuugacuaaggacucauagauuuacuaaacaucaagggcuggccugaaaacggcccuccaggaucuguccuccacuccccgcaccuggcucuccugaccucagcuccuguaaguuuucuucuugcucacagcccuguagccucacuggccucccauggaaugaaccucuggccucagggccuuggcaggggcuguuuccacugccuggugcgcucuucccgcagagcaccaaccccccucaccucucaccuuucucaaguccccuucagagguaggcccuccuggucucccaguuuauuuauuuauuuauuuuuugagacagagucuggcucugucucccaggcuggaaugcaguggcccgaucucggcucacugcaaccuccgccucccggguucaagcaauucuccugccucagccuccagaguagcugggauuacaggcguccaccaccauaccuggcuaauuuuuguauuuuuaguagagauggaggugucaccauguuacccaggcuggucuuaaacuccugaccucaggugauccguccgccucagccucccaaaaagcugggauuacaggugugagccaccacgucugggcccagucucccaauuuaaaauccuggcgcugggccacaggcggugccucacaccuguaaucccagaacuuugggaggcagaggcaggcguugcuugagcucaggaguuugagaccagccuggauaacauggcgaaaugcucucucuacaaaaaauacaaaaauuagcugagcaugguggcugggugugguggugcaugccuguagucccagcuacuugggagguugaggugggagaaucaccggagcccaaggagguugagacugcagugacccuugaucauaccacugcacuccagccuggacagcagagugagaccuugucucaaaaaaaaaaaaaaaagagugagaccgugucucaaaaaauaaaaauaaauaaauaauuuaaaaauaauaauaauaaaggccaggcacaguggcucacaccuguaaucccagcacuuugguuaggaggccgaggcagguggaucacuugaggucaggaguuugagaccagccggccaacauggugaaaccccaucucuacuaaaauacaaacauuagcuaggaguggagaugugcgcccguaaucccagcuacuugggaggcugaggcaggagaauugcuucagccugggaggcagagguugcagugagccgagaucgugccacugaacucccgccuggaugacagagcaagauuccaucucaaaaaaaaaaaaaaaauaggccaggcucgguggcucaugccuguaaucccaccacuuugggaggccgaggcaggcagaucacgagguuaggaguuugagaccagccuggacaacauggaaaacccugucucuacuaaaaauaaaauaauaauaauaauaauaauaaaaccccauccccaugggucacugccuuccccuucucugcugucuguuucuguuuuuuuguuguuguuguuguugguuuuuugagauagaguuuugcucuuguugcccaggcuggagugcaauggcgcgaucucggcucggcgugaucucggcucaccgcgaucucggcucacugcaaccuccgccucucggguucaagcgauucuccugccucagccucccgaguaguugggauuauaggcaugugccaccacgcccggcuaauuuuguauuuuuaguagagacaggguuucuccauguuggucaggcugaucuugaacucccgaccucaggugguccacccgccuuggccucccaaagugcugggauuacaggcaugagccaccgggccgggccgggccucugcugccugucucuuuuucuccuggccuguaucacuauuuaacaugcucuguagggaacuccacaucacuaucuaacaugcucugcagggaauuuuuauuuuuuugucugcauuccuuacuuuggggucuaagcugcauaaagggaaggaguuaaugcuauuuugggcaccacuguaucaccaauaucuaggaucuauuccagcacauaggagguauuuaacaaagauuugcuggaugagugaaugaauggacggugaggagacagccuccugaucucugaccaacuccaagugcugucacccaccauucgccaggcucuuuagagacacguggccuguacugacgaggucagcucucacugcacccucgggggcuggggcuggggguggccugccagggucugugcccuuaaccacucucccaggcuaacggaagaaauaguuucuuuuggcugggcgugguggcucacgccuguaauucuagcacuuugggaggcuguggugggcggaucaccugaggucaguaguuccaagaccagccuggccaacauggugaaacccugccucuacuaaaaacacaaaaauuagccaggcguggugacucacgccgguaaucccagcuacuugggaggcugagacaggagaaucgcuugaacccgggaggcggagguuguagugaguugagaucgcaccacugcacuccagccugggcgaugagugagacuccgucucaaaaaaaaaaaaaaaaaaaagaaauaauuucuuuuuuucuuuugagauggaguuucauucuuguugcccgggcuggagugcaauggugcgaucucggcucacuacaaccuccgccucccagguucaagugauucucccgccucagccucccaaguagcuggaauuacaggcaugugccaucacgucuggcuaauuuuguauuuuuaguagagaugcaguuucaccauguuugucaggcuggucucgaacuccugaccucaggugauccaccugccucagccucccaaagugcugggauuacagauguaagccaccaugccccgcuguggacaugauuucaagaaaagcccuaggugucccccaucaggcuccugccccugaacccauccgcuacagaaggaacuguggacuccaguugggagagcuacaagcuucauuuauuccacucuacugcuuuuuucauuuuguguuuguuucuuuguuuuuuagagacagggucuugcucugucacccaggcuggaacuuaguggcaugaucauagcucacugcaggcucgaaauccuggacucaggcgauccuaccaccuuagccuccugaguagaugggacuauagguguaugccaccaucacaggcuaauuuuguuuuuuguuguuguuguuguuuuuuggugagcgggagauuuacucuuguugcccaggcuggagugcaauggugugaucucggcucaccgcauccuccgccucccagguucaagcaauucuccugccucagccucccaaguaguugggauuacaggcaugugccaccacacccagcuaauuuuguauuuuuuuuuaguagagacgggguuucaccguguugcccaggcugaucucgaacuccugaccucaggugauccgcccgccucagccucccaaagugcugggauuacaggcgugagccacugcgcccagccacaggcuaauuuuguuuguuguuuuauagagacaggguuucuauguugcccaaauggggucacuacauuguuugggcuguucucgaauuccugcccucaagugauccucccccaucagccucccaaagugcuaggauugaaggcgugagccaucauaccuggccccccuccacuguuuuacagauagagacacugaggcccaaugaaggaaugagccuuguccaaggucacaggcagcaugugauggcagcuccacaugguuaaggagcuagcuucaaauagcauucugcgaccaggcacgguggcucacaccuguaauccuagcacuuugggaggcugaggcagacggaucaccugaggucaggaguucaagacuagccuggccaacauggagaaacccugucucuacuaaaaacacaaaaauuagcuggacaugguggcgugcgccugucaucccagcuacucgggaggcugaggcaggagaacaccugaaccugggagauggagguugcagugagccgagaucccgcuauugcacugcagacugggugacagagcaagacucuguaucaaaaaaacaaaaacaacaacaaaaaagaagcuagcuucaaauaguauucugcagccaggcaccguggcucaugccuguaaucccagcacuuugugaggccaagguggguggauugccugagcucaggaguucgagaccagccuggccaacauggugaaacccugucucuacuaaaaauacaaaaaaaaaaaaaaaaauuaaaaaauaaaaaauaaaaaacuagccuggcaugguauggugguggugacuguagucccagcuacuugggaggcaggagaauuccuuaaacccaggauguggagguugcagugagcugagauggcaccacugcacuccagccugggcgauagagcaauagagggagacuccucugucuccaaaacaaaaaaacaaauaguauccucccauuuuguaacagugugacacuaggcaaguuccuaaaauucuugagucucauuuguaaaauggggauaauauaaaucacaaaaacaauguagcccagaagcagcccugaguaagaggaagaugcuuacauuacaauguugcuauucuuaggagccgagcagaguucaaugcagggcuccugacuugggcuccucugagcaccugagcccugcaggcuguaucccccgccucuccuuuccuuuugucacccuuccucuggaggggccaccgccagccccuucuacggugggaguuggagauaugcaaaccuaguugggcccaggggagcugcuagccuugcccaucuuggucuuggcucucgaaggccccggugggaagcuucucaggguccuccccuuuucaggcccuguucauggagagucuguggcccacaggcuccagagguucccccgcccccagcccugccagccugaagaugcuguccuggggcacucuccucuccuuacccagcuaggccuuggcucuuuguccccagacccuuccaugacauccuacccaccccucacuauucccagggcacagcuuuggccccaggcucucuuuucaggcacuucuuccagggaaccucaccacugggccgugcccggucaggucacuccugccagggcuuccucccuccucuuccaucuucagcggagaggcagcagggcaggguagcaaggucuggguuuggucccuggucagucugaauuucagcgcgaccuuggagaauccacagcccuucucugaggagcuggacaaagugagugcuaaagcucucagucuccccagcugaagcuaagggcagggcuggaugggcaaggacccuacacuccacaucccgggcacuaagcugagaaagaccuugaggugacaaaucugggcucagugggaaacggcucuccccgcaccccuuacccccauauucaaaaccugagcagcucccaugagcucuaccuuccaacuggauucugaacccagccacucuuaccacgugugucuuccacuuggcuacuacaguggccuguuaaccacugagaucugacuguggcuacugaaaauacaccaguggcuccuucuucccuuagcaugaaauucacauucuuucccagggccugcuaugaucuagccccugccugccucagaccccauuucaaaccucacucucccucccucacugucugucaucucaccaugccucagggccuuugccuggcuguuccucugccuacaaugaucuccccaaauccuccaugacugccuccuacucagggcucagaucacaacucaaaagucaccucugcacagaagcccuccuugacuggucuucagugggcuuccuuccccucuguccuuccuguacuggggauauccugcuuuuuuuuuuuuuuuuuuuuuuugauacggagucagucugucgucaggcuggagugcaguggcgcgaucuuggcucacugcaaccuccgccucccagguucaagcgaugcuccugccucagccucuugaguagcugggauuauaggcgcgcaccaccacgcccagcuaauguuuguauuuuuaguggagacgggguuucaccauauuggucaggcuggucuggaacuccugaccucgugauccgcccgccucggccuuccaaagugcugggauuacaggugugagccaccgugccuggccagcugcuuuaucuucuucaugguacuuaugacuggcugaaacauuaacuuguucauuuuuaaugcucuuagggucucuccaagacagagaaaucucccauaggugcuccuguggguacccaacuggucaugggugccccguaaauacuugugcaauggugauguugugugugugaucucaggggugaaggcagggccugacacuuuccauccugagccagauguucccuaacagcccucccucagggccaccuugccccacccaucccuucucacgguggcugccuguccuccugcucugcuggggcccucuguccuccugcuccacucagcauucccugugcuguugcaacucccagaggagccaggagcgccugucacguguccccaggagcagggagcacuacacaaauccuuggcauccccaaagggccacccgugcccggccuccagcucaccucugccugcuuccuucccucagcuuggccugucacccccggcccuaugggcuccucugaccccucugcucaucacaacaucccuuguuugugcugcagucaaccagcgcccaaaccugcuccuucuguccucugagaagccagggcuucccguucccagcucacacaaccacucauuagcugggcuccgggaaugaggaugauugcugcgacuaauaaucccgaugcccacagcagcgcuccucgcucggcauaguuggugcgacucaucauccugccacaucacacguucacccacaagcauuuccugaugccaacuccuugcagggccucagaggucugcgccggccccagcuugccaggagcugacgauccgacaggagaggcugaauagacacaagaaaaaagaggguccuacaguauugagagaauacgcuagacagugaccgccacaggaaagucagugucugggggcagugguggugccaauggcuggcgagcagccgucuccccuucgcccugggcauuuugugaugugggcaguugcuauucuuguaauuuuaugugaagugcuacacaaauacagcacugagacaagucuccgaccccugcuuccccugccaucagacugucucccuaagcccugucuauagagaaauucugaaguugacacggggguggaagggaggaggcaggacuugaaaguaggugggaugccgggcacgguggcucacgccuguacccccagcacuuugggaggccaaggcgggcagauuaccugagcucgggaguucaagacuagccugaccaacauggagaaaccccgucucuacuaaaaauacaaaaaauuaaccgggcgugguggcacgcaccuguagucccagcuacccgggaggcugaggcaggagaaucacuugaaccagggaggcagagguugcagugagccaagauugugccacugcccuccugccugggugacagagcaagacucagucucaauaaaaaauaaacaaauuaaauaaauaaauaaauaaauaaauaaauaaauguaggggggaucuggauggugguuggcuggggggaaggaacagcccugagcaauagcugaacgguaggaaccucggauauuugggggugggaagggcccacuguggggagaccagucaaauggcacccaggccucccucaggggagaaggcugaagaggauggaagagguaagaggaucucuaaucccaggagcugacuaggagauuuagccaauggcuuugcucagaacagcuuagaguuuugcucauggacaagaggagagaaaaaaacuaggauuuacuggauggacagcgugcaggcuccccacuggguacucagcacugaaucugguuuaauaaaugccacaggaauccugugagcuggagaucacccugcccauuuugcagguagaaaccugagguucacaaggaguucaagaucaguucaggcaacaagggagacccugucucuauucaaaaaauaaaaaaauuagcugggcaugguggcacaugccuauggucccagcuacucaggaggcugaggagagaggaucgcuugaggccaggagaucgaggcugcaaugagccaagaucaugccacugcacuccagccugggcaacagaauaagauccugucaaaaaaaaaaaaaaaaaaaaggaggaaacccgaggcucagagaguuuaagagaaucugaccaaauaaugcauaaaaguuaggaagggccuggcgcaguggcucacgccuguaauuccagcaguuugggaggccggggugggcagaucacgagaucaggagaucaagaccauccuagcuaacaugguuaaacccugucucuacuaaaaacacaaaaaauuagcugggcauggugguacguaccuguacucccagcuacuuaggaggcugaggcaggagaaucacuugaaccccagaggcagaggcugcagugagccgagauugugccacugcacuccagccugggugacagaacaagacuccguccaaaaaaaaaaaaaaaaaaaauuggccaggcgcgguggcucacgccuguaauccuagcacuuugggaggccgaagcggguggaucacuugaggucaggaguucgagaccagccuggccaacauggcaaagccccaucucuacuaaaaaaaauacaaaaauuagccuggcauggugacgggcaccuauaaucccagcuacucaggaggcugaggcaggagaaucgcuugaacccagaggguggagguugcagugagccaagauugcgccacuucacuccagccugggugaaagagcaaaacuccaucucaaaaaaaaaaaaaaaaaggcugggcacgguggcucgagccuguaaucccagcacuuugggaggccgaggcggguggaucacgaggucaggagaucaagaccaaccuggcuaacacagugaaaccccgucucuacuaaaaauacaaaaaauuagcagggugugggggcgggcgccuguagucccaguuacucggaaggcugaggcaggagaauggcaugaacccaggaggcagagcuugcagugagccgagaucgcgccacugcacuccagacugggagagagagcgagacuccgucucaaaaaaaaaaaaaaaaaaauuagcuggguacggucgcucacuccuguagucccagcuacuugggugacugagaaaggagaauugcuugaacccgggaggcagagguugcagugagccaagaucaugccacugcacuccagccugggagacagagacuccgucucaaaaaaaggaaaaaagccagccaggcgcgguggcucaugccuguaauccuagcacuuugggaggccaaggcgggcagauugcccgagcucagaaguucaagaacagccuggacaagauggugaaaccccaucucuacuaaaaaauacaaaaaauuagccgggaaugguggcgugugccuguagccccagcuacucaagaggcugagccaggagaaucacuugaacccgggaggcagagguugcagugagccaagaucacaccacugcacucuagcugccugggugacagagugagacuccaucucaaaaaaaaaaaaucgcuuaggaagaacuucuguuuuccucuccagaccuagccuggagccucacccugccuuggggacugggcaccuucugccuuugucucccucaaugcaugguaacugggcaccccucucaggacaccacaaguccgauccaccacuccagaagcacagggauucuggugaccguuaagguagcugacucccaggcagaugucugcaccccaucagguucacuaacuaacccagugggguguaagaagaaaaaaaaucagaauuuguauucuucaguuuuuaaucugagcccgcuaaauauucuacuucaauguagguuuuuaaaaauuuauuuauuuuuugagaagagucuugcucuguugcccaggcuagagugcaguggcucuaucucugcucacugcaaccucugccuccuagguucaagcgauucucaugccucagccucccgaguagcugggacuauaggccugugccaccacgccuggcuaauuuuuuuuuuuuuuuuuugagacggagucuggcucugucuccuaggcuggagugcaguggcgcgaucucagcuuacugcaacccgcgccucccggguucaagcaauucuccugccucagccucccgaguagcugggacuacaggcgcaagccaccaugcccggcuaauuuuuguauuuuuaguagagaugagguuuugccauguuggccaggcugaucucgaacuccuggccucaggugauucacccaccucggccucccaaagugcugggauuacaggcauaagccaccgugccuggccaauuuuuguauuuucaguagagauggguuuuugccauguaggccaggcuggucucaaacuucuggccucaagugagcagcccaccucagccucucaaacugcagggauuacaggcaugagccacuguucccagccccuaauguauguuuuauaaugugcuuaugaacacagcagaacacauauaccuaaguuauaaauacuaaauauacaauuaaauacaaaacgaaugcucaaaaauauuuuuguggguuuuuuucagucuuuauuuuguuuccuuucauauguaguccugcagaucaaaaacauuuucccagaugggguaugcaaccacaguuugcauuaguguuggagaccccuggaacgaguucucacuugaggggcagcaaugauaaagacuacuucaggcuggcgcagugacucacgccuguaaucccaacacuuugggaggccgaggcaggaugaucacuugagcccaggaguucaagaucaggcuugggaacauaggggacucucucucuacaaaaauaaaaaaaauuagucgggcaugguggugcaugcccauggccucagcuacuugggaggcugaggugggagacucgccugggcccaggaggucaaggcugcagugaaccaugaucacgccauugcacuccugccugggcaacagagcaagacccugucucaaaaaaaaaaaaaaaaaaaacaacacucugcuucaagaggcuggauucaaauucuuaauuggcuacuuuaagcuccaggcuauguggcuggaugaguuuauaggaccuuccuaagccucaguuuccucaucuaagaaauggcgguggcaauagcacccaccucaguggggauuaaaagagcugcuguggccaggcgagguggcucaugccuguaaucccagcacuuugggaggcugaggaggguggaucaccugacaucaggauuucaagaccagccuggccaacauggugaagccccaucucuacaaaaauacaaaaauuagcugggcaugauggcuggugccuauaaucgcagcuacuugggaggcugaggcaggagaaucgcuugaacccuggaggcggagguuccugugagcugggaucgugucacugcacuccagcccaggcgacaaagucagacuccaucucaaaauaauaauaauaauaauaauaauaauaaaucaaagagcugcugugcauaaagcccguagcucagagccuggcaugugaauaguagcugcaguuauuaauucaccuacagggccuuggccuggcuaguuauuaauucagcuacagagcugggccuggcugggccuuucgguggguccagagaugaaauguacaugggucuugcacgguggagcugaccuacucaaggagacccaaaccuaggaacuggucauuauaaauuagugugagcagggcuaagacagagacagggaugucaguagacacugacagagugcagggauucuucgggaaagcucugaugccuugugcagaaaacaacagagagaugucugagaacacagauguaugucagacacccucuuagguuagagaggcaguguagccuagugaugaggggucuggaguuaagacagacugggauugaauccuggcuucccuugggcaacuuacuuaaccuuucugugccucaguuucaguaucuuuuuuuuuuuuuuuuuugagauggagucucccugugucgcccaugccuguaaucccagcacuuugggaggccaaggcggguggaucaccugaggucaggaguucgagaccaggcuggccaacguggugaaaccccaucucuacuacaauuaaaaaauuagccaggcauggugucgugugccuguaaucccagcuacucgggaggcugaggcaggagaaucgcuugaacccgggagguggagguugcagugagccaagaucgcaccacugcaccccagccuggcaacagagggagacuccaucucaaaaacaaauuaauuaauuaaauuaaauuaaauaauauguauccauuucguagaaugacucuaaagugccuagaacaagagacagccacacgagguccucaauaaguauuagcuaucagauuuuugaacagacauguuguggggcugugaaaguuucagaaagugucauuucccaggcccaaggcagcgacuugcuucuggguccuggugcuguuauuccaaaugacuaacauugugacuauguaaugaaccacuuccaauuuucugugaauuggaagaugacuguccuaauucuguuuuagaacaucagagaccccuggauacccaauuguuaggggagccugcuaaccagacuccuguccuggaguggcaagccaggcagaaagggaugaccuugaggggggggucacagacccuuucuacaagauuauuuuaaugcuaaugcucagacacucccaacagggcucagagcccuuuugcucucauccagugagagcgugcugugggugcacauuacaaaaaagcccgguuagagaaacggagcaagccccccagggucuagaaauggauggcucugggaaauggggauuuccuaucccacugagguguggccacagguucccagcacccagacccccucugaagauggccagggaguuaagaagaugaggggccaggguggggguguacagucagagacugagcaggccuuucaaagugggaggagggccugguaaguagguagcuggggaguuauuauucccauuucacaguugaggaaacggaggcccaaagcacagagacuucuguuuucucuaagcaaagauuagccugguacaaguacagcugaugacccagcccugacauccuccucucccuaacucccccauccaggcauuugguguagacaccccugagggaguuaggagcccugggggccaaaccgacucgguuacuguuucccauguggaucuugaacaaaucaccugucuucugagccuguuuccucaucuguacaagggguugguuacuaugccccaccuucaccccuuccuauuuuucuucuaauccccucacucugaagcuugcccagaaacucaucccaaaggggcgaacccaucuggaggccuggaggucauuggcccuggcucagggauccugucugcucccagcccacaaggagcggauaugcgccgaccuagugguucguguccaccuggcccagacucagagaugucuucauucuggggguuuucccaagagcucauccccguccuucucuccccagcacuucccguucucuggucccucaauaccuucaguugguccaaguccuuucuacaaacacacaaacaugcagacccuuuuucugccagacccaugauggcgguguuuguggggacagggccuacauaauuuagcucauuuaaucuucacaacacccuggggagguagcucuauguacccacuuuccagauguggaaacucaugguuagagagagcaaaggucuuuauccagaucccaguguuggcgguggaggucuuggccuguuuuuuucuguuacaucucccggucucccuucauaaucuuccauggaguguucagaaugguacccaaccauggucaaucucucaaauguuacauuaugcagccauuaaaacaaugauuacacauacacaaaugacucaccacaacgagaaaaugcuuaugacacaauauucaagggaaaagcaggacauaaaaguugcagauacaguaugauaaaauuauaugaaaaugguugugcauggaaaaaagacugaaaggaaacacaccaaaauauccagagugauuguguccugguacuauggaugauuucuuuccuacuuuucuacauuugccaaauagucaaucggcauacaguuuuacaacaaagaaaaggcaccaaugauaauaaugauaauaauaaaaagaauuauagggccgggugcgguggcucacgccuguaaucccagcacuuugggaggccgaggagggcggaucaccugaggucagaguuuggagaccagccgaaacccugucucuacuaaaaacacacaaaaauuagccgggcgugguggugcaugccuguaaucccagcuacuagggaggccgaggcaggagaauuucuugaacccgggaggcagagguugcagugagccgagaucgugccagcaacagagugagccuccgucucaaaaaaacaaaacaaacaaauaaauaauaagaagaaugauaacaauacauuugcgguugaaauauuuggaaaccugcugcuuccucuucaacuuccucuccuucaauucccuccaaagucuacguuuucaggacaacgugacuauaacccagagacaagggaggauuuggggggagcaggcaguaucuccacagacccacgcccaccuccuccuccucuccuuugacccgguucuccucuccgucgagugaggacccccaccccgggcccuccuccucccagcaccuacccccagcugcugcuggcgcucaccugaagcuugcuggccggccuucgagaugcgaagugcgcacaccugugccugcaggugaggacuccgcuggggagcgcu

SEQ ID NO: 17868 - RNA, 1497 nt, Homo sapiens
guaagacaggggguggggaauucuacuccaugguaucuucagagcuaggauaaugcuccuuaugcaaucccacugcauaugaccauggcaguagaacaaguucaauuacuacacuggaugcguuaagugugcuuuccuagcagaaagcaccaggguggagucaacaguucacaugcuaauacuuggaaguauuucuagaagggggugcucaauagagggcagacaugaugcaaguucuucauacuagaaagguguccugugugugcaugcacagcuggaugggggcacacaggagcaagcgcagaauuugguuuucuccagucaagucuacccugauguuaucugugcacugccacaauauuaucuugcugccuuucuagaagaugcuguagcaggguaagaaauccaaaguuaauguuuuggccagcugacugggauaagaaccuuuugucugaaaggcccuaugacauggccugaaucgccaaucacuaauaaggagggacuaagucuagccaagaggcucaucuagagcugcuuccggccaauguagauuugucucggccauguauugagugaucugcagcugauaucaaagcuucuguuaaaaaacaaaacaaaauaaauucaauacuuuuaguuuaacaguguguaguucaaacaaaaaaaaggaaaaauaaaaaauaucccaguggaaagggaagugguagccuaaggaugacuauuauaaaauuaugggaaucaaagaacuuaccugaagggaacauuuaagagaccaucgcuugacaggaagugaaaaaaggcccuggugacucagcugaaaauugcaccccugucuaugagguagaagccuucacuuuccaggaucuuguaggacauuggucagaauucugccauuuugguggguuuucucccucuuuugauuuuuuacaaggcagcaaacaaaggggcccaaaacaagcacugauguugaguaacaagaaacagacucggguaccuucccucuccccucacuuggaugagugggggugggaugaagagucuaaguuauucuaaugguagccaauuaauuugguuuagaaaugcaaggggacauggagcaaauauuuuuaauugucuaggcaagaugcacaaagaagcuaccagcacauagcaagccuguuuaaaaaccaaccauuacugaaagcuuuauguaaacugcuuucaggccuccgccuccucucccaacaggcccaaguucuaauggcacagauccagacaugaccucagagggcagaggggcagagagaacuuuccaucauggcugcaggucaccaccucugaaggagggaaugaugagugcaaugcauaaaaaggcuucauuacuuuuguauuccaguuugaauaccuguucucuuuauauuauauaguauaagggaauaauaugguacuucucaccuuacugggcaaauuaaauaccugucaauaauuuaaggauuuccuuguaauacaaauaaucuu

SEQ ID NO: 17869 - RNA, 2547 nt, Homo sapiens
augacacuuucaguuggaaucauuuuuaauauuuaaauacaaaaagugagcacugacuucucuuuuuuuaaacacacacacaggucuaacagccaaaaugugcagaggaaaugagcuccugcugucuuccauaguccccauucuguggcugaagcugcagccugccucccuccucucauacauagggauucauaguggccacuuuacacuacagguguaaugcauuuugucuguuucacauugugugcauguccugccccaacaacuccauucuuuaaaaaaaaaaaaaaaaaacagucguuaauggucaggggcacaucccucccacuggcaucgguuccuaccccacaaggggaaagugagaucuuccaguuaggagcaauuuggugaaaggagucgggugaccagagcuggaauaaccaucugcauggcugcacucugguaucagaguggagacagaaguaaggauaguguggagggcacaguugcaaguugagucuuuccaugagacaauguggggauaauucuccccaccagguuuagauagaucaaugugccaaaguuaaaaaaaaaaaaaaauccaaauuaucagcaguucaaacacuugaauuucaaacuuaucccacugagacagcucaaacagcaauaacaaucuagaucuuuccaggaagugaggguagagccccuggcauuccuccugagagcccuguguuagguccuagaaguaucuggaaaagaaaaggagggguguaaggcaucauacaggccuagagagcuuauucucaccauaccugauggggccaacgucuacaaaaauaauacugaaagcacagucagacaacuaaaagagcaugggcccgaucccaauccccacccacacauuaacuguuggucaacucaggugcuacaacaggagcccucaaccccugggcuguggacuggcacuggcccauggccuguuaggagcugagccacacagcaguagaucagcagcaggcaagugagagaagcuucaucuguguuuacugcuguucaccaucgcucacauuacugccugagcuccaccuccugucagaucagcagcaguguuagauucucauaggaacacaaacccuugugaacagugcaugcgagggaucuagguugcaagcuccuuaugaaaaucuaaugccugaugaucugucacugucucccaucacccccagacaggacugucuaguugcaggaaaacaagcucagggcucccacucauucuacguuauagaauuauuucauuauauauuacaauguaauaauagaaauucagugcacaauaaauguaaugcacuugaaucauccagaaccccccccccgacccccggccacccccaacccaccauccauguaaaaacuguguuccaugaaaccagucccuggugccaaaaagguuggggaccaauguguuagugaaauaacuugcgucuccaccacuggcaaaaagcccaaggucugggcucaccugccgcugcugcaguugcugcuguugcuccauuugcaacuucuccgucucaaagacaacgggaagaaccaggaucauaaaggaaguggucccaauccacaaggcugcccuggaaaaccugcagaggaaaauccccagagggugagcaugaagacaugcaaacaaaacaggcaagaacuacccaguaaccaaaccucucacauuacauacuccaauguuuuugauaaacguauucuacccgcuccuuacaccauacuccuaccagagacaggaggagcagcuaugguagcuguaucaucuagugauggcgguuuaacauucuccugaguucuuacaaagcuccuuauucauuaauuaucuccaacaaucugaaauaacccccacaacuccccugccagguaagaauccccauuuuacagaagaggaaacuaagaaaggauaggguacaagcccaaggucacccaacacgggucugcugcuuccaaaccccguguucuuucacagcaccacgaccaucccaugcacguacccagugccuuugcccucguuccuuaccuguacauuuucugagccacaaagagggaaagaucaaaaguggcuccggccgcggaccggacccucuccggaaacaucuccgucaggccccauagucucuccgacagggucucaucuagcugugguggaguagacgcgggucuuagccgaaaaagcgacauccauuccuggccccgcugcggcacugggagccgccgagccccacuggagcuagggcacccagggcccagcagggccccuaaccccgccucccaaagcagccgcuucgcuccgaucccguaccacgcggaucccacacccacgagcgggcccgcuucccgcucugcaccccgcgaggcccuaguaccuccucaucgucguccuccuccagcuccuccucaggcuucuccgcgucgccuuucgggagcaauucguccggggacugggguuccccugcaccggcagcagcgacggcggcagccaugacuguaggggacaccggaagcggaaaggag

SEQ ID NO: 17870 - RNA, 3658 nt, Homo sapiens
uucaaacauuuacugagucucuaguaugcaucaggcacuauuaggugucuucuuaaauauuucuaauuuuuacaacccaucuguacuuucuuaagaugaggugguuggagaacugaaagguuaagaaacuuucccaacgucacagagccuuucgaugguagggcaggaaagggaacccagcccugucugacucccaaguuggcauucuuucccuaaggaacguuaagcaccuucaaaacaccagucacaucuuguauuuacuuuucuauucuucacaaugucaagccguuggcgaggccuuaauuccugccuaccuucucgacagcucaaaaaacacgguuuuaaacguccuucacugcuccacucauacaagaugagcuuccacucacaggauagcgagacuaaggagccugaccaucuuuccauuuuguuucggguggccucgaaaaguagacauucucggacaugcuccuccccagcugagcgacuacuuucuguuuccuuucccgagucugggaagagacgcggcggccacccugcccuggccuccgacuaccugucuucaugagcgucucggcccccugcccgggcccccucgccccucugcugucccgcgcgguccagggagaggagacucucggucuccgaauccccucaaguggggacccgaagaacggggaggggcacugagcggggacagggaacgcgcggagcgcagcuggcaucgggcgcccccguuccacguggcagagccgagggguuacgaucucggcgggagacgggagggcgggaggcuggguuggcgacgcgggggagccaaggugggugcggggaccauggggacggccccucgcgccgcgaacccccgcacgucccggagacuagcaggugggcgggcucggccccuucuucccguuccgcgcuccccgcggacagggcggccgcuggccccgccgucgcccgggagacugcucggccagccgcccgcuccccucagcgcccgccgccgccgcccgggccuaccuugcuggugagguccagcucuggcucgccguugagcgccucgccguccucgcugcaguccgagucaaagccgccguggagucgggcggcggccgccgcggcccuggccgcccccggggagcugggcucgggggcgaacauagaggccgggaccggcgaguccaucgcggagcgacugcgcuccgucgccaucuuuaauaacuuaggcuaauucguagccggcuucccucccucccaggcucauuugacuaaucuaugcacagagccccgccccgcuccuuaucggaauaauuuaugcaaaacuccagccgcguacugggugacacguaccucuagcuaagaaacagucgacuaggccucucagccaccaaucccugcagagcuuucaaguaccuaaugaauaauuaaugaggcccaaaucccaacaacaaaugucugagacgucacgcgcccugcucccagcuugggagggggcaguaccgaguccccgcuacccgccugaagccuucccgccaacggaagcagagaagugucugacugacacagcagccauccaaugaggagagaaauacaaacaacguuacucgucaacgccccuucacucuccuuguuuccagaggcgguacuaagccugcaaaucuuacugcaaaacaguaggcgcuguaagccuuccgaugacggacaagggcaggacccaaucgagucauagaacaggucccgcgccuggaccugcucauggagauaguaaacugcaaaaugagccucccacucgauucagugacugaggcaguugcuggaacgccgauguccaacgugcuggcaugcuccaggcaacuuuaauaguaggaucgaugcuguaaguuccaagaguuguaauacuauagcagccagagugaggcaauaauuaaaugcugaccuuagggagaauucuccauucacugccuuugcggaggcaaucacacgaacuaaaaacagaggcaagcagcuaaaauuaaaagccaaaaaacaccucaccacuuuuguggugaacugcuaaaccgaaaucuagggucucauaagguaguuuccuauggauuauuuuuccagugucaucaguugugaaaagccccaacccaaaaugccaucaacacacguuuuagugucuugaauuccuguuucaaaagccggaaaagccuaggccgucauuguuuggcgaaauuagggauuaaccaacgucuaugaaugucggccuuggccacucgaaccaggcaucaagcaaacaagagcauguuugagaagauaaggaauccaagacuuaggguuuggaccuaaacccuaaaucuuuagugagcaaguggcaggauugaaaauggcuuucaguuuuggggaucuaccugagaagaaagagacagucucuucuugucccuguuuuccacuacuaucaagucuuauuugcacaaacacagcugggaaucuuggacaggaagucaucugauuccaauggucuugauacuguucuuaugugcuuuuuaauuucuuccuugccaaauugcucaccuccauccuauaugggccgggagcaauggcucacacuuguaaucccagcacuuugggaggcugagacggguagaucaccugagguuaguaguuugagaccagccuggccaacauggugaaacgcugucucuaccaaaaauuagcugggcgugguggcaugugccuguaaucccagcuacucuggaggcugaggcaggagaagcccuugaacccggggggggggggggggggcggagguugcagugagccaagaucacaccacugcacucaagcuugggcaacagagcgagacucccacucacaaaaaaacaaaaaaacaaaaaaacaaaaaaaaaaaacaacgaaguacuggaggccugaacucauaacuggcuucuaaaggaggggcacaguuuugugggacugagcccuuaaucagugggaucugacaguaucuccagguagacagugugagacgaauugaauugaacuagaggacauccagcuggcguccccugcagcacugauggguugcugguggggauaaauccacacauuuuggugaccagagguguuguguuguauugagaguagaacauuuuaaaaaacagauuuuggcuuuuccuuuauggcccagauugauagcaucucaccaacuggcucuuccaaagaguucaagucggccggaugcgguggcucacgccuguaaucccagcauuuugggaggcuaaggugggcagaucaccugaggucgggaguucgagaccagccugaccaacauggagaaaccccgucucuacuacaaauacaaaacuagcugggugugguggugcaugccuguaaucccaacuacucaggaggcugaggcacaagaaucgcucgaacucgggaggcagagguuacagugagccaagaucgagucauugcacuccagccggggcaacaagagcgaaaccccaucucaaaaaaaaaaaaaaaaaaaaaaaagaguucaaguccagaaugugcugacagcuaauagcgaacuaaaaaaauacccuuugcacuauagccuuuacccagaaaagaacucucagagcagguacuuuugaauugaacagggaacucuaucaugacauuu

SEQ ID NO: 17871 - RNA, 21286 nt, Homo sapiens
cacauacagagucggccacacgcgcgccgcccggccccacucgcgcagcgcgggccuccgccggccgcauuguccgcccgcccgccuugucccgcgucgccgcucuucgcgugcccgcgcgccccgggcccggccgcugugucgcccugagcggagcgccgcccgcgggauccccacgcggaaagggggcgcgccccggcggcggccuggccucggacgcccccggccgggcuagaagccgccgcggcagcaggugagugcgggcgagcucaggagaggguuggggggccgcggcccggccugaccccgggucaccgucgggccacucgggcggggccgcgccgccaggccugcuuccuccucuccgggacgugcugggccggauccagccuccacccggguccgcggcccgcgcccugacucaccuccuggcccccgccccgccugccgcgccacuggucagccgggagggcggugucugcgggcgggacuucccgggcagccucccgggaggaggagggcaaaggccgacugccccaacccggccccgggcagcgccuacggguuuugugccagacaggccguuuccagggacaggcaguucccagccucugccugucagaacucagggccucagaggaaggcccguuuuguucaguucuaaaacaaaacaaaacaaagcaauggggggcgcggugugacuuagagagccaggaggcgcgccuuuggugacaauuucugcagguuuggccugugggaaugagggcagagggaguuagcaccgggcguuuggcaggucccacaagggcguguggccuggcugugcccagggaguggaaaugucacgaggaagaugccccagaucugguuuaagucugaagauggauggagauguuugugauggggaagggcggaauugagaaaggaagucgcccagcugagaaguggggaaggaugcuuuccgaugagcguuuccuaacugauuguuagggaggagguggggcggggguggugucuauuaugauucgcaguaguagauuucagcucccagaggcucacuucuuguuuuggagaauggggccucgaccuuuuucaucuugugaaacccagacucaaugguaaacuguuuugugaugccaggaugccgcaggaaagacugagaggcaucucugggaguucugggagggcggaggcgggugcugacaguuuucagcacuccccgcucaaccuccaucagaauauuuaguucuucccagcggcagcuuggguaugguauaaacauguugccuuguuucugcccugggcaaaggugucaccuccuucagcaggacagaggcuaagaggagucccugugugggcagcuggagccuucagguagggaccguacgggcggggcagggaggggggaggggagauuaccuuauaaggacaggaauagagacaaggacccaggccaacuuccugcuuuuccuacuaccaaucggucccuuuuccaacaccagcuaaaaguagaggggaugccagaugggcgucugaccugggaagaugccaacaaggccaggacaugaggcugcuuguuuuucagaggaggacuuucuagcuggacuaaccagaccuucggguuucugcagccuggguugggaaguggacuucuauacucaccacacaacccagagaacuggucauuuaaguaucaaccaggaauauuagaagugaucaaaagucacaagcaagugcuaggaauucccaagugacuuuguuguacgggccagcagaggcacuaacguugagacuccccauguuggcagucggggacuuugaauucgggugucuagaccugagugguucauuaaucuuccucaugucacagaaugcuaccucuugccagaucuuugcacuuuggcuuccuuuguccucauuaucaguuccagagccuugauuucugccccacauggugaccggaacugacuguaauucaugcugcccuccuccucccuauuuuguuaguuugcuaacaaauauuuguuguguaacaaguuuguauacagccuuguuuugcgcaugugugaggcuaaaaaagauucuagcugaggacacacaacuagaaucuucaauacauuccugaaacaacuggaaaacuuuaugccugaguagaaagacccaggcccuacagccugucagagcugagcccaaacccuggcuuuggcacuuacaggcuggggacuguggacaaguuacccauugccucaguguccagguucuucccuuguagaugggaguaaugauaccuaccuugcuucuaauaauauaaaugagguauacaaggagcccggucccagcagacacuuaccauuuuaucaucaucuuaccaagauguggcagcacagugugcaccguggggacagacagugcaagcgccaucaggacguaggugggagccuggccaacuuggugaaacccugucucuauuauuaaaagaaaagaaaagaaaaauccuuuuggcugagcgugguggcucaugccuguaaucccagcacuuugggaagccgagguggacagaucaccugaggucaggaguucgagaccagccuggccaacauggcgaaaccccgucucuauuaaaaauacaaaaauuagccagucccgguggcgcacaccuguaaucccagcuacuugggaggcugaggcaggagaaucgcaugaaccugggagguagagguugcagugagccaagauugcaccacugcacuucagccugggaggcagcgcgagacuccaucucaaaaaaaaaaaaaaaaaaaaaaagaacauagguggggucuacaugggaaagguuuuccaucaagguucguuggggcccucgaugaacgagcacaugucagcaaagggacacagcuagagcgagacugggagaagucucuagggagaaggcaggugggguggcuggaccaccgggcgugcaggcagugaccagaagcaccagagucucugcuacuugucagaggucgaggaagacccaauucuggcuugugcggagcucagcaccaugaaggauaaagacaaggaaacugagaauugggaagccuguggaaagcgcccuggaagaggcuccagagucacgaagugagccccaggccgggcgugacuccagccgcugcacagugcaggggugcuucacagaucccugccuugccccccaucagggcuguuuagacugaacgccgggggccgggggccggggggguggucuguucucggcugugaggcgaugccucugucccaccuccucuagagaggagcuggggacagccccaggccucacauccaguccuccuccucucucuccuuagauucucuucaggggaagaguccacaucccaccucaucaugucccgaagaagccagcgccucacgcgcuacucccagggugacgaugacggcagcagcagcagcggagggagcucgguggcugggagucagagcacccuguuuaaagacaguccucucagguagggacccaagggagugccacggccccugacagccccacaagcuuuuggucacugcccgcacgcccugugguccagccaucccccugccuucuuguugcaaccuuggguggaaaucgaaggacgugggcccccguccggucgaggggguccuuccuugcuccauguguaugagcacacagcacccauucuucucccaccgacugugagccggggcugcugcccucaugcuuagaaaacaggaagugguaggucgggcgcgguggcucacgccuguaaugccagcucuuugggaggccaagggagguggaucaccugacccugaccaacauagugaaacuccgucucuacuaaaaauacaaaaauuagcccggcaugguggcaggcagcuguaaucccagcuacucaggaggcugaggcaggagaaucgcuugaaccuggcaggcagagguugcagugagcgagaucauggcauugcacuccagccuggguugacaagagugaaacuccaucucaaucucaaaaagaaaaaaaggaaagaaagaaaacaggaaguggagagaggcagcuucaaccauaagccaggccggaaaccccaaaacugcaggcugggcucacaggaacccccccugcucuggacgggcgugucagccuuaccauccuuccuggccccacgccugcaugucucaccaccuguccggccucagcagcuggccagcgacauggcugagaacaggcgcaguccucaggccacugggaaaugggcuguggcagcagcugccuggucguccugcccggcucacaggcauggggcccagaagacaggcccugaggcuuuggcuagcucugaggccaggucaggucugucugguuucaguggguuguaaaguuugaauguggcuccaucccuagcugccgcugcccgucuugcccaucugcuggugagauucagagagaacaggagaggacgugccagcauugggagagucaggggaauggcagcugcgaguugccuagcaacaagggaacccacacccugcacuaggcagggccgcaggcuguggcuuuccuucaugcuccuggcugggcucaccucccugcucccuaccucugcccucaugguugucccacaggaccuugaagaggaaauccagcaacaugaagcgccuguccccagcgccacagcugggcccguccucugaugcacacaccuccuacuacagugagucgcugguccacgaguccugguucccacccaggagcucccuggaggaacugcauggugacgccaacuggggugaguguggagcccuccgucccggggcuuugcuuccucggccucccgcgagauacuccucacaguguccccugcaguccccgggauucccuccucagagcaccucucugcccagaccccacuuuucagaagcucuuggaggcccagaagagccccugguucuucccugcacaggugaggaccugcgggugcggaggaggagaggcacggguggcucagagagcagcagggccagcgggcuuguggggcgcaaggccaccgaggacuuccugggcucuuccucgggcuacuccucugaggacgacuacguggguaggcgaugcuuccucccuccugagcagauccgaggcugcugggaggccucaggaaggcugggcagggagccccggggagcuggagagagggcagcauguggcaggcacagcgccccucccaugcccggcccugggugcgccccagccuggccugcgguggccccuggugcccugggcugugacugcccuucacuugucuguccuccccaccccacgagucuauggcaaccuaaggccaacauccuugcauucaggcccauuccagcacuuuccuguggggcucacacauggugggugcucagucauucugaguggugugcaugucagaccccagcaccuaguucugaacagcagcuugagggguggcuggugaggagagggaugcaaacaggaagcugucagaagaaacagaaugucaaagagcucccauuucauuccuuacugcacaccgggccuguguggggcuguggggaugugaaggagggugggugacuuguggucuuggcucacagaagacagugaaggaagaggcucgaaagugacagagacugagccaguguccucguuccccgcaggcuacucggauguggaccagcagaguuccagcucgcggcuccgaagcgccgucucacgggcgggcuccuuacucuggaugguggccacuucgccaggugggcugcaacccgugcccaguuacuuccauucuuggugauagugcuuucuuacccaucucucugcaguugggcauccugcccaugcagagagacuguaggaccauuggggaaaggucauucuagaauaaucacugggagcccagagcuguggggacccccuugcguggaagggaaggaguagcugcagagcaggacagagggugugggcaggugggauccaaggaccugggucccgguagggcaggacagaggcauacuggcaggugggggugggguaggggcagggaggacggcagacgggacaaaggagcggugcccccaaacaccauauggagccuucggcuugauggucauucuuccaggccggcucuucagacuucucuacuggugggcuggcaccaccugguaccgccugaccacagcugccucccuccuugacgucuucguuuuaaccaggugagcgagacuccacccuugccaauaaaucgcaaggcccuggggugaagggacggguaaagugugucaaccuguaauggucgauucucugaggguuuuccccaguuucccuggagccuuuauuagcgaucacggaguagcuuccccaaagcccaccccugccugacagaggauggacucagagucagguucuucuccccgaauugauagcccuucgaggcaggauuccagagcacagauuauuucuucuuggacacauucuacuaaacgccacacuagucuagccgugccuggcucucagacacacgauggcuuuccuccugcaggguaggcccacugacuccaggcaagaagugggguuucccagaaaguccaucuuccuucuugggccugggacaaucuaaccccccgaguuccccacucauggucagagccacaaagaggcucugccugaggaugcuauggguucauuccccaagucccuaaaccagcagaaccaggauuugagaaugugccccuuaggcagaagaacacggaacccagaagucaggaucccucuggccguaauccagguccgggcagaggggacagcuggccauacugaaacaaggggcaaggauggguuugugucaccaaaaacagguuccuuguuguuauuuaaggaguuacuuuuuuuuucuauauuugcauacuuagaggaccuguccauauaaaaauuuuugaguuuuucaaagaccacacuauuuuuaauaacaucaguaaaauucagucaaaauugucccaucacucuaagaccugcccagcaggaaaggcucugacguguccaggcuggcccuggcacagugagaagcucaagcuauccuccuuagcucuaguucagcacccaggaaaacaucucaggguacucccuggguggaacguggaggccuggagcuccccucacaccuccgccucccccguccugcccucccgcgugguccaggcgcuucucgucccugaagacguuccucugguuccugcugccgcugcucuugcugacgugccugacguauggugagccugcauggggagagcagagggaggcacagagauguguucaccagaggguggugaccuuuggcaggcagggaaggggcaagacuggguggggugugccugugacugggcagggccugagcccuggacccuggaucaucucugcauggcccuccccaccucuccugagccucuuuugugccgcccugggcaggagcacacccuagugccgcaacauugggugaaaagcgggaugcccucccauuaucauuagcagucauccuccuuccacuccaacagggacaucugcuaugagggaguuauuuuuacaagaugaaguuaaaucuugagcugucuuuaaaguaaaaacaaugaagcagcaaagggaaauaagugccuuuuuuguuuguuuuuugagacagaguuuuugcucuuguugcccaggcuggagugcaauggcgcgaugucagcucaccacaaccuccaccucucagguucaagugauucuccugccucagccucccgaguagcugggauuacaggcaugcgccaacaugcccagcuaauuuuguauuuuuacuagagaugggguuucuccauguugucaggcuggucucgaacuccugaccucaggugauccagcugccucggccucccaaagugcugggauuacaggcaugagccaccgugcccggccauaagugccucuuuuuacaccagucacuuaccagcuguccugaaucaucccaggcgcuagcacaggccugccuugguuuuuuguuuguuuugagacaaagucuucuucugucaccccagcugaagugcaguggcacgaacacagcucacugcagccuugaccuucugagcucaggugauccucccacgucagccucccaaguagcugggauuacaggcaugcagcaccacacauggcuaauuuuuguauuuuuaguagagacgggguuucaccauguuggccaggcuggucucaaacuccugaccucaagugauccacccaccucggccucccaaagugucgggauuacaggugugagccacugcacccagcccuuccuuguuuauauagacauuuuguguucagcuuuuuacuugacagcuuggcuaguuucauaugaauugccuaugugacucucagcucaauuuuaaugacugcaccaaguaauuaaagaccaugcuuuauuauuuuuugagaguuuguuuuauaagcuuaauaucauucaacuuguauuucuuuuauuaauaacaggguagaacacuuuuccaaaaguuagcuucguuuuuguguuugcugcuacaagaacagcugguucauauccaguggcaacugagcaccacccuuaaaauaauaaugauucuucuucuuuuuuuuuuuuuuuuugagacggaguuuugcucuguugcccaggcucgagugcuguggcacaaucuuggcucacugcaaccuccaccucccggguucaagcgauucuccugccucagccucccgaguagcugggauuacaggugcaugccaccacgcccagcuaauuuuuauauuuuuaguagagacgggguuucgccauguuggccagucuggucucaaacuccugaccucaagugauccaccugccucggccucccgaagugcuggcauuacaggugugagccaccacgcccagucagugauucuuuuuugugugugugugauggagucugucgcccaggcuggagugcagucgugcgaucuugacucacugcaagcuccaccucccagguucacgccauucuccugccucagccucccgaguagcugggacuacaggcggccgccaccacgccuggcuaauuucuuuuuguauuuuuaguagagauggggugucaccauauuagccaggauggucucgaucuccugaccucgugauccacccgccucggccucccaaagugcugggauuacaggcgugagccaccgcgcccggcccagucagugauucuuuauaauugcauagcaauguacccagagagcacuuucccgugcauuaucucaguucaauuugagcuucaccauggccuugugggguugcuguagucagugcugugaacccaucacauggagaugcacguggagggggcucagugaccugcucggggagugugugcaugaaggccauguccaugcuggacuucaagccccaugggcaugagcuuccuuuugcaccugccaaccucuggugcuugaguagcgaauggagcuuuaucaggacagaaagcccucccucccccgcuccccugccaccugccccagagcucaggaguaaacagguaucaaacagauggcccugaaaacagaaugaacaugucucuguguggcugcagcuuggugcucgugucugggccucgagcagccucucuuagaggggguggugcuuucuguugcagugacucucagccauggcggcccaugacagucaccaggaagcuuuacaaacucaccuacgcaggggccccaccccaggccaauuagcuugcucuccagagggcagggccagaccugguuguacuaaaaucuccccaggugauucugacgaccagacagggcugagaaccaccaucagguccucugggcuguacccuggaucaucccuaacucauucaaaauguuuucuccaaguuuugccacuuacagaaagaugaaggauucccgugggggugugagaaugaauaugcucugagguuguuggguggaaguugccaccucagagaaugggggcaccugcaucccucugaugccucuggaagggcacagcuccacgagugggacaggccacaagcacuggcagggaucagguagccauccucccuggcgcgcgccucuugcuggaggcccagcugggguaacacccucuccccugugcacaggugcuugguauuucuaccccuaugggcugcagacauuccacccugcuuugguuuccuggugggcagcgaaggacagcaggaggccggaugagggcugggaagccagagacucaucgccacauuuccaggugagucucugagggugguagcucccaagagcuuagcaauaauuaggugacggugaaaguggugggugcgcccucagccugccucacaccguacacacaaagcugaggcguacuguuaguugccaucuuacaaggcacagaaaacagaaagaaaaggaauccaacaaauuaucuugucugcuuuguuccuuuucaaugcuguuucacaaauauuuacugggcaccuucuaugacuaggauaauaucccagucaguuaccucuuaccaaagauaauccaccccuaaaagcaguggcucaaaacuacaaugguugauuaguucaugagucuguggguugucuggguggucuuucuggucugagaaaagagaagcaaucuuggcugggcucguacuugccuguguggaucugucugucugcaguuggcugggggggucagcugggggccagcuggucaaggcccuugccuaggacagcuguacuccaugugcacuuugcucacccggcaggcuagccccagcuguuucucaucgcacccaggcaggguuucaagagagaaccaaggcaaccagaccuuugaggccuugauccagaaccagcacaccgucacucccgccacauucuguuggcuaccgcaaaucucagagccaaauccagauucaaggagagggaaauagacuucaccucucagcaagagagcccacaaggucacaugacagaggugcggcugcagggaggagugagggaugguggccauuuuuauaaucugccagagucuaaagaugaaucaggcccaggcugugcccucaaggagccugcagucagcauaaccagaaagcaaugugagcacagguacugauacugacaauuuaaaccucuaagccaagccugguggcucacaucuguaaucucggcacuuugggaggccaaggugggaggaucacuuaaggccaggaguucgagacuagccuaggcaacacagugaggcccugucuuuauuuuuaauaaaacucuucauuuucuaauuaugguuauuugaccugcacuugcaucucacugaauuuaacuugguauuacauuuuuauuauucauuuaaaaauuuuuugagacagggucucauucuguuguccaggcugcagugcaguaguauaaucauaacucauuguaaccuugaacuccugggcucaagcgauccuccugcaucagccugugaaguagcugggacuacagguguacaccaccaugucugucaaauuuuuaaaaaaaauuuuuguagagacagggucucacuauguugccaggcuggucuugaacuccuggcuucaagcaauccuccugccucagccuuccaaagggcugggauuacaggcaugagucacugcaccuggcauaguaucacuuuuuuuuuuuuuuuuuuuuuuuuugagacagagucuugcuaagucacccaugcuggaaugcugcgucacccaggcuggagugcaguggcacgaucugggcucacugcagccuacaccucccggguucaagcgauucucccgccucagcgucccgaguagcugggacuacaggcgcgcaccaccaugccagcuaauuuuuuuauuuuuaguagagacaggguuucaccauguuggccaggauggucucugucuccugaccucaugauccgcccgccuuggccucccaaagugcugggauuacaggcgugagccaccacgcccagccggcaucacauguuuaaccaucuauuuuuguauauauuacuuuccagaccauggucuuuccaauuuuauuauaugugcugccaaagugaguaccagaccaugaucuuauuauuuuacaaaauaaugacaugucaucuaugacuuuuccuuuuuucaccauuaaagacauuaaauacaguucaauuucagaaccaucuuuuuuguaaaaaaggguaaguuaaaaaaaugaauauaucuuguauuagcaacauuugcaugaaguuaaaauaaaaacagcuuccuggucugggagaggcuguuggugaggcaacuggggugauggggcagaggauuuuuugcugguuuuugugggcuuuuuuuuuuuuuuuuuuuuugagacggagucuugcucuuguugcccagacuaaagugcaauggcacgaucuuagcucacugcaaccucugccucccagguucaagcgauucuccugccucagccuccuguguagcugggacuacaggagccugccaccaucuccagcuaauuuuuguauauuuaguagacacaggguuucgccauacuggccaggcuggucucgaacuucugaccucagguaauccaccugcgucggccucccaaaguguugggauuacaggcgugagccaccacgucccgccuguuugugugcuuuuugagucaugcaaauguagcgccuauuuaaaaaccagaauuucuaaaacucagaaccucugcugcucaguagcucccuggccuuuauuugacaguuuuuaucacuucucuuggcaaugauuuuguuguuaagccaacaacauucucaaauucaugacacacuaucaaaugccacccucaguccaaaugacauuuauuccauuuucucugugggacauccagcuaaagaggaaaaagaacguauuuucaaauuauucugucucuuagccauaguuaccuagggaaggagugaaagccauugagaguccacagacagaacucgcagcccuggcuccccugccccuguaggaggcggggaaggagugagcuucaggccaggaggguccacggcccccugcagccauccugcagcuuccaguccuccuccuggaccaucccugcacucagaccuucuccccggcccaccuuccuuccuccucugggaucagacuucgguacuguguccucagggaccuuccucuguggccggcacccagugaucccuggcucccagcacacccagcucagaggucggcagccccugcccacgagcuccagccggcccugcauggccuuaugcuggaacgucucuggaaucuuuucccuuucuuucuguguuggcugugucgggguggucuuugggaagcacuaucauccaagggucccucacuccguggcucucucucugcccuuccaggcugagcagcguguuaugucccggguacacucucuggagcggcgucuggaagcucuugcugcugaauuuuccuccaacuggcagaaggaggccaugcggcuggaacgucuggagcugcggcaaggggcuccuggccagggagguggugguggccugagccacgaggacacccuggcgcugcuggaggggcuagugagccgccgugaagcugcccugaaggaggauuuccgcagggaaacugcugcucgcauccagguaggagguggaauaccucagggugggaggugggugacacccauaggaaagcgugaaggugcccagcagcagagagaacaagugucauuugggaucagacagcucugccauuuugcaguuacucccuuucucuuuuuuucuuuuuuuuuuuucuuuuugagacaauaucucacucugucacccagccuggagugcaguggcgugaucucgacucacuacaaccugugccucccagguucaagcgauucucuugccucacucagccucccgaguagcuggauuacaggcgugcaccaccacauccagcuaauuuuguauuuuuaguagagacaggguuuuaccaaguuggccaggcuggucucgaacuccugaccucuagugaucugccugccuuggccucccaaaguccugggauuacaggcgugagccaccacgccaggccuccucaccuucucuaagccucaguuuccugcucuuugauggaggccaucgugucucccccacccccauagugagcugugcgaguagaaagccccagcaugguaccugacaccgcagaggugugcaguggagcugaagcgggagucuugcgugguucagagaaggcugagagccagggcucuggaagcaaacagaccuuguuugaauuccaguuccgccacuuccuagucaugagggucccuauaagcauggcucuguccaaccuguccucucacucccgucucacaggaagaacugucugcccugagagcagagcaucagcaagacucagaagaccucuucaagaagaucguccgggccucccaggucagcgggcuugcggcacucagggccugugacuggguccugaccccauccaacauguucaccucggaccccucggcccuuccaaagggacuguuuggguguugcauggggaggggagugcccuccucugacuucucuguuugacccccgaccccuuaguuggagagcugugcaggggcucccuggggugugccagggcacagcggccugucaugcuggugugcaugugcugagugugggugaacagauaccucagugugucagacauggacgagacucaugagggcuuugacaaggaggccaguuugauuuuugcugcaggggucaagagaccuugggcaggggugugguuaagcaaagacgcuaacagacagcagauccuacucuggaacaccaauuucugagaugaguauuucuuguauuugucccuucuuccuacacaggaguccgaggcucgcauccagcagcugaagucagaguggcaaagguacugggcgccaccagcuggccucggccugcuccuccccagccccacccacucuccaggcaggacuggggagcagagccgcagagcagagaguucugaucaucuugccaagcagaugguagggggagggguugaaacccagcucaggaccccugcccagggccugucuuugaggugccauggagguuagcagggggguccugagggcggggggcaggcugugugagaggaccgggauucauuuauagacacagcauccuuucuuacagccucacauaacugccuucucaugccccagauguccaugcuuguggaggaugugagaggcugaggcagaguacauucuggacucugggcuuagaaagggagcaggcucagaauuagcuccuugggacaggcagggguucugcagccagaacccccaggagaggccuugccccuucucagguucacaaugagugcugggcacccgcucuccugacgggagcccacuaggggguccucuuucaucuuugguguggccuuaccucccaccaaagagauccgaggcuuacucuucucucucugggaccagcaugacccaggaguccuuccaggagagcucugugaaggagcugaggcggcuggaggaccagcuggccggccugcagcaggagcuggcggcucuggcacugaagcagagcucgguggcggaagaagugggccugcugccccagcagauccaggccgugcgggacgacgugagugggaaccaccagggcccugcuggucccucuccuccuccuuugagacgacguguccuggggccugcaaagcagcaccccuugccccugcagccucuguuaugcccaagagacuguggcguuggccuugacacaugugggcucucacugacaggcguucuuccuguuuuuguuagugcccauggaguguucauaacucuuuccuccaguggccucccuccuacccuaucccugcuauccagcuaagcacuagcccugucauagcagcuccugcugucccugcaagccccccagggugacaccccuuuggguuccuauagguggaaucucaguucccggccuggaucagucaguuccuugcccgagguggagggggccgcguggggcuccuucagagagaggagaugcaagcucagcugcgagagcuggagagcaagauccucacccauguggcagagaugcagggcaagucggccagggaagccgcggccucccugagccugacgcugcagaaagaaggugugauuggagugacagaggaggugaggcccacaugccccucuccacacacccacccacagcucuccucccugggagcccuggacagucccacacugccagcucccuggcagguuccaggauggaagugccaagcaggaggcuuugcaugcuguggggcuggcauggguggguggcagugugcccacaucugccugggcaccagcacagugcaagccuagaaggggucagcccauggguccuuggcccacggccacgaggugacagggggacacgucugcucccugcugcaaccgucuccuggugccugcauugcagcaggugcaccacaucgugaagcaggcccugcagcgcuacagugaggaccgcaucgggcuggcagacuacgcccuggagucaggagguacgugcucugcuuuccucgcucugccuuguccuggaccccgcaauggccgguccccuggcaucuaccagguuggugguggggcagagcaagcaaagcucaggaucagcagaaaucacccaaccuaguacccaugacaaaggcaaguggcaauucagggaagucaggacguaccgaguaccauccugggccagggagaggcugaccuuuaaagcugcucugagcaucucgguuaggguuaaaggcuaggccuggggcaucugccguccaccuucagcgaggagacagccaauggccugagcggggcccuccucccgugcgggagcccacccugccuuccucuccugucucaggggccagcgucaucagcacccgauguucugagaccuacgagaccaagacggcccuccucagccucuucggcaucccccugugguaccacucccagucaccccgagucauccuccaggugggcaccuggcaagcacagcagcgggggcucugagcacacugagggcuggucccaucuggggucagcaagagcuggacucagggcccuguccugacaugacuuucugcuccuccagccagaugugcacccaggcaacugcugggccuuccaggggccacaaggcuucgccgugguccgccucucugcccgcauccgccccacagccguuaccuuagagcaugugcccaaggccuugucacccaacagcacuaucuccagugcccccaaggacuucgccaucuuugugaguaucuguccugugguggggccagaggggcugcagggggauccugugggccucucuacugaggaucaagucagggucacccuuggacuggaagggaggggaguggauuuggaagaggaggagcuagggugggagacagcacuucagucccuguuaccuuaggcuuuggaggcagaaacuguggcacaagagagugaagugacuugucauaggccacucuggugccugaccugcugggugggaggagcagggauuggaguggggagggguguucucccugcuccagccccuccccacuucccuccgcucucuuugcagggguuugacgaagaccugcagcaggaggggacacuccuuggcaaguucacuuacgaucaggacggcgagccuauucagacguuucacuuucagguacgggaugcugcugugcuagcagaaguggcgcagacuccccauccaggcagcaggugcucccugggcacuuacccugccaggcaugggguucagagagggaagcccugcucuccuuucccacagcucaagaugugauauccaaaugggguguaacacgcauccugcagacgucagcacaggggaaggcaccuuccagaagggcagcaugagggaagcuuccuggaaaaggacaccaggaggugggcuuuacacaagagggguuggguggccaggaaaggaaggccgggagaggcguucgaggagccgccgccagcacaugccagggcgcgggcauucuaccauggccagcuggagccucaggcagugcaugcggcuuaaacuucagugggcauccgaucuccuaagucaguuagaaaugcagauucccagucuccaccccaggagagucugguuccuuagggcugacaggacccaggagccugcauuugaacaaaccauuggccuaagccccacaccgggggaguccuggagugaggaauuggguuggcgggauagugggagguggacgagggacaguggcaggaagaggaggccacagagaggcaggaaauaagcccucagggaccugggggaggcagugcugugcuucaggugacaaagcuauguccauuugacuaacaucacuauaugacucgaaggggcgagccugggccugggagacccgucaggaagugguugagggaaagcagccagaacaggauaggugggggagaggggcguugggagugaggacaaagacguagcagggagggucgugaauguccaguuggauggggugggaggaagaagccacugcgaugggggcugauguggagcagggggcaggucuggcugagucugaggcaccuauggaacaguccaguggagcugucgggggagccagaaagaacugaguugucaucagcucugaggagguaacuaggcugcaagagagguugggauuucucuuuaggaaaguauagaggccagacgagguggcucaugucuguaauuccagcacuuugcaaggccaaggcgaggggauugcuugagcccaggaguucaagaccaggcuggugaacacagcgagaucccgacucuacaaaaaauguuaaaaaauuuagccggguguggugacaugcaccuguggucccagcuacuggggaggcuaaggugggaggaucccuugagcccagaagguugaggcagugaacugugaucacaccauuguacuccagccugggugacagagcaagacccugucuccaaaaacaaaaaaagaggguagaggacagaacgaugugccagagagaagggacaagccaggagugugcuaggccuguggcaucugcccagguaagauaugcugcuaacaccauucccaacacuguggcuagacagaggcccgaugggcacuggagaaaaagaaucaagugugccccacaucagcaucuaugaagcccucuaugaaggugguucuaucuguugaucacaauaaaaaaacgauuguggaugaauucauuccgguuucagaugaagugugcuacagguggccccuuaacccacuggcuggaaacacugcucaggaggcuaaagauaggagcuuuugaagccugguucucuucagagccccagggaaggagcaggggagccaucuggcccuaggcgaggcugucuccccuucccaccuucucugucagugaggccucacaggucucugaugcucuuaaucccuuucuucucuacccaggccccuacgauggccacguaccaggugguggagcugcggauccugacuaacuggggccaccccgaguacaccugcaucuaccgcuucagagugcauggggagcccgcccacuagcccugcuuacuggugccugcugccagccaucugggagugggugaacagcaccccgccgcuucccccacacgcuugcucggcgcucugacuucuaggagcacaagagaggagccuguggccccaugcagaugaaaaggacgggcagggucuccugagcagcagguggcucgaggcgguuagcaggcuccagcagcucccuucuuccuucccucugugcccguggcgucugcuucccauccugggaguguguauauauguagcauaucaugggggacugggaaguugggagagguaggaccugacuggucuuggcuggggucaggggcuggugccugggagcugaugaagcaggugccagggcugugggaggggcaagcuacggccugggcuaggugagcugccucugccccugggcaaggaagcgaggcccucugggaggagggugcuuagcuccagagcaggaugggacuuccccaggcaggaagcacuugauggagagcugcccagcucuccuacaagguuagugcccuccaccuagggaagcaugaaccacagggucccugagggccuucgacaaaaguguguauuugucccggggaggguagcagugggccauggggcuucuugugcccuaaaggggacuggcugcugugaucuucuaaggggcccagggccaacccuguaggcuuccccucugcuggggacgguaguugcuuuucucucuccugaugcuagguuggggcccacccugcucccuguuccugcuagggccugccagugccccugagcuugcuuuccacauucucccaggguauggagaccuagaccugucuuuggggccauuagcaucugggguuauagcaagaagaguggggagcauggaacuccugggcucuuguggggacguucaggguaucggggugcgaggucugucugcaccggcccccacaucuaaccaggcccugauguaggggucguccgcucaggcugcccccuugggcucuugcagcucuuguucagguagucgcccuucugguuuguucucuguggggcaguuggugggggcugggggaagaggcuggcagaaguuacccuggauagggaagggggaggaggggacuuuuagagccagcaggccccacuguauuauguauauauuuuucaaggucuguuuuucuaacugaaaagcuaagggcuugauuccuagccccguucuguggggcacugggugauacucaguuucuuguuccuggccguggagaggggccuggggcacugguuccggcugugucugguggucuggcugcggggaaggggcaagaaggcgggcaggccuucacugcagcacugagccucaaauccgcucuggagcaugaggcuggaugcagugguggugaggccgccccgcuccaucccgaggcagccaggguuuguuuugcgcucuccugucacaaaugcugcacuauugguucuuaaguuuuuuaucuccagauccuaauuuaugccuaugcaaaaaauaaaugacgcccaagagcug

SEQ ID NO: 17872 - RNA, 2783 nt, Homo sapiens
ccggcucacagucggugggagaagaaugggugcugugugcucauacacauggagcaaggaaggacccccucgaccggacgggggcccacguccuucgauuuccacccaagguugcaacaagaaggcagggggauggcuggaccacagggcgugcgggcagugaccaaaagcuuguggggcugucaggggccguggcacucccuugggucccuaccugagaggacugucuuuaaacagggugcucugacucccagccaccgagcucccuccgcugcugcugcugccgucaucgucacccugggaguagcgcgugaggcgcuggcuucuucgggacaugaugaggugggauguggacucuuccccugaagagaaucuaaggagagagaggaggaggacuggaugugaggccuggggcuguccccagcuccucucuagaggaggugggacagaggcaucgccucacagccgagaacagaccacccccccggcccccggcccccggcguucagucuaaacagcccugauggggggcaaggcagggaucugugaagcaccccugcacugugcagcggcuggagucacgcccggccuggggcucacuucgugacucuggagccucuuccagggcgcuuuccacaggcuucccaauucucaguuuccuugucuuuauccuucauggugcugagcuccgcacaagccagaauugggucuuccucgaccucugacaaguagcagagacucuggugcuucuggucacugccugcacgcccggugguccagccaccccaccugccuucucccuagagacuucucccagucucgcucuagcugugucccuuugcugacaugugcucguucaucgagggccccaacgaaccuugauggaaaaccuuucccauguagaccccaccuauguucuuuuuuuuuuuuuuuuuuuuuuugagauggagucucgcgcugccucccaggcugaagugcaguggugcaaucuuggcucacugcaaccucuaccucccagguucaugcgauucuccugccucagccucccaaguagcugggauuacaggugugcgccaccgggacuggcuaauuuuuguauuuuuaauagagacgggguuucgccauguuggccaggcuggucucgaacuccugaccucaggugaucuguccaccucggcuucccaaagugcugggauuacaggcaugagccaccacgcucagccaaaaggauuuuucuuuucuuuucuuuuaauaauagagacaggguuucaccaaguuggccaggcucccaccuacguccugauggcgcuugcacugucuguccccacggugcacacugugcugccacaucuugguaagaugaugauaaaaugguaagugucugcugggaccgggcuccuuguauaccucauuuauauuauuagaagcaagguagguaucauuacucccaucuacaagggaagaaccuggacacugaggcaauggguaacuuguccacaguccccagccuguaagugccaaagccaggguuugggcucagcucugacaggcuguagggccugggucuuucuacucaggcauaaaguuuuccaguuguuucaggaauguauugaagauucuaguuguguguccucagcuagaaucuuuuuuagccucacacaugcgcaaaacaaggcuguauacaaacuuguuacacaacaaauauuuguuagcaaacuaacaaaauagggaggaggagggcagcaugaauuacagucaguuccggucaccauguggggcagaaaucaaggcucuggaacugauaaugaggacaaaggaagccaaagugcaaagaucuggcaagagguagcauucugugacaugaggaagauuaaugaaccacucaggucuagacacccgaauucaaaguccccgacugccaacauggggagucucaacguuagugccucugcuggcccguacaacaaagucacuugggaauuccuagcacuugcuugugacuuuugaucacuucuaauauuccugguugauacuuaaaugaccaguucucuggguuguguggugaguauagaaguccacuucccaacccaggcugcagaaacccgaaggucugguuaguccagcuagaaaguccuccucugaaaaacaagcagccucauguccuggccuuguuggcaucuucccaggucagacgcccaucuggcauccccucuacuuuuagcugguguuggaaaagggaccgauugguaguaggaaaagcaggaaguuggccuggguccuugucucuauuccuguccuuauaagguaaucuccccuccccccucccugccccgcccguacggucccuaccugaaggcuccagcugcccacacagggacuccucuuagccucuguccugcugaaggaggugacaccuuugcccagggcagaaacaaggcaacauguuuauaccauacccaagcugccgcugggaagaacuaaauauucugauggagguugagcggggagugcugaaaacugucagcacccgccuccgcccucccagaacucccagagaugccucucagucuuuccugcggcauccuggcaucacaaaacaguuuaccauugagucuggguuucacaagaugaaaaaggucgaggccccauucuccaaaacaagaagugagccucugggagcugaaaucuacuacugcgaaucauaauagacaccacccccgccccaccuccucccuaacaaucaguuaggaaacgcucaucggaaagcauccuuccccacuucu

SEQ ID NO: 17873 - RNA, 20276 nt, Homo sapiens
augaggucaguuuuuggucauuuuaauuguaaaaaccaagacauuuauauaaauaagaccgcuguguaaaauacgauucacccuucuacuaaaacccuuuucccacacucgaaaagaacauagaaaacccagcagagagcaguacaaaucagcaugcggucccugaugcgaagucgcgggcaggccaggguucccugcggaagcagccucguggugagagcacuccugcccaggugucccaccagaggcucggugaccccucgagaaacugccagguagcagcucccacacaccagccccuggcucucaacuguacgggucgaggaggggacgggaaaggcugcuugguccccaccaaggcugggggcugggggggcugcuggcccagugagaugcaguggucuguucagccuggggucaaguugggggaagggguuucugaggggucagcaccuccccagaggacaaggagagaagcugccugugucccuugaaagaaucaucuccuucuuggggccauuuucauaugaccacuaaugacaaggacggccgacacuucccggcaguacuggggauggcagggcaguggggcucccaggaugcaaggggaaggcagcccuggagaaagggggacuggcguguuccugugcggaagaucucaucucccaccuccucuacccugucacaccgccccaccccacgucucccacacagacccaugcccgcugccccguccacacccugagacuccgagggagacgguugagagccuggggauggagaugucaaguucacacacugggcguggcucaggaaacugguacacaaagacaaaaagaaaagaccccaacucuccuuggaaaaaccaggaccugccuagggcugcuccccaccccagaugaguggcaggaaaaggcccugcaggggacggggcaggggacagagugucaggagcacuuccagacgcacacagccagggugcccccgaaguacagguagaggagguucuucaccucgugggugaucucaaacccaaagcccucgccgaucaccacgugccaggaggagccgaacuucuuguccauugucucuuugaucaucuuggcggcgcucuggaaggaagagggcacuuaucaagggggcgcagggcaggugggggcaggagucagguccuucuccaggaaggagaaggcuggcacugaggucuuggcaagagaaaggccugcuguccuauuucucuuguccuccugcuucaaaaaggguuuccacgcaggccaccuccugccaggucuauuacacaggcacagaaaacuagacauuacucagcagucaagaagaaacuggcugaggcgggaaggcaagcaucaggucuggagauagccuggggcugcguccuggcucugcacuuagugcgggcuuccugggccagugccaccucccucagauguaaccuggacaagcggggcaccaggcagucucaggaccaacuggauggagagaccuggcacccugcagacugcgagguaccugaugcguucagugggcucuggggaggcgccgacuacuccccuagucauggccacagucgacuucuuccugugccugcucuuucaagacgugcccccugugugaggaggucuagaggggcagggacccccgcucggcagggcgaguccaggugcaggcgccugagguacaccaacagcgccucccaccaugccaggugccaugcugggcacucuguccccaucgucucaguaaauacauccucacaacuggcccagugaggaggcaccaucgccacccuccauuuaaggacuaggaaacugcgcucagaguugagaaauggcucauucaaggguacagcugggaagggcugaagccaggaucugaaccugggccuggccgacccaaagccugggcucccacuggccagugucuugccuccccaccggcugccgcaacacugacuucucgcucuccccaccagauugaugaauggccuuccugcguugaugccugcuggccguauccccaacaccuagaacagcgccuguucaacaccuuuuugaauggaugagugaauacaugaauggaugccugggcaggccucuguucaccacugggauggaaccacggggaaaggcacccuauucagcagcccaccugaggcagggaacaugggcaggggcgucauggagaccccuguggcuuugcuccucuagggcugggugugaccgucagugccuggagucagcgccagccucucacucacugacuuuccccagacugaaugcuuccaaggaaggcucuggccucauccuagcaguacugucuggagccaacugcagggaacaggggccacuuuauucacccacaggggccaucaaaagcacgaggggccgccugcacugcuggcaauaccucguuguuguuggagaauuucucacaggcugugacacauagcuccauggucuccacgcgcaucuccucuggcauguccgagugcuagagacagggcagggguaacaaacaagagacaggcuuagcccgugaccuggccuuccuggcuggccucucugucccaagcuuaaggcauggacagcagguagccucccuggcccagcccugggcaggugacccaucuccugacugagggccugcagcuggggcaaaggcauggcauggagcugagccucgugggcucucaagcccaggcucucugcaagggcacgaagccagcaccagguuccagccaacagacaugggaagaaagccggcugagggcggagggaaugcuggcuauggaaguguguuccgacggaaucucaccccggaggcccgaagaggccgcugggcgcucucuggggccccugguuuuccuccggccuuucccucugcuccuucuccaucgaucugcuggauuuccuuccuccucccagcuccuggagggcccugggccccaccuccacucucccaucuccagcgacuccaucucuggggucuuguguguuccgcgccugucuguguccucucugugggagggcucccacacuucuacccccagcucuaaccucuucuuugggcuccugacuacucugucaaacuggccacuugacagccucacuuagaugucuaaaaauaacuugauucccacaaacccaucuucuuccaucuccuuuuccugguaauugauaccauuuuuucucccaauacucaggaaaagacagacuguagcagccacccuggacucucuugcucccauacccagucuccaauuuggcagcagguccuuuggccucugcacucacggaacacccuaaacccgaccgcaucucgcacucuacuccgugagccgcacccagccacccucaucgcucugggccuccacagcggccuccucgcuggucuccccacuucugcucugguaucuccaaauccauucugcucacaacagcuggagugagcuuuugaaaaccaaacagaucucaucacuccccugcuuaaaacccuucaguguucccccuucgauucaggacagaacccacaguucucaccacauucuucacuguggcuggccaggccuguagggucuggccccacuggugcuguuauguccugccacccuucucagcacuccauuccagccaugcuggccuucucucugugccuccaaaaugccaaguucauucccaucccaggcuucccgugccucuguuuccccggcuuggcauguucuuccccaggucuuugugagguuugcucucugucuucaggucucugaucugcaaaaccucuccagaagcuaaccucugcucuccagcuccuuccaccugcuucauuuuucauuauaguacuuacugccuacgaucauguucuuaaaacauguauuucaugugggccaggccuucgccugucucguuuaccauccccacagugccuagaacagugcccggcauagaguagguggcccaauacuuggugaaugaaugaaugaaugaaacaaugaaucacugucaacuccaagaugucuaggucugagccagcagagcccuucuuaacuuccucccacugccauccugcaagggacaagcuccacccaccucucuccaggcugugugggcccugccggcaguccugccucccuccccuggggcuuacccugaccagagggaaggucugcagucgcuuauaaucagccucaucuuucuucccuucuguuucucccaugauccuuccacugugaccacuggaggagaguggggcuuucaggaggugcugggacuggcaguuaagacacacccaggagauucaggaagcaggcccugccaacucggugggagcagaaaaugucuuuccccggggggugcugcagaaaacaggagaaaccagaaaaaaagagcuggcuucaaaaccauacaucgcaaauuagaaaugucucaguaacaaucugacaccuccccaucuuaacuccuccgcacccuuuuccaaauggccagcaagucugcagacggcaggaugagucaacacgagaugcugggaccugguuaagaacacacugguacgaugccgcaagcccacacugucauuaucaagacaaauacugacugugggccaggccugcaggauggaggcuugagcuggcagugagcaaaugcaguuuccccgcguacccacuacauacacgguccuucccucccacuacacacaugggccuucccucccacuacacacacgggccuucccucccacuacacacacgggccuucccucccacuacauacacgggccuucccucccacuacacacacgggccuucccucccacuacacacgcgggccuucccucccacuacauacgcgggccuucccucccacugcauacacgggccuucccucccacuacacacacgggccuucccuccugcuacacacaugggccuuccuucccagaagcugugcuuaggaagggaaauguucaggucaccacugacagucugggcuuauuggcaagcaagggggccccucugcaggcccugaucuucaggggaaugggcacggugcugcucugugcccucccuggcacaccaggcucccugguuguucuuuccuacuccuucuuggaccacuggguccuguccugcuggcccagcagcugggaggcuugggugcugcugcugguucagucagucaccagcaguauggcccugggccccagacuccucaccaguaauguggguacagucacauccaucucaugcggccguuaugagaauucaaagaaacagugccuguaaagcuaagacagugccaagcacacggcaggcacucaguacauggcuguucccuaaccgacggggcuucuacuaaagagacgggccuggacccgagaugacuggcagcacuccugccaauccaggcauuucucuuucaucuucaacccaauuuaucucauaauucaaaguuuuuuuuuuuuuuaaucucagaaguacugacauaagcggauacaaaucaccagguuguuaagcccuuuuuaaugauuuauauuagacaacuacagcaaaauaauguuauuccagcauuucucacauuuccaaauaaauuuccuuucacugcacagucauggaacccaaaggugccgagcacgguaacuaacaggcaggugaugacacgugacggcugucgguuuccugccugucgguguuucacaugcauuuacacaccuugucaucgcaacaaccccgggaguucgguucuguagggacagaggcaugaggcuggucagucgcuggccugaggucacucagcucguuagcgacacagcuaaggugugaauccaggcccggcugucggcaugggcacuccugaccccuuguucauacgccuccucaugggcacacaggaggcacucacaagcauacaucagcugcccacugggacagcuccuaucauccuagaagggagacgaaucaaauauuugcucuuccccuuugcugucucuuucacuuuuuuuuuuuuuuuuuuucuugagacggagucucacucugucgcccaggcuggagugcaguggcacgaugucagcucacugcaagcuccgcuucccagguucaugccauucucccgccucagccucccaaguagcugggacuacaggcgcccaccaccacgcccggcuaauuuuuuucuguauuuuuaguagagaugggguuucaccguguuagccaggauggucucgaucuccugaccucgugauccgcccaccucagccuccgaaagugcugggauuacaggcgugagcuaccgcgcccagccugcuggcucuuuuucuaauguuaacuugacccugguuuggcccagccuugagcuuucugggcacucuuucugggcugugcucuugauuugauccccgcuccaaugacucggugccacuccauuuggucggcucccucgcaugaggcuggaagccuggcacagacccccccccccauccaaugacauugguauuuucugauuucccaguggacagauggcuccacuuaucucaucaauucugggcauuuguaccacucagauguuagcaguuuuuguuugucucucucuacaagcuggugaauuaccaagcacaauuucauuguacuuucuggucagguuccuuauuucacaaaauucagggaaucauuuugucuuugcucaugaaugugaaggcguauuuccaauuccaggcuguccuccuagccuuacugcuuccuccucuaccuuuguccaggugugacagagguggcggcuacacugaugacagaaggaaaagggcacacaguuuguuuaucucugagaauuucaagggggaacaaugaaaaauguggaagcagcuucuuaggcaucuuccacugagauguuuccauuugauucaauucaucccggaggcuaaaaagugcuggcauguaggagccaggagggaaccaggagccaguuguggacaugccacccuccaggaggucagggucugugacagcugcucuaacaugcagaauccugcugagaugucccaugacuucagagguaugaccaaggcccauuucucaggaacaacggggaaaagccagugggagagugaccugugcagcaucuugcagagcuaagaacugugugggccgcaagccggagugugcaggcauggagaccagcucugucaaagacgagcauucugcucacuuccuuucuuugcagccgucagcaaguaauuucaccuaagccuugguuuccuucucuaugaaacgggauacuaaauccuaucucugcguucucaggaagcuguugcaagccccagguauguguaugugagcgauuugaaacguuaaagcucucugcgcuguuaucacagugcucucugcuaccagcguuaaucagccaggacuuggucaccaugauucagccaaguuuacuaagggcccugacuacaaagagcuuuuucuaaccacuacacauacuucuggggaccuaaaagagaugagacagaauaaaaaggaaucguuauagaugauguguuuccaaauacagaaaggcaggagaauuuuuuaugacgcuguaucauuauaguacagcuagagucauucagccacaguccuaaaacucuccucaaagaauguuaccaaaaauagcagaaccagagguucuaacaaccuuaucaaucuuccaugcagagaagcaugugccugaacucuuggagccagaaagagucaugucaggucuaaaagagccuuuuaauaauauaauuguggcugggugcaguggcucacgccuguaaucccagcacuuugggaggccgagguggguggaucacuugaggucagaaguucgagaccagccuggccaacaggguaaaacccugucucuacuaaaaauauaaaaauuagccggauguggugguacaugccuguaaucccagcuacuggggaggcugaggcaggagaauggcuugaacccgggagacagagauugcggugagccaagaucacaccauugcacuccagccugggcgaagaagugagacucagucucaaaacaaaacaaaacaaaacaaaacaaaaacaaaacugugcccaccgccaggguacuugaaucuccuggguacagaagcucgacuccagcccaucuggcccacaguggugcaaagccaggggcagccuuauucccucucccacuaccccugcucuccuccucacucaagggccaucugugggcuuuacauauccucacccccucugaugugaggcucuuccuaagcaacagugggcacagacaagggcccuuuaucucauugccuggucaaggccaguguuccugguccugcuaucccuuguucuuuuguggcacugaccucagucaccauucacuauucugugucugaagcgucugggaagaauccuaaagaggguuagggugugugggagggacugggaaaaaugaaugcguucugggaaauaaggcccaaaauaucugccagcccccugggaggggggcagccauucaaugucuggaacauccgcggcccuuagaucacggcucgccucccuguaccacccaccaugcaccugagagauugcaggacacaccuggagcaugucauggugguucugaguacagacuccaccgucggaucugaauucacaucuugguucuguuuuagacaagggcuuaccucccuaagccucaguuuucuuuucuuuucuuucuuucuuucuuucuuuuuuuuuuuuuugagacagcguuuugcucuuguugcacaggcuggaguguagugacgcgaucucggcucacugcaaccuccgccucccggguucaagcaauucuucugacucagccucccaaguagcugggauuacagguacgcgccaccacgccuggcuaauuuuuguauuuuuaguagagaugggguuucaccauguuggccaggcuggucucgaacuccugaccucaggugauccaccugccucagccucccaaagcgcuaggauuacaggcgugggccacugcaccuggcagccucaguuuucucaucuggaaauuggggcuaaggacucagcuccuguuacuggugcaguaggaaggaaacugcgauauccuucuucauagaccaaccugcuacacaucuaaacgugcagccaaacaaaccacuaucucccaaguucccacuaugugcaaaccacugugguaguaaugaaggaggaaagagucacaaggaaauucugugaaaccucuuggggcugaggugguagugguguggcuauggugugccuucacauccaccaucucauuucauccuccuaacaccugugagggaaggauccagcucccuauucucagacaagucacuggagcucagagagguuuuauggguggccugagggugcacagccggcaaugguagaaccaggaucggaaccccaauccauccuucugacucgaccuucugugcuuucuccuuuggcacaagcaaguaggagacaagccaguaacacagaugacuucgauacucagcauccacccauccagccucuguccaggccugccucuugcuucccgccacauuggggacacaggcgggcacuccagucuuccuuggccuucuagcgaacaaaugaagaacaaagcugacaggggaggaaaaaggauccuaaggacuugggcauucguccaagacgcucguaguaaggucaggaaaugaugcagaagccaggcucccagaccaguuuaaagugugggcagacgcagggcugccauuuuaaaauucugcugcaaaagggccuuagaagauacaucaucuacuacaaaagaggaaaauuuggcagaauaaagaucagcccuccucaagaaaagucaaacacacgaaguuguuuuuacgugguccuuauuuuuucucauuuugcugcgguccaaugaaaacuuaaugugccugggacugagggaggaguggagggaaggagaggagggagggagagaagagaggccugcugucuggaucugcaauucucaacauuuccucauguccgacaccaugugauaagugacauugacucacacaugcacccucaaggacuuagccagacuuggaugaaaucccagacaguuuugucaagauacaaaguauaaggaaagucacaaccaucacagcuauuagcucccggagaacagcugcucgccacacacagcagggcaggcucccgccccgcucucucccacucaagagaacagauuugaaucuaagggaguaagagugacauuaucacagaaauaaauuggacuuagcauggauuuauuuuuuagaaacucauucacaauugcuaauuaccagugacaucucacaaccgaucacgacuuaacugugcccgugaguccagauucccuggggcugaggaacuugauuuggcucuagaugccccagagcacaaaggccagugucuggcacacggcagaagcccagaaauuauccaaauugcaauuaacuuauauuucauuugccccaugggaggggagaggaccuaucacauccauucaagacuauuuauugaacacugauccugagccaggcaccagaaugggcgaucuacauacaggaugucccucccccagucacucugucagacagguacuacuagcccuacguuacugguauagccacacagccugaaaaaaagagaguuuccaccuaguuaauaaacaaaggggcuaggauuugauugcagguauauaugacuucaaagauuaugcuuuuucuuuucuuuucgagacagggucucacucuguugcccaggcuggagugcgguggcaugaucacagcuuaccgcagccucaacuucccaggcucagaugauccuccugaguagcucaugcuaccacacucagugguggcacacuacaggcuugugccaccauacucggcuaauuuuuuuauuuuuuggagagacgggguuuugccauguugcccaggcuggucucaaacaccugagcucaagcaauuugcccaccucagccucccaaagugcugggauuauaagcgugagucaccaugccuggccugauuaugcuuuuucaacuacucgacuauaaucaucagacagucccugccuuuaaggagcuuacaaucuaauauggagaccaacaggcauacacaaggaacuaacuaugguuccuggcagccuggcagaaaguagugccacaagacaggcauacuugcaguggugaggagggugagauaagacagcaaaaggagcuugcuggcaggggcagcauuugagucaggccuggaaaggugaggaagaauugcaacagguggacgaggugaggaagaccuuccaggcggaugaacacaacagugccaaggcagaaaguacaaagcaucuucugggaaagucuaacaguccgauuuggcuagaagauagaauuuggcaaagaagggagaaauaaaucuggggaaaaagacugggguugggcuguggacguguagauggguccugaaaccuaugcuuacauauuuuuguagacauggggucucuauguugcccaggcuggucuugaacuccuggacucaagugaugcucccacuucagccucucaaaaguguugggauuacaagugugagccaccaugccuggcaagauguguggaucuuuuucauagugaaugggaagcccuuuggaggucucuagguggcuggugacaugggugggcuggguugacaggagcagagaccggagguaggagcagucgcuaggaagcugcaguaaugguccagggguauuaaugucacaggcaugaaauacuugaaggagagugguggcuucaggaauggagacgaugugagcucugcaugcagcagaaucaaaacaaccugacaacugcccaaauggaaugagcaugguggagugaggaaugaugcccaggaggauggugaugccacugauggggagaggggaaaccagguggcacagcuggguagagaagcaggucaguuucauuucagagcugcaaaguuuaaguugcugguaagauacgcagauggagguaucuagucaggagaaagaaaucaccaagucaugggcuaucggggcaggagggaagccaucaaguccaacuaucgcaucaacacagucaugcguugcuuaaugacaggggcauguucugagaaucguuaggcgauuuuguugugugaaugucauagaguguacuuacacaaaccuagaugauguagccuacuacagaccuaggcuauaugguacggccuauuucuccaaggcuacaaacuuguauagcauguuacuguacuaaauacuguaggcaacuguaaugcaaugguguuuguguaucuaaacauagaaaaaguacaguuggccgggugcgguggcucacgcuuguaaucccagcacuuugggaggcugagguagguggaucacuugaagucaggaguucgagaccagccuggccaacauggcaaaaccucgucucuacuaaaaauacaaaaauuagcugguguuguggcgcgcgccuguaaucccagcuacucaggaggcugaagcaggagaaucucuugaaccugggaggcggagguugcagugagcagaaaucacaccacugcacuccagccugggcagcagagcgagucuccaccucuagaaaaaaaaaaaaaaggacaguaaaaauaugcuauaaaagauaaaaaaucauacaccuauauaggucacuucccaugaaugaagcguacaggacaggaaguugcucugggagaaucagugaaugaguggugaaggcccaggacauuacuggacaccacuauaacuuuauuuuacuuuuuaauuuuuauuuuauuuuauuuuuugagaugaaucuugcucuuguuccccaggcuggagugcaaagccgugaucucggcucacugcaaccuccgccgccuggguucaagcgauucuccugccucagccuccugaguagcugggauuacaggcacgugccaccaagccgggcuuauuuuuguauuuuuauauuuuguauuuuuaguauuuuguauuuuguauuuuuaguagagaugggguuucuccauguugaucaggcuggucucaaacuccugaccucaggugaucugcccgccucagccucccaaagugcugggauuacaggugugagccacugcgcccagccuauuuauuuuuauuuuuuagauggagucucacucuguugcccaggcuggagugcaguagugugaucucagcucaaugcaacauccaccauccggguucaaaugauucuucugccucagccucccaaguagcugggauuacaggcgccugccaccaugccuggcuaauuuuuguguguuguuuuuuuuuuuuugaguacagaugggguuucaccauguugggcaggcuggucuccaucgccugaccucaagugaucccucugccuuggccucccaaagugcuggcauuacaggugugagccaccaugccuggccacuacuguaacuuuauuuauaaacaccguaaaaaauuuacguaaauuuaggcugcacuaaauuuauagaaaauauuuuucuuucuuccauaauaaguuaaccuuagcuuacuguaacuuuuuacuuuguaaaaguuuugauuuuguuaacuuuuugacucuuucguaguaacacuuagcuuaaaacacaaacacauuguacagcuauacaaaaauauuuucuuucuuuauaucuuuauucuauaagcuuuuuucuacuuauaaauuuucuauuucuuuuuuacuuuuuuuuuuuugagacaaaguuuuacucuuguugcccaggcuugagcgcaauggcgcuaucucggcgcacugaaaccuccaccucccggguucacgccauucuccugucucagccuccugaguagcugggauuacaggugcccgcuaccacgucuggcuaauuuuuuguauuuuuaguagggacagguuuuaccauguuggccaggcuagucucaaacucuugaccucaggugaucugccugugucggccucccgaagugcugggauuaauaggcgugagccaccgcuccuggccuuuauuuuuuauuuuuaacauuuuuaacuuuuuuguuaaaacucagacacagauacacuagccuaagccuacacagggucaggaugcuuagugucacuaucuuccacuaccacaucuugucccgcuggacggucuucagggcaauaacacgcauggagcugucaucuccuaugauaacaaagccuuuugcuugaauaccuccugaaggaccuaucuaagacuguuuacgguuaaauuuuauuuucuuauaaguaggaggaguguacacuguaaaauaacaauaaaaguguaggauaguaaacacauaaacaaguaacagucauuuauuaccauuaucaaguaugauguccuguacacaauuguaugugcuauauuuuauaugacuggcagcacuguagguuugcuuacaccagcaucaccacacacgugagucaugcauuuugcuuugacauuacgauagcuauguaacuaggugauagaaauuugucagcuccauuauaaccuuagggcaccaccgugguaucuguggucuuucuugaccaaaacguuguuauaugguacaugacuguauuucaaucuccaucuguccccuccccaccccuaaguaacccuaaccauggaagcccaggaggaagaucagagagggucaacuggagaaaugacaguucaugcugaccggguugauaacauuucccagagagggaaaauguggugaagagacaaaggaaagaaacuaacaaauacugaaucuauacuggacuggacucuguacuucauauuagccucagaauuaccaaaggagaugcaccgacguauacugauuuuacauaugcacugauuaaaagcgcagggaggguaggucuugagacugggaauccaaauuagguuugccaaguuauuuucacaauacacgauaccucccauuggggagcacauccucucggaagccuaaaguugggucaaagaacaacgacauccuagaacgucagaguggaagaggccuuagagaucacucaacucaacuucucauuuacagauggggaaacugaggcccaaacaggggaaaugaccagcccagaaucccaguaagucgccaacucuccaagccaagagcggucugaccuaguugauggcgaccccgcgggagagggaauuacuccgcgaaaggucgagggaucaaggugcugggggaagucggcuaaagggggacgcgggaccacgaagcugggcaggccuuggguggguggggaagagcagccggcagagucgcgauggcaaaccugucacgacagagcucgcaggucccgaagugggggugaggguggggguugaggaugggaagaccuggggcaggggaacagcaggcaggagaccgagguggggccucggcggcgggcgaggccucuuccgcccugcguugccucccgcccucccuccgggccggcccuccccgccuggcugcccgccgcgccccggggccucaccugcuccugcgggggccggagccggggccgcagccagcgaacccccgccaggguugucaaggagcgaaacaagagugucuuagcaaccagcaaggaaguccugcccccucaccggacguugacgagaauuucacuuauuauugguggauaaaaguaucaaucagagugaaaggcccuuauaagucaggcguuugcaaggacaggggcgugguuuagaggccagggaggcgggacuucacuuauaguugucuuaagcgugcccgaggagcaggggacacauugaaguucuuuuucuagggaaacaaacuucgaaaagcaguacugccuugggagguucuuuuagucacuugaaauaacaaaugcaacuuguuggugucgugacacuuagccacuacuuuauugggaucugaaaagccugauaauaacuagcauuuuuguagggcuguacaauuaauaucucacuugauucucauuacaguacuuuuaggugauaauauucgucaucccaucugaacuaaaguucagagagguuaaguaacuugguaaaggauggagguaaucucccuggagaaggaacccaggggcuccuuccucugugccacacccuuguauggucaccuagcucuagucacuaggagacauuuguaccaccuaauuucagacacaguugcccagagccugccuuuucuuccccuugggagggaaaauuaauccgaaaguacggagaaggaaaaggggaaaggggaagaacuggcggauucuauuauuugauugguagaucaaagggucaguuggguacuucguaguuuaaaccuuuauuauugugaugaguacuuggggugaaaccccacugccacauuuacuagcauugaagcugucuuugccaaaauuauaacugaggaaauuaugacagugaaagagaucagaccuaacccacuccaucuugccuuucuagccuuuaagcugucuuuguucauuccuaggcauaggcugaacgaaccuugggaaggaauuuaguuuauaguuuuacucugaaacaaaauugacaauagcccuuucccaaaaaggcucccuuccugccuugggaccagucugccuuuguaggacuaacaaauuagcuacaacauuagaaauuaugguuuaggggucacacagcagccucuggcugcaagagucugaaccuucccaaauugcuccuggggauaacaucacuauuguaaaaccuaagaucagcgcuugagauauuuugcagacccugcgcucgauggaucagcugacaccacccagaccaguaauguggcucaaacaguucugugaucccacccaggaacagaagacagcaagaaaaccucacuucgacccccucaguauuccaucuucgacuuaaucaaucaacacuccucgcuugccaagccccuacccacaaaauuaucuuuaaaaccucugaucccugaaugcuuggguagcauauucaacugccuccuagccaugugcaccagaauguuccacaagcccuucaaacucagugugucccaaacugaauugaucaucucccuccaaucugcucuuccugcauuccccauuccaguaaauggcaccacccccgacccaguugccuccaucagaaaacaggggggaguccuucacccuucccacuacaacagcccacuuccagucacaagcaugccaauuucgacuccucacuauuuccugauacagccuuucuggccacguucauggcacccuccaugugcacaacaccacaaucccaucuaccugagugcaaucuccuggugggacucccuggcugcagucuugcaccucucuaauuuauccucuguaccauagucaacaugacccugccaaaacccaaaucucaccgcugcauuccucuguuugaguaauuugaguaauaauaaaacuccccucucccgcacagcuggcucuguuugaauuaccuuucuccauugcaaucccccugucuugauacaucggcucugucuaggcagugggcaaggugaacccauugggcaguuacagcaucuacugggagcucagcccucgucaggugcuagugauucagagaggaguaagaugaggaccuugaucccauggaaggcacaguccagugaacagacagccaugugaacaaauagauauagaauaauucauucuaccaaugcuaugguagaggugugggcaagauucuggcucuuuccaaggagggaguaacuaacucucagagugugguacuugaguuggccgaguccaggaugaccccggggggcuaauugagggugggacagcaugcuucacuggggaacuguggguggcuucguaaggucuggguggagggcgaauguagguguaggugggaggugauaggggugaagaugcuaagggaaguagggaaguagugagaaggguuuugaaugccaaguucagggacuugagugcucccugggaugagguaagaauaggcacgguagcuguuggaggguuucaagauguggucacauuuguguuguggaaagaucacucugguggugaagacggugaauuggauuucgaguggguagacaggaggcaggcacaguggguuugguucugagaguuggcagcuugaagggugcuagguccuugcugguucuuaagaugccucccuggugcguucugaugguccguggaaugucugacucagccuccagauuuccuuaauccucuuugccaacuuucucuaggagacggaagguagccuuugagggggaggaugcucuugccuacgucuuucauccaaauuucucccaaaagggguccacaguugcugucuucucuuucucaccucccauucacucuucagcccacugcaaucuggcuuccacucccacgacaccacugaaauuuccuccuccaugguuaccaaugaccuccugaagagcggaauccaauagacccuucagucuuuaacuuacuggacccagccccacuucuggcgugagccuguugaccaugcccaucuaaaugaacuucuguaccccauugguggcaccuggagaacucuuuaccauauagauucuagggcccuacugcuccaggauggugaaaggcaggaauguguauuucucaucagcacccauggugcacaguagagaaucacuucucuaucccaacacccagggaaccucacucuccugcauguccucaaaccucuccuccuuuucggccuccuucuuggacucuucuuucuuuuucuuuuucuuuuuuuuuuuuuuuuuuuuugagauggagucucgcucugucacccaggcuggagugcaggggcacaaucucgcaaucucgguucacugaaagcucugccuccugggcucaugccauucuccugucucagccuccuguagcugggacuacaggcgcccgccaccaugcccagcuaauuuuuuuuuuuuuuuguauuuuuaguagagacggaguuucaccguguuagccaggauggucucaaucuccugaccucaugauccgccugccucggccucccaaagugcugggauuacaggcaugagucaccgaaccuagccuuggacuuuucauucuuugcucucugugccuaucuugacccccuuuucuucucacuaaugcucucaaaauucuuuguaccugaggucaccuccucaucaguaacaguguuccccugagucacauucccugggguauuuacuggaauugaggguaggguaugcacuuuuggaaaagccucccuggugauccugaacacugucccagggagcuaugccacccuaugcauaucuuguugaggauugcuaccuuagguacuuuccccugggggucuccuccacucccaagguuuccauugucaauguccuucuaaauucugaugccuccuguauuucuuuuucuauauuagaccucucucuggagcucuggacccaaauauucaacugccuccuggccacguccaccagaaugcuccacaaguccuucaaacucagugugucccaaacugaauugaucaucucccuccaaucugcucuuccugcauuccccaucucaguaaauggugcuacccccuaccccccaccaguugccuccaucagaaaccagggagucguccuucacacuucccacuaccaucguccacuuccagucaaucaaaagcaugccaauuuugacuccuaacuguuuccugauacagccuuucuggucauguucaugguauccuccaugugcaccacaccacagucccaucuccaugagugcaacaaucuccuagugggacucccuggcugcagucuugccccucucuaauuuauccucuguaccacagucaacaugacccugccaaaacccaaaucucaccgccgcauuccuccguccgauaacuucuucucuccuuccauggcuucccauugccuaagggugacauucaccugcccuguccuggcauuuaagccuccccauggcguggccccgggcucccccaucuucuucuugcugcuccauccccugugcuuuacgccuccacuacaccaacucucauggcucuccacacacgccaagcuguuuuucaccucccugccuuuguucacaaauucucucugcccacauccucccugugcuccucccucccuccuuuugguucuaugagcccauaagguuuuggccuaagcuuguauacuuugggaucucaucucu

SEQ ID NO: 17874 - RNA, 20276 nt, Homo sapiens
agagaugagaucccaaaguauacaagcuuaggccaaaaccuuaugggcucauagaaccaaaaggagggagggaggagcacagggaggaugugggcagagagaauuugugaacaaaggcagggaggugaaaaacagcuuggcguguguggagagccaugagaguugguguaguggaggcguaaagcacaggggauggagcagcaagaagaagaugggggagcccggggccacgccauggggaggcuuaaaugccaggacagggcaggugaaugucacccuuaggcaaugggaagccauggaaggagagaagaaguuaucggacggaggaaugcggcggugagauuuggguuuuggcagggucauguugacugugguacagaggauaaauuagagaggggcaagacugcagccagggagucccacuaggagauuguugcacucauggagaugggacugugguguggugcacauggaggauaccaugaacaugaccagaaaggcuguaucaggaaacaguuaggagucaaaauuggcaugcuuuugauugacuggaaguggacgaugguagugggaagugugaaggacgacucccugguuucugauggaggcaacuggugggggguaggggguagcaccauuuacugagauggggaaugcaggaagagcagauuggagggagaugaucaauucaguuugggacacacugaguuugaaggacuuguggagcauucugguggacguggccaggaggcaguugaauauuuggguccagagcuccagagagaggucuaauauagaaaaagaaauacaggaggcaucagaauuuagaaggacauugacaauggaaaccuugggaguggaggagacccccaggggaaaguaccuaagguagcaauccucaacaagauaugcauaggguggcauagcucccugggacaguguucaggaucaccagggaggcuuuuccaaaagugcauacccuacccucaauuccaguaaauaccccagggaaugugacucaggggaacacuguuacugaugaggaggugaccucagguacaaagaauuuugagagcauuagugagaagaaaagggggucaagauaggcacagagagcaaagaaugaaaaguccaaggcuagguucggugacucaugccuguaaucccagcacuuugggaggccgaggcaggcggaucaugaggucaggagauugagaccauccuggcuaacacggugaaacuccgucucuacuaaaaauacaaaaaaaaaaaaaaauuagcugggcaugguggcgggcgccuguagucccagcuacaggaggcugagacaggagaauggcaugagcccaggaggcagagcuuucagugaaccgagauugcgagauugugccccugcacuccagccugggugacagagcgagacuccaucucaaaaaaaaaaaaaaaaaaaaagaaaaagaaaaagaaagaagaguccaagaaggaggccgaaaaggaggagagguuugaggacaugcaggagagugagguucccuggguguugggauagagaagugauucucuacugugcaccaugggugcugaugagaaauacacauuccugccuuucaccauccuggagcaguagggcccuagaaucuauaugguaaagaguucuccaggugccaccaaugggguacagaaguucauuuagaugggcauggucaacaggcucacgccagaaguggggcuggguccaguaaguuaaagacugaagggucuauuggauuccgcucuucaggaggucauugguaaccauggaggaggaaauuucaguggugucgugggaguggaagccagauugcagugggcugaagagugaaugggaggugagaaagagaagacagcaacuguggaccccuuuugggagaaauuuggaugaaagacguaggcaagagcauccucccccucaaaggcuaccuuccgucuccuagagaaaguuggcaaagaggauuaaggaaaucuggaggcugagucagacauuccacggaccaucagaacgcaccagggaggcaucuuaagaaccagcaaggaccuagcacccuucaagcugccaacucucagaaccaaacccacugugccugccuccugucuacccacucgaaauccaauucaccgucuucaccaccagagugaucuuuccacaacacaaaugugaccacaucuugaaacccuccaacagcuaccgugccuauucuuaccucaucccagggagcacucaagucccugaacuuggcauucaaaacccuucucacuacuucccuacuucccuuagcaucuucaccccuaucaccucccaccuacaccuacauucgcccuccacccagaccuuacgaagccacccacaguuccccagugaagcaugcugucccacccucaauuagccccccggggucauccuggacucggccaacucaaguaccacacucugagaguuaguuacucccuccuuggaaagagccagaaucuugcccacaccucuaccauagcauugguagaaugaauuauucuauaucuauuuguucacauggcugucuguucacuggacugugccuuccaugggaucaagguccucaucuuacuccucucugaaucacuagcaccugacgagggcugagcucccaguagaugcuguaacugcccaauggguucaccuugcccacugccuagacagagccgauguaucaagacagggggauugcaauggagaaagguaauucaaacagagccagcugugcgggagaggggaguuuuauuauuacucaaauuacucaaacagaggaaugcagcggugagauuuggguuuuggcagggucauguugacuaugguacagaggauaaauuagagaggugcaagacugcagccagggagucccaccaggagauugcacucagguagaugggauugugguguugugcacauggagggugccaugaacguggccagaaaggcuguaucaggaaauagugaggagucgaaauuggcaugcuugugacuggaagugggcuguuguagugggaagggugaaggacuccccccuguuuucugauggaggcaacugggucggggguggugccauuuacuggaauggggaaugcaggaagagcagauuggagggagaugaucaauucaguuugggacacacugaguuugaagggcuuguggaacauucuggugcacauggcuaggaggcaguugaauaugcuacccaagcauucagggaucagagguuuuaaagauaauuuuguggguaggggcuuggcaagcgaggaguguugauugauuaagucgaagauggaauacugagggggucgaagugagguuuucuugcugucuucuguuccugggugggaucacagaacuguuugagccacauuacuggucuggguggugucagcugauccaucgagcgcagggucugcaaaauaucucaagcgcugaucuuagguuuuacaauagugauguuauccccaggagcaauuugggaagguucagacucuugcagccagaggcugcugugugaccccuaaaccauaauuucuaauguuguagcuaauuuguuaguccuacaaaggcagacuggucccaaggcaggaagggagccuuuuugggaaagggcuauugucaauuuuguuucagaguaaaacuauaaacuaaauuccuucccaagguucguucagccuaugccuaggaaugaacaaagacagcuuaaaggcuagaaaggcaagauggaguggguuaggucugaucucuuucacugucauaauuuccucaguuauaauuuuggcaaagacagcuucaaugcuaguaaauguggcagugggguuucaccccaaguacucaucacaauaauaaagguuuaaacuacgaaguacccaacugacccuuugaucuaccaaucaaauaauagaauccgccaguucuuccccuuuccccuuuuccuucuccguacuuucggauuaauuuucccucccaaggggaagaaaaggcaggcucugggcaacugugucugaaauuaggugguacaaaugucuccuagugacuagagcuaggugaccauacaaggguguggcacagaggaaggagccccuggguuccuucuccagggagauuaccuccauccuuuaccaaguuacuuaaccucucugaacuuuaguucagaugggaugacgaauauuaucaccuaaaaguacuguaaugagaaucaagugagauauuaauuguacagcccuacaaaaaugcuaguuauuaucaggcuuuucagaucccaauaaaguaguggcuaagugucacgacaccaacaaguugcauuuguuauuucaagugacuaaaagaaccucccaaggcaguacugcuuuucgaaguuuguuucccuagaaaaagaacuucaauguguccccugcuccucgggcacgcuuaagacaacuauaagugaagucccgccucccuggccucuaaaccacgccccuguccuugcaaacgccugacuuauaagggccuuucacucugauugauacuuuuauccaccaauaauaagugaaauucucgucaacguccggugagggggcaggacuuccuugcugguugcuaagacacucuuguuucgcuccuugacaacccuggcggggguucgcuggcugcggccccggcuccggcccccgcaggagcaggugaggccccggggcgcggcgggcagccaggcggggagggccggcccggagggagggcgggaggcaacgcagggcggaagaggccucgcccgccgccgaggccccaccucggucuccugccugcuguuccccugccccaggucuucccauccucaacccccacccucacccccacuucgggaccugcgagcucugucgugacagguuugccaucgcgacucugccggcugcucuuccccacccacccaaggccugcccagcuucguggucccgcgucccccuuuagccgacuucccccagcaccuugaucccucgaccuuucgcggaguaauucccucucccgcggggucgccaucaacuaggucagaccgcucuuggcuuggagaguuggcgacuuacugggauucugggcuggucauuuccccuguuugggccucaguuuccccaucuguaaaugagaaguugaguugagugaucucuaaggccucuuccacucugacguucuaggaugucguuguucuuugacccaacuuuaggcuuccgagaggaugugcuccccaaugggagguaucguguauugugaaaauaacuuggcaaaccuaauuuggauucccagucucaagaccuacccucccugcgcuuuuaaucagugcauauguaaaaucaguauacgucggugcaucuccuuugguaauucugaggcuaauaugaaguacagaguccaguccaguauagauucaguauuuguuaguuucuuuccuuugucucuucaccacauuuucccucucugggaaauguuaucaacccggucagcaugaacugucauuucuccaguugacccucucugaucuuccuccugggcuuccaugguuaggguuacuuagggguggggaggggacagauggagauugaaauacagucauguaccauauaacaacguuuuggucaagaaagaccacagauaccacgguggugcccuaagguuauaauggagcugacaaauuucuaucaccuaguuacauagcuaucguaaugucaaagcaaaaugcaugacucacguguguggugaugcugguguaagcaaaccuacagugcugccagucauauaaaauauagcacauacaauuguguacaggacaucauacuugauaaugguaauaaaugacuguuacuuguuuauguguuuacuauccuacacuuuuauuguuauuuuacaguguacacuccuccuacuuauaagaaaauaaaauuuaaccguaaacagucuuagauagguccuucaggagguauucaagcaaaaggcuuuguuaucauaggagaugacagcuccaugcguguuauugcccugaagaccguccagcgggacaagaugugguaguggaagauagugacacuaagcauccugacccuguguaggcuuaggcuaguguaucugugucugaguuuuaacaaaaaaguuaaaaauguuaaaaauaaaaaauaaaggccaggagcgguggcucacgccuauuaaucccagcacuucgggaggccgacacaggcagaucaccugaggucaagaguuugagacuagccuggccaacaugguaaaaccugucccuacuaaaaauacaaaaaauuagccagacgugguagcgggcaccuguaaucccagcuacucaggaggcugagacaggagaauggcgugaacccgggagguggagguuucagugcgccgagauagcgccauugcgcucaagccugggcaacaagaguaaaacuuugucucaaaaaaaaaaaaguaaaaaagaaauagaaaauuuauaaguagaaaaaagcuuauagaauaaagauauaaagaaagaaaauauuuuuguauagcuguacaauguguuuguguuuuaagcuaaguguuacuacgaaagagucaaaaaguuaacaaaaucaaaacuuuuacaaaguaaaaaguuacaguaagcuaagguuaacuuauuauggaagaaagaaaaauauuuucuauaaauuuagugcagccuaaauuuacguaaauuuuuuacgguguuuauaaauaaaguuacaguaguggccaggcaugguggcucacaccuguaaugccagcacuuugggaggccaaggcagagggaucacuugaggucaggcgauggagaccagccugcccaacauggugaaaccccaucuguacucaaaaaaaaaaaaacaacacacaaaaauuagccaggcaugguggcaggcgccuguaaucccagcuacuugggaggcugaggcagaagaaucauuugaacccggaugguggauguugcauugagcugagaucacacuacugcacuccagccugggcaacagagugagacuccaucuaaaaaauaaaaauaaauaggcugggcgcaguggcucacaccuguaaucccagcacuuugggaggcugaggcgggcagaucaccugaggucaggaguuugagaccagccugaucaacauggagaaaccccaucucuacuaaaaauacaaaauacaaaauacuaaaaauacaaaauauaaaaauacaaaaauaagcccggcuugguggcacgugccuguaaucccagcuacucaggaggcugaggcaggagaaucgcuugaacccaggcggcggagguugcagugagccgagaucacggcuuugcacuccagccuggggaacaagagcaagauucaucucaaaaaauaaaauaaaauaaaaauuaaaaaguaaaauaaaguuauagugguguccaguaauguccugggccuucaccacucauucacugauucucccagagcaacuuccuguccuguacgcuucauucaugggaagugaccuauauagguguaugauuuuuuaucuuuuauagcauauuuuuacuguccuuuuuuuuuuuuuucuagagguggagacucgcucugcugcccaggcuggagugcaguggugugauuucugcucacugcaaccuccgccucccagguucaagagauucuccugcuucagccuccugaguagcugggauuacaggcgcgcgccacaacaccagcuaauuuuuguauuuuuaguagagacgagguuuugccauguuggccaggcuggucucgaacuccugacuucaagugauccaccuaccucagccucccaaagugcugggauuacaagcgugagccaccgcacccggccaacuguacuuuuucuauguuuagauacacaaacaccauugcauuacaguugccuacaguauuuaguacaguaacaugcuauacaaguuuguagccuuggagaaauaggccguaccauauagccuaggucuguaguaggcuacaucaucuagguuuguguaaguacacucuaugacauucacacaacaaaaucgccuaacgauucucagaacaugccccugucauuaagcaacgcaugacuguguugaugcgauaguuggacuugauggcuucccuccugccccgauagcccaugacuuggugauuucuuucuccugacuagauaccuccaucugcguaucuuaccagcaacuuaaacuuugcagcucugaaaugaaacugaccugcuucucuacccagcugugccaccugguuuccccucuccccaucaguggcaucaccauccuccugggcaucauuccucacuccaccaugcucauuccauuugggcaguugucagguuguuuugauucugcugcaugcagagcucacaucgucuccauuccugaagccaccacucuccuucaaguauuucaugccugugacauuaauaccccuggaccauuacugcagcuuccuagcgacugcuccuaccuccggucucugcuccugucaacccagcccacccaugucaccagccaccuagagaccuccaaagggcuucccauucacuaugaaaaagauccacacaucuugccaggcaugguggcucacacuuguaaucccaacacuuuugagaggcugaagugggagcaucacuugaguccaggaguucaagaccagccugggcaacauagagaccccaugucuacaaaaauauguaagcauagguuucaggacccaucuacacguccacagcccaaccccagucuuuuuccccagauuuauuucucccuucuuugccaaauucuaucuucuagccaaaucggacuguuagacuuucccagaagaugcuuuguacuuucugccuuggcacuguuguguucauccgccuggaaggucuuccucaccucguccaccuguugcaauucuuccucaccuuuccaggccugacucaaaugcugccccugccagcaagcuccuuuugcugucuuaucucacccuccucaccacugcaaguaugccugucuuguggcacuacuuucugccaggcugccaggaaccauaguuaguuccuuguguaugccuguuggucuccauauuagauuguaagcuccuuaaaggcagggacugucugaugauuauagucgaguaguugaaaaagcauaaucaggccaggcauggugacucacgcuuauaaucccagcacuuugggaggcugaggugggcaaauugcuugagcucagguguuugagaccagccugggcaacauggcaaaaccccgucucuccaaaaaauaaaaaaauuagccgaguaugguggcacaagccuguagugugccaccacugagugugguagcaugagcuacucaggaggaucaucugagccugggaaguugaggcugcgguaagcugugaucaugccaccgcacuccagccugggcaacagagugagacccugucucgaaaagaaaagaaaaagcauaaucuuugaagucauauauaccugcaaucaaauccuagccccuuuguuuauuaacuagguggaaacucucuuuuuuucaggcuguguggcuauaccaguaacguagggcuaguaguaccugucugacagagugacugggggagggacauccuguauguagaucgcccauucuggugccuggcucaggaucaguguucaauaaauagucuugaauggaugugauagguccucuccccucccauggggcaaaugaaauauaaguuaauugcaauuuggauaauuucugggcuucugccgugugccagacacuggccuuugugcucuggggcaucuagagccaaaucaaguuccucagccccagggaaucuggacucacgggcacaguuaagucgugaucgguugugagaugucacugguaauuagcaauugugaaugaguuucuaaaaaauaaauccaugcuaaguccaauuuauuucugugauaaugucacucuuacucccuuagauucaaaucuguucucuugagugggagagagcggggcgggagccugcccugcuguguguggcgagcagcuguucuccgggagcuaauagcugugaugguugugacuuuccuuauacuuuguaucuugacaaaacugucugggauuucauccaagucuggcuaaguccuugagggugcaugugugagucaaugucacuuaucacauggugucggacaugaggaaauguugagaauugcagauccagacagcaggccucucuucucucccucccuccucuccuucccuccacuccucccucagucccaggcacauuaaguuuucauuggaccgcagcaaaaugagaaaaaauaaggaccacguaaaaacaacuucguguguuugacuuuucuugaggagggcugaucuuuauucugccaaauuuuccucuuuuguaguagaugauguaucuucuaaggcccuuuugcagcagaauuuuaaaauggcagcccugcgucugcccacacuuuaaacuggucugggagccuggcuucugcaucauuuccugaccuuacuacgagcgucuuggacgaaugcccaaguccuuaggauccuuuuuccuccccugucagcuuuguucuucauuuguucgcuagaaggccaaggaagacuggagugcccgccuguguccccaauguggcgggaagcaagaggcaggccuggacagaggcuggauggguggaugcugaguaucgaagucaucuguguuacuggcuugucuccuacuugcuugugccaaaggagaaagcacagaaggucgagucagaaggauggauugggguuccgauccugguucuaccauugccggcugugcacccucaggccacccauaaaaccucucugagcuccagugacuugucugagaauagggagcuggauccuucccucacagguguuaggaggaugaaaugagaugguggaugugaaggcacaccauagccacaccacuaccaccucagccccaagagguuucacagaauuuccuugugacucuuuccuccuucauuacuaccacagugguuugcacauagugggaacuugggagauagugguuuguuuggcugcacguuuagauguguagcagguuggucuaugaagaaggauaucgcaguuuccuuccuacugcaccaguaacaggagcugaguccuuagccccaauuuccagaugagaaaacugaggcugccaggugcaguggcccacgccuguaauccuagcgcuuugggaggcugaggcagguggaucaccugaggucaggaguucgagaccagccuggccaacauggugaaaccccaucucuacuaaaaauacaaaaauuagccaggcgugguggcgcguaccuguaaucccagcuacuugggaggcugagucagaagaauugcuugaacccgggaggcggagguugcagugagccgagaucgcgucacuacacuccagccugugcaacaagagcaaaacgcugucucaaaaaaaaaaaaaagaaagaaagaaagaaagaaaagaaaagaaaacugaggcuuagggagguaagcccuugucuaaaacagaaccaagaugugaauucagauccgacgguggagucuguacucagaaccaccaugacaugcuccagguguguccugcaaucucucaggugcauggugggugguacagggaggcgagccgugaucuaagggccgcggauguuccagacauugaauggcugccccccucccagggggcuggcagauauuuugggccuuauuucccagaacgcauucauuuuucccagucccucccacacacccuaacccucuuuaggauucuucccagacgcuucagacacagaauagugaauggugacugaggucagugccacaaaagaacaagggauagcaggaccaggaacacuggccuugaccaggcaaugagauaaagggcccuugucugugcccacuguugcuuaggaagagccucacaucagagggggugaggauauguaaagcccacagauggcccuugagugaggaggagagcagggguagugggagagggaauaaggcugccccuggcuuugcaccacugugggccagaugggcuggagucgagcuucuguacccaggagauucaaguacccuggcggugggcacaguuuuguuuuuguuuuguuuuguuuuguuuuguuuugagacugagucucacuucuucgcccaggcuggagugcaauggugugaucuuggcucaccgcaaucucugucucccggguucaagccauucuccugccucagccuccccaguagcugggauuacaggcauguaccaccacauccggcuaauuuuuauauuuuuaguagagacaggguuuuacccuguuggccaggcuggucucgaacuucugaccucaagugauccacccaccucggccucccaaagugcugggauuacaggcgugagccacugcacccagccacaauuauauuauuaaaaggcucuuuuagaccugacaugacucuuucuggcuccaagaguucaggcacaugcuucucugcauggaagauugauaagguuguuagaaccucugguucugcuauuuuugguaacauucuuugaggagaguuuuaggacuguggcugaaugacucuagcuguacuauaaugauacagcgucauaaaaaauucuccugccuuucuguauuuggaaacacaucaucuauaacgauuccuuuuuauucugucucaucucuuuuagguccccagaaguauguguagugguuagaaaaagcucuuuguagucagggcccuuaguaaacuuggcugaaucauggugaccaaguccuggcugauuaacgcugguagcagagagcacugugauaacagcgcagagagcuuuaacguuucaaaucgcucacauacacauaccuggggcuugcaacagcuuccugagaacgcagagauaggauuuaguaucccguuucauagagaaggaaaccaaggcuuaggugaaauuacuugcugacggcugcaaagaaaggaagugagcagaaugcucgucuuugacagagcuggucuccaugccugcacacuccggcuugcggcccacacaguucuuagcucugcaagaugcugcacaggucacucucccacuggcuuuuccccguuguuccugagaaaugggccuuggucauaccucugaagucaugggacaucucagcaggauucugcauguuagagcagcugucacagacccugaccuccuggaggguggcauguccacaacuggcuccugguucccuccuggcuccuacaugccagcacuuuuuagccuccgggaugaauugaaucaaauggaaacaucucaguggaagaugccuaagaagcugcuuccacauuuuucauuguucccccuugaaauucucagagauaaacaaacugugugcccuuuuccuucugucaucaguguagccgccaccucugucacaccuggacaaagguagaggaggaagcaguaaggcuaggaggacagccuggaauuggaaauacgccuucacauucaugagcaaagacaaaaugauucccugaauuuugugaaauaaggaaccugaccagaaaguacaaugaaauugugcuugguaauucaccagcuuguagagagagacaaacaaaaacugcuaacaucugagugguacaaaugcccagaauugaugagauaaguggagccaucuguccacugggaaaucagaaaauaccaaugucauuggaugggggggggggucugugccaggcuuccagccucaugcgagggagccgaccaaauggaguggcaccgagucauuggagcggggaucaaaucaagagcacagcccagaaagagugcccagaaagcucaaggcugggccaaaccagggucaaguuaacauuagaaaaagagccagcaggcugggcgcgguagcucacgccuguaaucccagcacuuucggaggcugaggugggcggaucacgaggucaggagaucgagaccauccuggcuaacacggugaaaccccaucucuacuaaaaauacagaaaaaaauuagccgggcgugguggugggcgccuguagucccagcuacuugggaggcugaggcgggagaauggcaugaaccugggaagcggagcuugcagugagcugacaucgugccacugcacuccagccugggcgacagagugagacuccgucucaagaaaaaaaaaaaaaaaaaaagugaaagagacagcaaaggggaagagcaaauauuugauucgucucccuucuaggaugauaggagcugucccagugggcagcugauguaugcuugugagugccuccugugugcccaugaggaggcguaugaacaaggggucaggagugcccaugccgacagccgggccuggauucacaccuuagcugugucgcuaacgagcugagugaccucaggccagcgacugaccagccucaugccucugucccuacagaaccgaacucccgggguuguugcgaugacaagguguguaaaugcaugugaaacaccgacaggcaggaaaccgacagccgucacgugucaucaccugccuguuaguuaccgugcucggcaccuuuggguuccaugacugugcagugaaaggaaauuuauuuggaaaugugagaaaugcuggaauaacauuauuuugcuguaguugucuaauauaaaucauuaaaaagggcuuaacaaccuggugauuuguauccgcuuaugucaguacuucugagauuaaaaaaaaaaaaaacuuugaauuaugagauaaauuggguugaagaugaaagagaaaugccuggauuggcaggagugcugccagucaucucggguccaggcccgucucuuuaguagaagccccgucgguuagggaacagccauguacugagugccugccgugugcuuggcacugucuuagcuuuacaggcacuguuucuuugaauucucauaacggccgcaugagauggaugugacuguacccacauuacuggugaggagucuggggcccagggccauacugcuggugacugacugaaccagcagcagcacccaagccucccagcugcugggccagcaggacaggacccagugguccaagaaggaguaggaaagaacaaccagggagccuggugugccagggagggcacagagcagcaccgugcccauuccccugaagaucagggccugcagaggggcccccuugcuugccaauaagcccagacugucaguggugaccugaacauuucccuuccuaagcacagcuucugggaaggaaggcccauguguguagcaggagggaaggcccguguguguagugggagggaaggcccguguaugcagugggagggaaggcccgcguauguagugggagggaaggcccgcguguguagugggagggaaggcccguguguguagugggagggaaggcccguguauguagugggagggaaggcccguguguguagugggagggaaggcccguguguguagugggagggaaggcccauguguguagugggagggaaggaccguguauguaguggguacgcggggaaacugcauuugcucacugccagcucaagccuccauccugcaggccuggcccacagucaguauuugucuugauaaugacagugugggcuugcggcaucguaccaguguguucuuaaccaggucccagcaucucguguugacucauccugccgucugcagacuugcuggccauuuggaaaagggugcggaggaguuaagauggggaggugucagauuguuacugagacauuucuaauuugcgauguaugguuuugaagccagcucuuuuuuucugguuucuccuguuuucugcagcaccccccggggaaagacauuuucugcucccaccgaguuggcagggccugcuuccugaaucuccugggugugucuuaacugccagucccagcaccuccugaaagccccacucuccuccaguggucacaguggaaggaucaugggagaaacagaagggaagaaagaugaggcugauuauaagcgacugcagaccuucccucuggucaggguaagccccaggggagggaggcaggacugccggcagggcccacacagccuggagagagguggguggagcuugucccuugcaggauggcagugggaggaaguuaagaagggcucugcuggcucagaccuagacaucuuggaguugacagugauucauuguuucauucauucauucauucaccaaguauugggccaccuacucuaugccgggcacuguucuaggcacuguggggaugguaaacgagacaggcgaaggccuggcccacaugaaauacauguuuuaagaacaugaucguaggcaguaaguacuauaaugaaaaaugaagcagguggaaggagcuggagagcagagguuagcuucuggagagguuuugcagaucagagaccugaagacagagagcaaaccucacaaagaccuggggaagaacaugccaagccggggaaacagaggcacgggaagccugggaugggaaugaacuuggcauuuuggaggcacagagagaaggccagcauggcuggaauggagugcugagaaggguggcaggacauaacagcaccaguggggccagacccuacaggccuggccagccacagugaagaauguggugagaacuguggguucuguccugaaucgaagggggaacacugaaggguuuuaagcaggggagugaugagaucuguuugguuuucaaaagcucacuccagcuguugugagcagaauggauuuggagauaccagagcagaaguggggagaccagcgaggaggccgcuguggaggcccagagcgaugaggguggcugggugcggcucacggaguagagugcgagaugcggucggguuuaggguguuccgugagugcagaggccaaaggaccugcugccaaauuggagacuggguaugggagcaagagaguccaggguggcugcuacagucugucuuuuccugaguauugggagaaaaaaugguaucaauuaccaggaaaaggagauggaagaagauggguuugugggaaucaaguuauuuuuagacaucuaagugaggcugucaaguggccaguuugacagaguagucaggagcccaaagaagagguuagagcuggggguagaagugugggagcccucccacagagaggacacagacaggcgcggaacacacaagaccccagagauggagucgcuggagaugggagaguggagguggggcccagggcccuccaggagcugggaggaggaaggaaauccagcagaucgauggagaaggagcagagggaaaggccggaggaaaaccaggggccccagagagcgcccagcggccucuucgggccuccggggugagauuccgucggaacacacuuccauagccagcauucccuccgcccucagccggcuuucuucccaugucuguuggcuggaaccuggugcuggcuucgugcccuugcagagagccugggcuugagagcccacgaggcucagcuccaugccaugccuuugccccagcugcaggcccucagucaggagaugggucaccugcccagggcugggccagggaggcuaccugcuguccaugccuuaagcuugggacagagaggccagccaggaaggccaggucacgggcuaagccugucucuuguuuguuaccccugcccugucucuagcacucggacaugccagaggagaugcgcguggagaccauggagcuaugugucacagccugugagaaauucuccaacaacaacgagguauugccagcagugcaggcggccccucgugcuuuugauggccccugugggugaauaaaguggccccuguucccugcaguuggcuccagacaguacugcuaggaugaggccagagccuuccuuggaagcauucagucuggggaaagucagugagugagaggcuggcgcugacuccaggcacugacggucacacccagcccuagaggagcaaagccacaggggucuccaugacgccccugcccauguucccugccucaggugggcugcugaauagggugccuuuccccgugguuccaucccaguggugaacagaggccugcccaggcauccauucauguauucacucauccauucaaaaagguguugaacaggcgcuguucuagguguuggggauacggccagcaggcaucaacgcaggaaggccauucaucaaucugguggggagagcgagaagucaguguugcggcagccgguggggaggcaagacacuggccagugggagcccaggcuuugggucggccaggcccagguucagauccuggcuucagcccuucccagcuguacccuugaaugagccauuucucaacucugagcgcaguuuccuaguccuuaaauggaggguggcgauggugccuccucacugggccaguugugaggauguauuuacugagacgauggggacagagugcccagcauggcaccuggcauggugggaggcgcuguugguguaccucaggcgccugcaccuggacucgcccugccgagcgggggucccugccccucuagaccuccucacacagggggcacgucuugaaagagcaggcacaggaagaagucgacuguggccaugacuaggggaguagucggcgccuccccagagcccacugaacgcaucagguaccucgcagucugcagggugccaggucucuccauccaguugguccugagacugccuggugccccgcuuguccagguuacaucugagggagguggcacuggcccaggaagcccgcacuaagugcagagccaggacgcagccccaggcuaucuccagaccugaugcuugccuucccgccucagccaguuucuucuugacugcugaguaaugucuaguuuucugugccuguguaauagaccuggcaggagguggccugcguggaaacccuuuuugaagcaggaggacaagagaaauaggacagcaggccuuucucuugccaagaccucagugccagccuucuccuuccuggagaaggaccugacuccugcccccaccugcccugcgcccccuugauaagugcccucuuccuuccagagcgccgccaagaugaucaaagagacaauggacaagaaguucggcuccuccuggcacguggugaucggcgagggcuuuggguuugagaucacccacgaggugaagaaccuccucuaccuguacuucgggggcacccuggcugugugcgucuggaagugcuccugacacucuguccccugccccguccccugcagggccuuuuccugccacucaucugggguggggagcagcccuaggcagguccugguuuuuccaaggagaguuggggucuuuucuuuuugucuuuguguaccaguuuccugagccacgcccagugugugaacuugacaucuccauccccaggcucucaaccgucucccucggagucucaggguguggacggggcagcgggcaugggucugugugggagacgugggguggggcggugugacaggguagaggaggugggagaugagaucuuccgcacaggaacacgccagucccccuuucuccagggcugccuuccccuugcauccugggagccccacugcccugccauccccaguacugccgggaagugucggccguccuugucauuaguggucauaugaaaauggccccaagaaggagaugauucuuucaagggacacaggcagcuucucuccuuguccucuggggaggugcugaccccucagaaaccccuucccccaacuugaccccaggcugaacagaccacugcaucucacugggccagcagcccccccagcccccagccuugguggggaccaagcagccuuucccguccccuccucgacccguacaguugagagccaggggcuggugugugggagcugcuaccuggcaguuucucgaggggucaccgagccucuggugggacaccugggcaggagugcucucaccacgaggcugcuuccgcagggaacccuggccugcccgcgacuucgcaucagggaccgcaugcugauuuguacugcucucugcuggguuuucuauguucuuuucgagugugggaaaaggguuuuaguagaagggugaaucguauuuuacacagcggucuuauuuauauaaaugucuugguuuuuacaauuaaaaugaccaaaaacugaccucau

SEQ ID NO: 17875 - RNA, 1367 nt, Homo sapiens
uauugggaaguccaucugccaggccagaacuguggcuaggacauuuuaauugacugcaacuaaucaccuucaggucacucacguuuccaauucugacaaaaguuuuccuuguucuucugauucguaggcagguauuugcagguuaaagguuuggguugagaaggacacagggaacuugcugguaugauggaaguaucuguguuuggcugggucaguggagucagaguguucacuguuacaccuuggaacugagacugcuugaugcggacaauguucagacauuuguuuaugcaccaaaauguacaccuaacauuugugcauuuuacuguagguaaagucauuaaaguuggugucuuugaaagcugggcugagggauuggcuuuugggugaauaaggacgaggcugucuguggagcucacccagggguugcugggcugccacaggagagcuugaccucauucauucaacagauaucucauggacccaacuguggguggugcagucuccacagcugcaucccugcaggcccccgaacaaaacugaagguggucucagcugcauggaguucucauuuuagugagggagacaggcaguaaacaagcauguaauauucuggagcaagaagggcuggaaaaauacuuccagggauagagaagaggggcaguaaaucauauauaaaaagguccugaaguggcccuuucagaccaugucauuggaguggagagagcaagaggaaaauggcagggggugaggacagagugggcacggcccagaggaagcagcugagggagcgcuggaaagcccuuggcuuuaagucucagcucugagcagagugacaugaucugacuugcauuuuggaagggucacuguggcugcugaggggaacagccuuugggaggugaggguagcaacagggaggucagcaggagggccacugcagugaucuggaugaaggaccauggcuuggacaagggccauggucagggguggugagacguaaaggaauccuguggguuugcugauggacugaguguggggucugggcgagggaggagccagaggugacuccgagguuuaggcugagcaucgggagaauggaggugucauuucuggauccggguaguacuaugguaggaguggcuuugaggagaaggugaagagcuuugcuccucaugggguacauguuagaggcucaccuggagcugucagaaagccauuagcuaugggaaucuggauauggugggagagagcuggccuagagccaugaagcucagacccuccugaagacggaggcuuggcugcuuggagaacacguaguagagaaugcuuuuucuuuccuccuuggcucucucuuggcagaaggugau

SEQ ID NO: 17876 - RNA, 1952 nt, Homo sapiens
agggguccccaacccggacucucacucaccgccucgcgcggcucccggccggguuccgcggcucgccccacuccggcucuagccgcccgcgucuccucucgaggcucacuguccagcccgggcgcacggagcugagaagucgccgccagcggagggcguguggccagcggcaaccaagagggugggaaagaugggaccgucgcucucgccgccgcggccaccacagacacugccgccgccggcuccucucagccacggaagcugcgggcccgcccaccacgcccgccucccguccugaagacuguccgcuggagaagugacggcggcgcuagccaaucagaggccugaucggggucgugaucggcggacuaaagggcgggcggagaaggaagcggcaugaagaaggcgaaaacggcggccugacuuccugugacugacggcacggcgcagccaaugggcaacggggagaugaccucaucucugaggaaagucuggaacuggcugagcugcggcgaggggguuggcgacgagccgggggcggagcucugggccuuaaagaggccgcagcccuguggucacccugugaagggaagggcgguggacccugccggaucuugcgaaguugccaaggggucaaugcccaggcgcgaguaauuacugcauuaaucccagaccccaucccgauucuugucggggacugaagggucuccgccuggggcuccgaagucgaucauuucacauucacgcuucccaaaacgagacacaauaaauuccgcucuggccuggagccuugaauucccguuacggucccgccccgccgaggcccgucgccuuguuucucugagucaguuuccccaacggugaaagggaggacgcugacaccugccugccccucccuaucugccgaggccguggagaucagcagcagcgaaagcgcucugggcuuagaagaggaaaagggcugcgugagcccaagagcuugcaucggaaggcuccaggaagagcaucugcaaaaaagaggauuccacgggaugacccccgacaacucuuggaauucuaaaauccuauacccuugcccgcacccauucguguagugaaggggcgcgcguuaggcgcagaggccacacgcuccgcaagugaacccgggcaccucucugaaccuauuccgggcugagggcggggagcggguggcugcccgauuuaaaaacauguauauguauguguauguguauguguauguguauguguauguguauguguauauguauauguauauguauauguauauguauauguauauguauuaugagugaaguccaugacugcaacagggagaaaggagaaaggcgaaaggggagagagcaacaagguaagccaggcccacugugaugacagcugcggucaugcaggcccuucguauccgccuuccuccccagcaaugggagagagcccagaaaaggagaaauaaccccaacucgaugggguggaaaagggggaagcgcuuuccggaaggcuuccgggauggggucaccagagucagaggaaggaguaacaguagauagaagaagaaguggucaggggcguucuucuagguuuggggcggacccgcgugaagaugcaaagacugaaaaggggcggcucacuuuacauuccaagguaaauucucacuaugacccccuuuuccccaucaaaggcuucugggacugcccaugggugaacucagagggaggguaggagagggugcugcucuauccaauggcggcaaaagucaaaguggccuuggguauucccaauuacucacuauaaaucagcuuccaaugccggucgcagaaucuuggaguuagacgggauccucgugggcucuuagucacacacaccuuccccaaggcaaaaauucuugcacaaaauaccugauaaaauuauuuauucgauaaauauuuuuugaguaagaa

SEQ ID NO: 17877 - RNA, 3509 nt, Homo sapiens
uguguccagucccucccagcuuccccagggcccuggggcucugcaggcauucagaaguggaagccagccacagccugggacugaagagguuaaugugcaucugccuccgaauguuaaugugucuaggugaugucagugggagccaugaagaagggaguggggagggcaguugggcuuggaggcggcagcggcugccaggcuacggaggaagacccccuucccaacugcggggcuugcgcuccgggacaagguggcaggcgcuggaggcugccgcagccugcguggguggaggggagcucagcucgguugugggagcaggcgaccggcacuggcuggauggaccuggaagccucgcugcugcccacuggucccaacgccagcaacaccucugauggccccgauaaccucacuucggcaggugaguugacugggagcccucccuccucugggcuguggguggaaaaugggaagguuucaccccugagccaaacugcuugggaaacuuuaucacaguucuuggggacaagaucuguggucugcuuugcucugaggggcaggagaaaagggggcaaugguccgcaggggcagacgggcaggagcagagcagggggcgaaggcauauucagaauggcaaggaaggggggccagccgugagacagcaggggaaggcucgcugcuggguuccaaagaugcuuggcagaaaaaauuccaggcuggaaaagcaagcgagagaagcuggagggugguaugugggagacagcugggggcucacuccugcacuguuagccucagcuuuuuacucccacuuggaugaugaggucugagacauccuuacugccaccugggagaggcccugggaagggaagacuucacagagccaugaggggauuaacuuuucuggugaauuaagcuuccugacauuuccagagcugcggugcccugggauuccagcuuugaaggagaaaggaaggaaggaaaagaggaaaggcuuauguagauaauuuuuccaggcugcugagcuccaacagacaguuucugucucugcuucacucaagaagcccaggcucagaagauaccaaucaaggaaauccccgcuaggaagccugggguagggagagcugcuggcuugaccagggcacagccggcaaaagccucuacaagacagucacccacagauaugcccaagaaucaguacacaguuuccaaccagagaucuccaaaaugaaacacucagggcuacacauaggaaaagcacgcacacacacacacacacacauacacagacacuuacuuuuguguccuucuggcuaugcugacgaguuuuccuggugaagcccggggcucacagaguaaucucugcagacaacugugguucuugccucuggugccugcaggaggcaggcauguuguguccuuccaagacagauggcucagggcacucugguaggauucaccaggaaacucauggagaagggaaaagggacaagauuagcaacagugaagggagggagaauggugggagaggauuccagaugaacggugggucgcuggaggcugagcaugccagcaggaugucaguucucagagcaaagcccaugucaaacagccaacgcuugcuccuucuguccccaggaucaccuccucgcacggggagcaucuccuacaucaacaucaucaugccuucgguguucggcaccaucugccuccugggcaucaucgggaacuccacggucaucuucgcggucgugaagaaguccaagcugcacuggugcaacaacguccccgacaucuucaucaucaaccucucgguaguagaucuccucuuucuccugggcaugcccuucaugauccaccagcucaugggcaaugggguguggcacuuuggggagaccaugugcacccucaucacggccauggaugccaauagucaguucaccagcaccuacauccugaccgccauggccauugaccgcuaccuggccacuguccaccccaucucuuccacgaaguuccggaagcccucuguggccacccuggugaucugccuccugugggcccucuccuucaucagcaucaccccuguguggcuguaugccagacucauccccuucccaggaggugcagugggcugcggcauacgccugcccaacccagacacugaccucuacugguucacccuguaccaguuuuuccuggccuuugcccugccuuuuguggucaucacagccgcauacgugaggauccugcagcgcaugacguccucaguggcccccgccucccagcgcagcauccggcugcggacaaagagggugacccgcacagccaucgccaucugucuggucuucuuugugugcugggcacccuacuaugugcuacagcugacccaguuguccaucagccgcccgacccucaccuuugucuacuuauacaaugcggccaucagcuugggcuaugccaacagcugccucaaccccuuuguguacaucgugcucugugagacguuccgcaaacgcuugguccugucggugaagccugcagcccaggggcagcuucgcgcugucagcaacgcucagacggcugacgaggagaggacagaaagcaaaggcaccugauacuuccccugccacccugcacaccuccaagucagggcaccacaacacgccaccgggagagaugcugagaaaaacccaagaccgcucgggaaaugcaggaaggccggguugugagggguuguugcaaugaaauaaauacauuccauggggcucacacguugcuggggaggccuggagucagguuugggguuuucagauaucagaaauccccuugggggagcaggaugagaccuuuggauagaacagaagcugagcaagagaacauguugguuuggauaaccgguugcacuauaucugugagcucucaaaugucuucuucccaaggcaagagguggaaggguacugacuggguuuguuuaaagucaggcagggcuggagugagcagccagggccauguugcacaaggccugagagacgggaaagggcccgaucgcucuuucccgccucucacuggugcgauggaagguggccuuucucccaagcugguggauaaugaaaaauaaagcaucccaucucucggcguuccagcauccugucaauuucccuuuugcucuagaggaugcauguuuauuugaggggauguggcacugagcccacaggaguaaaagcccaguuugcuaggaggucugcuuacugaaaacaaggagaccuggggugggugugguugggggucuuaaaacuaauaaaagcuggggucggggggcuuuugcagcucuggugacauucucuccacggggcacauuugcucagucacuaauccagcuugaguguccguguguucugcaugugcaggggucauucuagugcccgguguguuggcaucaucuuuuugcucuagcccuuccucuccaaaauaaaaucaaauaaaggaaaaucuccacccacaucacucuggau

SEQ ID NO: 17878 - RNA, 1177 nt, Homo sapiens
cucuuaguauaguauuaaguguuaucuacaaaauuugugauuaaccaaaacacacacaauuguguucaaauguuauauauuugaagagucaauuuaacaauuccuuuugguagacuucuuuugcaccucuuuacgcuucuuuuuuuuccucuuaccacccucuuugacuccugcugagaaaauagggggaucucuguugcugguaacccaagauauaccucccucaucauuguccacgaaaguauauugagauacauguuuggagcugugagaauuuggugaauaguuguugaaugacuguguucuccagcugcauucuuuugcaaagcccucuucauuggccacacuauuuacaagaaaaaaugucaacucuccauuaucuucagcuucucuuucuugaucacuuucaauaauuuucuuuguauuaauauuucugccauuaacgauuuugucugaaguuguaacagauauguaguuguccaucccacuauuaucaaaagccagggaagagaaagaaguaaggccuucaugccccaaugaacccugugauguauauccuguaucauaugaagaaaauuucucaaaaauuggauauucacuggcaguggagaaaaaguauccugcaucucuguuucuguuuccauaggagcuuccuggacgauuuaacagguccucaagcgagucuucaaagaagugaaaagaaaauggaucccuuucaugaaaaauuucuuuaaaaacaucaucuggcuuauggaaugugaagccguacucacauucaucaucaaaaugacuuccaccuccguuuaauccuucugugccauauuuaucauaaaugucccguuucucaucauuugauaauaccucguaugccucagcuacuucuuugaauuuucucucugcuucuucuuuauuuucuggauuuuuaucagggugccauuuaagugccacuuuaugauaagcuuuuuuaauguccucaggugaagcauaucuuugcaguccuagaacuucauaguaauccaccauguuuuaacagauaguuggaagugggugugcuggguauugagaaccgugguuuccucagcucaggcucugcuggugguggugauagagguagugacugcaaauagguacacuuuuauguuaaagacaauguuauuaccaugugcuaagagaugag

SEQ ID NO: 17879 - RNA, 2435 nt, Homo sapiens
ugucccugcgcugcgccuccaggcuggaccagcaguuccaggcggcauggaggggugagucuuugggcccgauggugcaaggggggauucagagcagcucaguggccucagguaagucucugcccccucugggccucucagaggcuggcgggcaggggcucuggggacuuccugggguucuccaggaagggggucucccaaggugggcucugagacacguggcaauguggccacugccaggaacugguccucuggggcuugucugagagcccagcaguggucccugcauuaugaaugcuugucgcuucagcgaucuguccccauggguccccucccuggccugcccugaggcacagccuucaccacaggcucuggagaagccaccaacuccaacgcaggggcuggagccugggacccaaaggagacuccaaaacagacgauaguccagugagcagcgagggggaggcuccugggggccggggaacagcccagcgaugggggagaggccaugccugacacaggcugagaacagaggggccagcugggcaggggaggugaucuaucauccuagcgcuuugggaggccaaggugggacaaucacuugaggccaggaguucaagaccagcccgggcaacauagcgagacccugucucuaccagaaguaauuaaaaaauuagccaggcgugguggugugugccuguagucccagcuacucaagaggcugaggugagaggaucacuuuagcccaggaggugaaggcugcaguaagccauagucauuccacugcacuccagacuccagccugggcaacagagcaaggcuugucucuauuuaaacaaacaaacaaaaaaagacucaaggacccggacuggaugccucccuccuuucugggggguaccauuaugcuccugccaccugggagcuggcaucauaucagucugaggacaggcugcuuccgagccuacccuggaccagagccucaccacagccugagaacaugcucugaacuggagucauucucacagucagcaaguccucacugagccauugggcagaggcaaagggacuaaccaggucacuuuucugagccucgguuuccucccauguaaaacaggacuaaucauaggaccuccacugcgugggggguggggggcagggaggcucagggugauuggcacuuuccugggcccaaaggaggaggcucugagggguuuuuggggcaggagcugcaccauggcugggacuaagugagggacagcauguggccucggcccuugugcacaacagacucucccuccccgucccaggccccggagcuccacccauguccccuuggugcugccgcuucuuguacuucugcugcuggccccggcuaggcaggccgccgcccagcgcugcccacaggccugcaucugugacaacuccaggcgacacguugccugccgguaccagaaccucacugaggugccagacgccaucccugaggucagcagggcaggagcacaggcacagaguggcaguggggcaagguggggacccagagggaggagccugggcugggcaccaguugaucugccaccgccugcccgggagaccuuggcaaauuacuucucuuugagccucaguuuacacuucuguaaaaugggaauaauaaaaaccaguaacagggagaugaucuauuuaaaauccuuacugugugaauggaauaaguaggugacccauagaucgauacugaauucacugcagacccugugguggagaggcgggcuguggcagggugagguguggucucugcucugcagagucaucagcuaguggaggagagagagcgaggaggcagggacagcacagugugaaaaaugccacagugggugaugcccagggcacuggagaggaaggcuuccuggaggaggugucaggggucggaugaagagaaauaugggaaaggugacaggagaaaagaguguuccggggaagaagcagcacuugcaaaggcggggucccugccuggcucagccccacuuucuccucgcuguccccagcugacccagcggcuggaccugcagggcaauuugcugaaggugauccccgcagccgccuuccagggcgugccucaccucacacaccuggaccugcgccacugcgagguggagcugguggccgagggcgccuuccguggccugggccgccugcuccugcucaaccuggccuccaaccaccugcgugagcugccccaggaggcgcuggacgggcugggcucguugcggcggcuggagcuggaggggaacgcacuggaggagcugcggccggggacguucggggcacugggugcgcuggccacgcuaaaccuggcccacaacgcccugguuuaccugcccgccauggccuuccaggggcuacugcgcguccgcuggcugcggcugucgcacaacgcg

SEQ ID NO: 17880 - RNA, 486 nt, Homo sapiens
agaauuuucuuauagauuuuuuuuuuuuuucucagccaggcgugcuuuauggacaaugcgcuccucaggccuugaccgcguacuuccccagcggguacagccgcuccuuccgcugcugcuucuuggucuucggguucuccucaugcuuguugagccggcggcgcauggcgcgugucuucuuaggccgcagguccaggggcuuguaguuccugcccuuguagaauuuccugagguuuucuuucugagucuaguuaauaacagugagaacacaggcaauggauuugcggacgacucggaucuuagagagcuuggaggccgcaccgccugucacuuuggcgacgcgcagcugggacagcuccaccuucaggucguccagcuguuucagcagcuccuccuucuucccgcgaagaucucgagccuugaucuuggccauugcugcacaggccgccgacgccgccgcgccgcccgcuccgagggaaagagcgu

SEQ ID NO: 17881 - RNA, 486 nt, Homo sapiens
acgcucuuucccucggagcgggcggcgcggcggcgucggcggccugugcagcaauggccaagaucaaggcucgagaucuucgcgggaagaaggaggagcugcugaaacagcuggacgaccugaagguggagcugucccagcugcgcgucgccaaagugacaggcggugcggccuccaagcucucuaagauccgagucguccgcaaauccauugccuguguucucacuguuauuaacuagacucagaaagaaaaccucaggaaauucuacaagggcaggaacuacaagccccuggaccugcggccuaagaagacacgcgccaugcgccgccggcucaacaagcaugaggagaacccgaagaccaagaagcagcagcggaaggagcggcuguacccgcuggggaaguacgcggucaaggccugaggagcgcauuguccauaaagcacgccuggcugagaaaaaaaaaaaaaaucuauaagaaaauucu

SEQ ID NO: 17882 - RNA, 13841 nt, Homo sapiens
cggagcuggagggaaggccccgggaaacggcucgggcaaacguccgaaccaugggcuccgaggcaggugcagggcggacgacucagcgggggguuuccggcgggcauggugacucccuccccucccccgcgauacucgucccccaaacacaacuaaagggagagugcacugugcccggcucgugagcaacccggccccaggugguccccggcccucacggagcgccccugggagaacaccucacacgacgcgcacaaguucagagugguaugggaaugaaggaaaggagugcggcgcggcgcugugacagggaggggaagacggggagccggacgcacgaccggcgagcacagaagggcacaggagcugcuccgcgagauaccagcgagcugaggcgcggggcuggcugggaaguagucccggccgggcccuggccccgccccugcagggcggagggacgcaucacgcagggguggggaagccggauccgugcgcaggguugcuaagggugaaacuuuucauugacuuugcucacuucgggccggggcgcgggaaggugcggguuguuggcugaggcaagccguggcucgggcgacgcggggccaggagggcaggaccgucugccggcgacagcccauaccgucugccguugcgcgacacgaaccacccuccgauccgccauccccgcgucgucgccgcuaguccgcccgcccgcccucgggccccccgcugccgagcccgaccuccuaagagcugaaagaaauuauugagagucauaguccauagcccccugcuucgucccccaacccucaacgacgaaaaggacuucgguccccuggcccggcgacgcccgggaaggaaaggagagcgaccuccgccccgcgcucaggccacccuggagggagaagccgccccgcggccgguagagcgccccgccgccgcggagacccgagugagugaguuggggggcgugcgggcggggggcccgccccgagacccagccggccggacuaccucuuccaccccgccccacucccgcuuugcuggacucuccacguugcugccgcucccuccccgccuggccagcauuuucuuuccccauccagcuucccuccagaccccacuuuccccagcuccucuucucacgccaucugugcuccuggggugcccaagagcuccuuuuucucccaguuccaagaguggcccucuccuggguggggugcauuuccucccuuccccgccucccccgguucuuuauauccuagcuacucgcuagaucuuccuuguucuccaaagaaacauaacuccccccaccguuaaauaaauccgaggaaggaaggggauccaggccuuguuuuucugcuucuuuucccgugugcagggaaggggggugguaauuguuaauagacucuauuucuggcucuguggagccugaaggguggaggguggacacccccuuuggcgacgggacaggucaguggagauuguccuugggccacugagccagaguucaccguuucggcugagcucuuuauacucuuaaguguuuuaauggaaaauugggcagaaaaaaguacccuuagagcagugccagugaguggauucugcuuaucuugguaaggugccugcgagguggggcccuacccccaaacuccuuccccuccuguccggaggaugaacugugcccuugaccaccagaaaucugggaggggaaggagggugcagagaggaggcacagccggcaggcccucucccucccccaggagaaaccagaaccccgcacagcaagcuucagcuuggggacggguggaggccagucucuggugcuacuccguaucuaaacggucuuuuucuccuucuuacccaccguacccugggaauggguccuucaucucugauuuuccggcagaaaaacaauccuauugcuuucuugggcuucuacccccaucccuccgugaagcauagggggaaagaagcuugugugggaggaaggauuaaggagguuuaacacccagcgggggagcuugccgaggaucugguaagucuggucguaaagcagaccuugcaaugggaggagacacacagaauuuuaguaugagaagaugcucaggugucagguguacaguuuuuuucuucucugccugggaaccuuuuccuauuucccucucccggaucugguuacucagucuucgauuagaaauggggugaggcuugggcccugcuggccuuggccuggcgccuccccacagcuugacuggaaauuucuuuggccgagaggacgggagaacuggguuugauuccugccuuuccuuuccuggcuguuuggggugcuggagccgaguccgcuaggcauuaagugaaaaagauccguuucccuuugaauccaccguccauccagcaaccccacacggaccgcccaggcccuggaauucagauuggguggggggaagggggucgugaccuuaucuaagccagcccacccccuucacccagaaaaaacucauuagaagcagauccuaguuucaucaguaaugggaggcgaugaagggaaaggugggaaaguuaggcucucguaaagccuagaggaugugguggggccauacaauacggggaguaggccuuuuggguagaaucuacaugaaauguauuaggcgaugggaggggggcgccgacccgccucagcgcgcaugugcaucggaaacuuuuccugggcucuucgacccucggucggcuccccuuaccgggcaugcguauugcggccaguugggccuucgcaaagugcucagggaaguguagugugcagggaaaguaggucacuccugcuaucgccugguccggagguguuugaggacuacaauucccagagugcagagcgggcccucaccgcccgccucuccgccuacguuuggguugagucgaguuuuccuagcuccugaggaacauggagugcccuagaaagggucuucauagccgaaaggggccuuguugucagaccuaagguugaccggucugugucuagggggagaugaugagagacugggcgcgguguugcagucagucagcaccaguccuggaagccuuucaauacacacccgccugucugggccgcugccucugggaccagcgaguuggggcggaucccgugucucaccaaggagaggagcugccugcguuuggcucucacuccccggacagcggcagggcacucgcauccacccggucugugacaccugcuggccccuccacacuuaguugaguccuguaguccgucauuguaggacaguuugcacauuuaaggcuuagaggugucugaguaucuuuuuggguuuggggcucaguggauuccaucaccauuaucccuccuuuuccucuuugaaacagaauuuucuuucugaaaaaccuuccggccgggugcgguggcucacgccuguaaucccagcacuuugggaggcugaggcgggcagcggauaaccugaggucgggaguucgagacuagccugaccaacuuggagaaaccccgucucugcuaaaaauacaaaauuagccgggcgugguggcgcauuccuguaaucccaguuacucgggaggcugaggcaggagaaucgcuugaaccugggaggcggagguugcggugagccgagaucgcgccauugcacuccagccugggcaacaaaaccgaaacuccaucucaaaaaaaaaaaaaaaaaaaucuucuggcuaggcagugacucacgccuguaaucccaacacuuugggaggcggaggcgagcggaucacgaggucaagauuucgagaccagccuggccaacauggugaagccccgucucuacuaaaaauacaaaaauuagccgggcguggucccgcgugccuauaaucccagcuacucgggaggcugaggcgggagaauugguugaacccaggaggcggagguugcagugagccaagauggcgccauugcacuccagcucugggcuacagagcaagacugucucgagggggggaaaaaaaucuuccuucgcuucugacauuagagcaggcagacacaugcgcgcgcgugugacacacacacacaccuuccucacauuuuuaucagaaguucucucuggaaucugcacugacugaggcuucuuuugagcuucacgccccacuucuucccccgucgucuuucuccuaggcaccugcucuuuaaaacacaagucagcacaagggaucagaauccagguuuaacuuugcugcuggaaguaaacaagugaggauaaaauucuuagugaaauuggacagaauuuugcucucauauuugcccuuuuuaauagguugacaaaagggagauuuugcuauuguuaaacaccucaccauuuuuauucuucuugcucccuuuuucgccguuugugccuacacugggguuagaaaagaucuuaguguccucugcagccacuuaagcgaaucccuuuacuuguucccuuuauugacagguaguuauuucuaagcuuucuaaucuuaccauacuuccauaaauauuuuauauauaagcucuagaauuuguucauagcuuuuuaaaaaaugaacaaacuccucugaauggccacuccuaucuuuagcuaaagacaagccagcaccagugcuuuaauccucugcuccauaagcuucuugcagucaaaauuagagccugagcugauagagcagaaaaucucauucugguuguccaucauuuuuguaagguuccaccccacagccaucugguccagccuguucucuaauuaaagaggcaaagguggcauuauaugcuuccuuauuugugcggcaacaucacugagguauaaauuggugugcagcuuuaguugcuuaugcugcagaaaaugguuagcuaggcagggcugaugacagugguucuauuguauuuuggggugggaggcuuauuucccaaugacuuuggccugcauuuaaaaugcucucauuuugaggccgaacuguucaggaguaguuaacuuggaaggcaauuaugcagccagguuugaggaggcuuagaaagguguagaaacccuuugcucucaguggaaauaccaagaggugcauuuuaagaggccaugcaguaccuugggagaaguaucauauguugacuucagucuguuuuagauuucaaaaauacuuuggaaacacugucuuuaacaacagguuccauucuagggaaccaguaucaacuuuccucacaacuuuuuuuucuuuuuuuuuuuuuuuugaggcagaauuucucucacuuugucauucagacuggaguccaguggcaugaucucggcuuacugcaaacucugccucccagguucaagcgauucucuugccucagccuacggaguagugggauuauaggcacccgcaaucaugcugggcuaauuuuuaugggguuuuuucuuuucuuuuuuuuuuuuuugagaaaaaucacucuugcccaggcuggagugcaguggcgcaaucuuggcucacugcaaccuccgccuccuggguucaagcaauucuccugccucagccuccugaguagcugagguuacaggcgugugccaccacacccggcuaauuuuuuauuuuuaguagagacgggguuucaccauguuggucaggcuggucucggacuccugaccuugugauccacccgccucagccucgcaaagugcugggauuacaggcaugagccacaaugcccggcuaauuuuuguguuuuuaguagagaugggguuucgccacguuggccaggcuggucuugaauuccuggccucaagugauccaccugccuuggccucccgaagugcugggauuacaggugugagccaccacaccuggcucuucacaacuuuuuagucugcuccuuguuggacaccucuauggacuauguggcccuucagaccucuguuccugagagaaggcucaugguucugguggguaguuuuguaucugcugaugagccugauccucauaaacagaaagcccuuuauucuuucuacuauucuuacuuuuuuuuuuuuuugagguagagucuugcucugucacccaggcuagagugcaauggcacgaucucagcucauugcaaccuccgccuccuggguucaagcgauucuccugccucagccucccgaguagcugggacuacagcugcgugccaccacgccuggauaauuuuuguauuuuuauagagaugggguuucaccguguuagccaggauggucucaaucuccugaccuugugauccacucgccacggccucccaaagugcugggauuacaggcgugagucaccgugcccggccucuacuauccuuacuuuuuauacccaaaaaagcccugaaauuggucuguauugaucauuaauagacauuugaggcugaggcacguggaucacuugagcguaggaguucaagaacagccugggugacauggcaaaaccccaucucuacauaaaaauacaaaaaaaaaugaggcuggacaugguggcucaggccuguaaaccuaccacuuugggagguugaagcagguggaucacuugaggccaggaguucaagagcagccuggccaacgugaugaaaccccguguguacuaaaaauacaaaaauuagccaggugugguggugcaugccuguaauuccagcuacucaguaggcugaggugggagaauuguuugaacguaggaggcagagguugcagugagucgagaucacgccacugcauuccagccugggugacagagacuucaugucaaaaaaaaaaaaaaaaagccagguguggugguacaugccuguagucccagcuacuuggaggcugaagugggaggaucaccugagcccagggagguggaggcugcagugagcugugauccugcacccuagcuugggugacagagugagacccugucucaaaaaaagaaaaagaggccaggcgcgguggcucaugccuguaaucccagcacuuugggaggcugagguggguggaucacgaagucagcaguucgagaccauccuggccaacauggggaaaccccgucucuacugaaaaaaaaaaaaauuagccaggagugguggugcacgccuguaaucccagcuacuugggagacugaggcaggagaaucgcuugaaccggggaggcagagguugcagugagccgagaccgugccauugcacuccagccugggcgacagagcaagacuccgucucaaaaaaaaaaaaaaaaagaaagaaaaagaaaaaaauagacauuugaagaaacuuagagaugaagucuguguuggaggcugggaaaagagggaaaccaggguauucugaguccugaguguucuuguggaggguuugggagaggcauaguugugguaccucugcugacucccaugugaccuucucuguuccucagaacugaaaugaggguuaacuagauucagccacugucaugcugcuccagauugacccagugagucuucucugauacauucaccccagaaaucuuuuucugaggauuuagucccaaaaaugccccuuaaggccguguguguuggcucaugccuguaaucccagcacuuugggagaccaaggcaggcggaacacuuuagguuaggaguuugagaccagccuggccaacauggugaaaccccaucuccacuaaaaauacaaaaacuagccaggcguggugacgggcaccuauagucccagccauucaggaggccaaggcacgagaaucacuugaaccugggagguggagguugcagugagccaagaucacgccacugcaguccagccugggcgauagaacgagacucagucuccacauacauacauacauacauacauacauacauacauacauacauacauacguaaaauuaaauuaaauuaaaugccccuuaagagccaugggcccaggccugagaauuacagggaaauguguuggggcagguguuuagaaaacucaaaauccccaagccugaaauuagcaccuggauacuucaagcuggauccagaaaggauuugaaucaaaauccagccccaagucuuucauaggacagaagaugcccuugacaguucauggagcagucaugucucuuugcuuagcucagcagcacagccuugcccagaggucuggcuaggaacauguucuggcucugccuccucucagagauggcucuuucaguucaguuucucccccagcaugagccccggagcugcccuuuuggagaaaaugagauuaggaucacuggcucucaggaccucacagaucaucuuccugagacaugaggcuggcccaggccaagggaauaaaccuuuuugaccucagugggaucuggcugugagagaaucccaaaauaacaaucugguguuuaucuugggcugccuucucuccggggaucucaaaacacuugauaaaucugaucugcugccgaggacagguggucagacagucccugggagacugagugaugaugggucccuaccggaggcugcagggugauggaaaauuucuuuccucugccacccucaucacuuacauucucaccagaaacuacagagauucccccuccuuuucucugcuucccuguggcagccccgagucagcaguucccuuguugguccacaucucugauugugacaggucuugccuuuuuccuggggcucaugcucuugucuuaugucuuauuccuuuuuuuuuuuuuuuuuuuuuuuuuuuuuuugagacagaguuucgcucuuguugcccaggcuggaguacaauggugcgaucucggcucaccacaaccuccgccuccuggguucaagcgauucuccuaccucaaccucccggguagcugggauuacaggcaugcaccaccaugcucggcuaauuuuuuguauuuuuaguagagacaggguuucuccauguuggucaggcuggucucgaacucccgaccucaggugauccacccgccucagccucccaaagugcugggauuacaggcaugagccacugcaccuggccggaguucuuaaaucaguucugcaaaccuggacugaaccagacagcauacacacccauggggcccaugaugacagauggaugugacuggaguccaggcccccagugaagaauuggcagugcucuuuccuguucagugaccuguaucccuuuucauuuaaggaggacaaccaaauauuuuaaacuuacaucuuagucugugacaguuugggggcacgacuucaccaagauauugcagagacagcaagagacuucuucuucaccugauuuagggacuugauuuuuuuagugucauucauacagugaccugaauucucaagaugguggaaaacacagcuucccuauuucuuuagaauuacuuuaaaauaguagcuuuuuuuuuuuuuuuuuuuuuuuuuuuugagauggagucucacucugucgccaggcuggaguacaguggcaugaucucggcucacugcaaccucugccuccuggguugaagcaauucuccugccucagccucccaaguagcugagacuacaggcaugcgccacuaugcccagcuaauuuuuguauuuuuaguagagauggggcuucaucauguuggccaggauggucuugauuucuugaccucgugaucuaccugccucagccucccaaagugcugggcuuacaggcaucagccaccgcgcccggccaauaguagcuaacuuuaucaauuaccuuuuaauugccagguacacugugaggcaguuuauauccuugaacuaccuuaacuucaugauggccucauguuacuaaugaggaaacuggggcccacagucagacaugagccacugguggggcagaaauaggcuccugguucugugugauccaaaguuggugcuuuucugucuaucccuagcuguuggucaccaccagcuuucugcauauuuucucacggugccucucauuucccagagccgccuggagcccaaggcuguacacgugcccugugcugauucucugccuaggaaaggaccaugcagcuagagaucaaaguggcccugaacuucaucaucuccuacuuguacaacaagcugccccggcgccgggcagaccuguuuggggaggagcuagagcggcuuuugaaaaagaaauaugaaggccacugguacccugagaagccacugaaaggcucuggcuuccgcuguguucacauuggggagaugguggaccccgugguggagcuggccgccaagcggaguggccuggcgguggaagaugugcgggccaaugugccugaggagcugagugucuggauugaucccuuugagguguccuaccagauuggugagaagggagcugugaaagugcuguaccuggaugacagugaggguugcggugccccagagcuggacaaggagaucaagagcagcuucaacccugacgcccagguguucgugcccauuggcagccaggacagcucccuguccaacuccccaucgccauccuuuggccagucacccagcccuaccuucauuccccgcuccgcucagcccaucaccuucaccaccgccuccuucgcugccaccaaauuuggcuccacuaagaugaagaaggggggcggggcagcaagugguggggguguagccagcaguggggcggguggccagcagccaccacagcagccucgcauggcccgcucacccaccaacagccugcugaagcacaagagccucucucugucuaugcauucacugaacuucaucacggccaacccggccccucagucccagcucucacccaaugccaaggaguucguguacaacggugguggcucacccagccucuucuuugaugcggccgauggccagggcagcggcaccccaggcccguuuggaggcaguggggcuggcaccugcaacagcagcagcuuugacauggcccagguauuuggagguggugccaacagccucuuccuggagaagacacccuuuguggaaggccucagcuacaaccugaacaccaugcaguaucccagccagcaguuccagcccguggugcuggccaacugaccaucuaccugcccguggggccaggagcacccaagaccacagaaaagagaaaggaaaggccaaaaaaaagaggaaaagaaaaauguacaaaaagauuuucgaucuucucacucuuacuucuagaaaaaagauccagcccaggcacggaaugggagggcccugcaaagcacccaaguguguuucacucaccccuuaccgcucgcccaccggccugugauuuauuugguugguuuggguuuuauauuucuuuuucuuuuuuuuuuuucuuacauguaguuuucuauauaacaucuuuaaugaguggcuuccugugcuaagaaugguccagaugugaacugcugcucccugcuccucccuuccuccuucacacuccuaguuuaggauugauguguccaagcucauagggaagaaagagcugcagcuggagccugacccucccuggaacagggagaggcuggcccgugucacugccucugucacccagcuauccucgcacucaaagccauccaaccucagcaggccuucucgggcccugccaccugaauaggucugaccccaguccccacucccuuucaggcugggccacagggaguugcuggcuggccacuugacacccucccccuggagcugaugucugugacuacagggagauuagcacuucgucuagugaaacuccuuucaucucuguccuauggccccaccccaccauucccucuaggcccagaccaucaucauggcccuggccauugauguguaugggcuuucuuucccucaugcagccccuucuuccccaggcuggauguuguggguagggagggguguguguguguguauuugguuugcuguccuuuuuuaaaggauuccaagccaugugaaacuucccuucuggaugugauucugggucgcaaguccuuauuuauaugugaggcuggggaaugggcuggggguauuggcaguccuuuugcagggcagugugugugguggggugacaccgcuguggcuuagcccaagacacucccagaggaaaacacugcagaaggaacugguuugcagacuguggaaggaucugcaguuuuguuuuugaccaaaaaaauaauaauaaguuagcucugaagggcagagggaauacccaagccccugaugccuaugagaagucccuggacuucaacccuccuguuguuuggccuuagcccagagggagcugcucaccugagcacccuugggggugggcagagaggcagggugggauuuuagaguuagugucugugcgggggcagcccugagccuggaguugagacuuuggggucucuuaguuuggagguguugagugcauuugugccccugccugguugagagcuucuugguaccucuugccaccccuucucacugcccugacccaaccccacuggaccuugaugcugcgaggagugguguccugacggacucagcacucccgccugauguauuggaucauaggagagcacuugcucuccugccucugccaggagagggcuuguuccuccaacucuaggaggccaggcaagcauggacaggagccaagggagcagggucauuaacuuuuucuucuuugcaaagugggcacuuggcaucagggucccaaucaccagaaagcaccaaagccccuggcaccccacccacuccauccuacccagggaccccaaguaggcaacuguuauggcaguggguccagcccaggccagcacugccagccuccucucccugcaguaggcaccagcucuaccucccccggcaggcaauguccuggcuucucagcccagcaccaucuguuccccuagacuucucaggggccagcccagucugggccacccuuuguuucccucauccucggcucccacacaggugacagacccagcagauagcuucucucugggaaagguuggaugcugccuuacauccccuucuagcccuccucccauccacacacacaggcacccacccacaccaggucggcuuguuucucacauguagggagagaggggagaccaaccccuuugugucuuuugaaauacgaagaaaaauguguguucaggagcaugacuccagugcugcgcucuugggcccaguucagucugucuugucucaaaucuaggcauuuuugcuucaauuuuauuuuuuuuaagaauacaaaaacagaaaucugcacuaauuuaccugguuucguaggaaaacuuuuuuuuauuuuuuacauuuuuugguguccguuuguauugaauaauuugcuacauuuguaaaauguaagagguauauaauauauguauauuucuaacguaaaaaacauaauuuuuuucuuuucaagauuuuuucuuaaaaagaugagagaaacauauuuuuucaggaaaaacaaacuuuaaaaaaaaaagaggagaaauaaaaccuuuucuccccuuuccccauccucuaucuaucccucuuucccaggaacaaaucaaaagguggauuaucuucugaagaauggaaacuguuaguccagaaugauguguuuuucucaaugcagugaguuauagauucucuaguuuucucccuagggaugggaagggggcauugaggcaagccuggagaggagcccggggagcagggucaugaacuuuuuucuuuagugaaggaggaauacaaucaaggguuuuguauucagaauguugugcaauauuuuggaaugggacauugguguguuuagagauuuuaguuuaaaaacaaaacaaaaagauugaucaaaucuguacaguuucuauuguuccagauuuuuuuaaguuuguauuaaaagcaugauacauaauagccu

SEQ ID NO: 17883 - RNA, 775 nt, Homo sapiens
uagcgaguagcuaggauauaaagaaccgggggaggcggggaagggaggaaaugcaccccacccaggagagggccacucuuggaacugggagaaaaaggagcucuugggcaccccaggagcacagauggcgugagaagaggagcuggggaaaguggggucuggagggaagcuggauggggaaagaaaaugcuggccaggcggggagggagcggcagcaacguggagaguccagcaaagcgggaguggggcgggguggaagagguaguccggccggcugggucucggggcgggccccccgcccgcacgccccccaacucacucacucgggucuccgcggcggcggggcgcucuaccggccgcggggcggcuucucccuccaggguggccugagcgcggggcggaggucgcucuccuuuccuucccgggcgucgccgggccaggggaccgaaguccuuuucgucguugaggguugggggacgaagcagggggcuauggacuaugacucucaauaauuucuuucagcucuuaggaggucgggcucggcagcggggggcccgagggcgggcgggcggacuagcggcgacgacgcggggauggcggaucggagggugguucgugucgcgcaacggcagacgguaugggcugucgccggcagacgguccugcccuccuggccccgcgucgcccgagccacggcuugccucagccaacaacccgcaccuucccgcgccccggcccgaagugagcaaagucaaugaaaaguuucacccuuagca

SEQ ID NO: 17884 - RNA, 564 nt, Homo sapiens
cugucauggcaguugggcuguuaaguuugagcgcucccagucuuuuggcggcaguggugaugcaaaggcucuuggccacccaccuccgcugggaauccagcuucuccaggacuguggucgcccugucugcuguggugggaaaacagcccccggaacugaccguacauuggcaggaggacccagauccugaggacaaaaacuucuaugagaagaacccagacucccauugcuaugacaaggaccccauuuuggacaucuggaacaugugaguugucuucuucuuuggcgucuccauugucccgguccuuggcagcaccuuuguggccuaucugccugauuacaggaugcgagagugggcccacugcagagcugagaugcuugugaaauaccgagaggccaaagaccuucccaucauggaauccaacugcuucaaccccagcacgauccaguugccagaggaugagaacugaccaguugcugaguggagcucaagaagcaccaccuuccccaccccuugccugccauucugaccuaauuaaaggggcugaaagucugaaaaaaaaa

SEQ ID NO: 17885 - RNA, 21990 nt, Homo sapiens
cucacuuugguuaugaaacacuagaaaauaaugacugaggcccgaccugacgccaacugaagaugaacugaccucacaaaguguuuucaucucuaauaucuguggcuauuucuuaccaagagagucucacccuccacacaugggugagaugacauaauggcugauuuggucaaggagcacaaauaagacaggccaggcaguuacuguucaaacagcaauguuuaguuguacaacacauaaagucuagcaacaauuacaggaccaguuugagugucuguuugcuuguuuucaauugggaaauuuaacuguaaugucaccguaagauuggcugggacugguaacauuuaagaaacggguuguucuugcauccccuaggcgugggccucuugcuccaucaggacuugguuguagaugaauggcccacaagucaccagccuuugagcaaguuguguccagguggagacaggaagagggugggcaaaggggaauucuauaaagacacaguguguggggcaguggcagucaacauucgcaaacauucaugcaucugauggggggcuuugcccucccuuggguauuuuccauuagccuacagugaccaccuguggucaggcuaauucauuacucacauuaauggggaaggggguuggggguaggaguagguaggguaggugggaagagaucccucuuauugcugaguggacagaagggugcuaguuuuuccuuagcguguacauauuguggguuucuggggguuuguguguguguuuaguuuuuguuuguuuguuuggacagaagaaagucaacuccagcaaugucuucuuaggaaaaccacucuuccucaguggcugcguuaugagguggggaggauguacaaccgcacucugggacagccacaaguggugauuuuuuaaaaagugauccuagcccuugcuccccaacaucuguagugacccacccucaugaauaucuuuaaguaaugaaggagacacccuugucccacuuuggggcucacacagcugaucucaaugaaucuaguaagcagaaaaauugcuuucuugacccuuuaaggaagccaagaguagcucaugcagaugaauggguagggagcaaugccauugcccuuagagaugguuacaaguagcugggaugggcuuacaagggcagaaggagcucuugaugaguucuuucacccugcagaugggcuaggaccggcugacgcagaugaugcaguagggcuguacuggcagaaccccacuccacugggaggagaggagugguuuggauaaauggaggaugcaacuggccuaaagaggcagcuggccccucccaccuacugagggcugagaggggcugugguggugagcuggacgagcacagcacuaaaaagggcuuggcccugcagcaauaacagcugagaggaauggagugagaagcagcgcuugaaauggccuucauucagcaguggggcaggggguggcuggcacagguggaaggacagugcccaggaggccuucucccugcagggggguugagaacgguugaggguguggagaccagcagcuggcagcagacauauaaaauaccuucuccagggaggcucagaucaugguucaggggugccaggcaccauuccuacucagccuuuccaacgcccaccucccaugcccauagaucuuccccugcugguccaaggucuccauacaggacugcuucuacaguagccaaggaucccuguucuguugaaauguauaaccucugggcuguagcgcugcugcuguucuguccugacaggugccuacccuguaacuuugugagcaagggaggaugagggcuggguuggcagccuccaggaaagaccgagagcauagguuggggucacuggugaccugaucaccgccccccuuucuccugguccauugaaucuugggucuugagucuauguuuuuuuuccuagcaccugagugauaaaagacugggauuauaagugcugggauucauagaggaccagugaaacaccuaggcugaaccaggagaugggacagaagguuguaugagguuauuguaaacaguuucacuuaguguuuucccuucccuaaggcuaaacuguuucccuggccccgaauuucaugaaucuuacagauuaaaggaaaagaguaacuuacuuguacaacaagcaggggaaauauaugcauuaauaaauacagggcuucagggaaaggcaagaaaagccuaaauguaugacgguggguaucauugggaaugucuacaggagucaggaggagagggaauuagggaaaaguagagaaagacagacauaaauaugauuagcuucagcacaaaagugauggggaauagaaaagagaggucaaguauguaugaagcaaauggagcaacagagaagccugcuuagaagggagagaagucugacggagaaaacggagguguggucaaaaauuugucuuugaagccaaauuacuaagaaagacaaauuauguauauuguuucugauacuucuuuagaauuaguucuagaaccugaugucccaauaaaagguugucucacaugacuagcaugugugcuuccuuuaacuggacacugggaacugcauaacucacuguguuucccucuuuacauuggcugccugugagcucagggccuguucaggugcuugacuacagaaacuuucuuuccuauuccuuucuuugacccagauuucucuggcaaucuguuuguacuguccuguaguuuugugauuuuaugugaaaggcagucuaaagucauuucuggaaguagacugggcauaaaugcuaaauauaggaaugaaccuaaaguagauucaucuaaaaggaagugagagaugucagagacacgcaggagagggagagaaagcaauguaugagggaaggagggaaagggagaaagaagacaaagucggaagcagagacaggcaguggccuggcagcagaggccaguugaguggagagcagcaguaggcucuggugacaggugguagcuuugugacacugaacacgacacagacugaaggguggagcuccauuuguaggcacugaugcuuucugcaagaacccagcucuggccuacuucucugccuucucauggccuuccuuuucccaggaagccccagccuuacccccagaccacccccaacuuacaggaggguuguccugaacucccugcccccuacucaggucuagcuccacugccaucuguccuuggagaaucucuauagccccaguuugugugcagguuccgagagaagaguugccuguggcucaccugcucccagcacuuuuaaaugaaaccucccccagaucuccugagugaggcaaacagcuuuguuuugggacacaaggaaaggagacagauaauggacaggcauggaggagccaaacuuacaagggacucuccagggagggcagugaaaauaccucaccccugcaugcacacacacaggcucucucgcucucucucugucacacacacacacacacacacacacacacacacacacacagacaagaugcuccacaaauaccagacaggccugugggacagaguugagaggaagaaggugguugguggugguauuugggaugugugugugugaaguggguaugugugaugacacagagaaguggucgucauggguuacugucguggcuuuccucuguguccacgcucaccggagggaggccuccauugucauugagccgcuuggcccuguaagucucauaguggauguugugugucacuuccuugagguccuggagguggguccuagaggacacagggugagaagaagagggcugcaauuaggggcaggaagaggaggcggugacacacaucacuucgagggacuggacccagugaaugggaaccacucccaggagcuaaggauucuucuacagcaccuuccauuuugcaacaggagcuggaacuggggcagaaagcucugucagagagaccuggagaugcaggaggugaaucugaacagauagacccugaccccaaauaauucaaccugcugucuggacagcuggaggggagacaucuuaccugaugacaaagucucgaagcagggcaaacucacagugguugagguuuuccacuaugaacaaaacaaaacaaagcaaaacagguagucaguucauuaauacagcaacacccaggaggugagcuucuguuugggucacggaggcauuuaggagaaagcuaugggacaggucauuuuuuguaacccuuccagagauuugcucacuuggguguacuggauuugauucauugaacaaauauuaagcagcuacaaugggcacgacauccuucuagacgcuguggcauaauagccaagagggacuauaauuuuuaccauuuuauagaagagaaaacuaauaccaagucugagaaacuggccaaggccuaagauacacuucccauucuucagaagcuuauaauccgguuggaaguaacacagagaaaauaauaauugagccauuuuaaaaaggucaugcacuacaugacaaauccaauucaacauauauugaauaccuaguauuugcaaaucauuggccaagcacuguuggaacagaaugaggauuaagacauggggccaggcgcuguggcucaugccuguaaucccagcacuuugggaggccaagguaggaggauuacuggagcccaggaguuugagaucagccuggguaacacagugagacccccaccucuauuaaaaauaaaaauaaaaucaccaggcauggugguucacaucuguaaucccagcacuuugggaggccaaggcaaauggaucaccugaggucaggaguucaagaccagccugaccaacaugacaaaacuccaucucuacgaaaaauacaaaaauuagcugggcuaauuuuuggggauaaauaaaaaauacaaaaaucgggguccgcaccuguagucccagauacuugggagacuaaggcagaagaauuacuugaaccugggaggcagagguugcagugagcugagauugcgccacugcacuccagccuggaugacagagugagacuccgucucaaaaaaaaaaaaaaucugagucugaaaucaaguuucaccacuaacaaguuaugugcuuuggacaaggcuuuuaaccugagcuuccggugcuuugguagcuuauacucugagaacaggagcacccgcucuccucccuucauaggguuaucauauugaaugaaaucauuaaagugauucuuugaccacuuucagaaucaucaagacccgcccagggucacauccauucauaauaaaauggaaauggcaacaccugaacaacccuccggcaguuugucagaucacaucccccuuccuaugaaaaccuuucuccaguuuuuccaggccuuacuaaucucuccauguucugaacuccuuugaugcgcuaagucagugccacccagucaggugcuaaaucagucucuuguuacuccugccugugagcaucgucuucucaaugagacuguaagcuccuuaugggcagaaucuggcuggcauucauuucauauguccugagacagugccuugaccuauagaugcuuaauaaauggugacuggauaacugaucagcaaccaguucuuccagaagaugcagugaauuaccuucgaugaucccccauggaguuuuucggccgaggacccucuugccauucacuugguacuccuugucacuucccaccacagcaaaaggcaugcucuccugcugcacggggcagaaacacaaaccagacacaugugcaccgucauccuccaacaaccuggacuuucaggagcaggauggcauaugguccucuagccuugaaccacacacuucugaugcucauucagagauacuacugauggcaagggcaaggcucagucucuugaaaagagcacccgacugagauugaagaguccugggucuagucccaauuguaccacugccucacugguuaaccucaggaaucagcucuccuucagcugcagagcgcuuuguacuuucuuuuuugagacagaguucgcucuuguugcccaggcuggagugcaauggcacaauuucaacucacugcaaccuccaccuccuggcuucaagcaauucuccugccucagccucccgaguagcugggauuacaggcaugcgccaccaugccuggcuaauuuuugcagguuuuguagagauaaguuuuugccauguugcccaggcuggucgugaacuccugggcucaagcgauucucccaccuaggccucccaaagugcugggauacaggcaugagucaccacgcccagccaauuuaauuuuuuuaaguuauucuagcgggggaagccuauaagccacucagucuaaccccugcauuucauagaggggaaacuaaggcagggucugaccacagcauagauccuccuggaccccagccugaugcucuuccugccugcugccccucccaucaccccaaauacuguuuuugccagaccuuguuggggaaaaggaggcuuuuauguggucuggggauagaaggcuuucuggguacagggagcccuucuguggguucacaguccagggccauaguccuccccaucccccuaugucacuucuggucugggucaggcaagguuggggggaguacagaaagggaaaagacagacagaggacgugcacaauacacaucccagaggucgcaagggggcaucaguggaggagcagugccccaggcacccacccugauuuugucauucuccgucuuauccuccaaauccucaucaaauuccuucuggggguagaauucaaugccauuuacuucaagcuccuugcgaaccuagaggcgaggagaagaaacaagguagucaagugucaggguaauggaaaagaggggugugugcaccugugugcgugagcugaggucagagagccaaauccagccuuggauaauccacagucaucucugaacucugagacccugagcagcaggaagauggugaauaaaugcaagccccagcuauacaauuacaaccuagccugagaggaggaagaggccaggaggugcaacuucaggucccaggcgccucgcaaccagcuugcucaucucaggguccgcgagacugggauuuacacaagcagcacaggugagcccacuggggagugcucagaccccugcauguuauauuccugauuggaaggaagaaaggugaggcucccccuacuccgagacuguuugcccucuuucaaggucgacuuaagucuugccuucuccaggaaaccauccaggaccucuucauuuucuauuugauuauaaguuuuguuuguuuguuguuuguuuguuuguuugagaccgagucuugcucuguugcccaggcuggaguaccguggugcgaucuuggcucacuacaaccuccaccucccggguuccagugauucuccugccucagccucccuaguagcugggcuuacaggcauaugccaccacgcccagcuaauuuuuguauuuuuaguagaaaugggguuucaccauguuggccaggcuggucucgaacuccugaccuuaggugauccacccgccuuggccucccaaagugcugggauuacaggcgugagccaccgcccccagccaauuguaaguuucuuuuuuuuuuuuuuuuuuuuuuugagauagagugucacuuugucgcccaggcuggaguacaguagcacgaucucagcucacugcaagcgccgccucucggguucaugccauucuccugccucagccuccugaguagcugggacuacaggcacccgccaccacacccggcuaauuuuuuuguauuuuuaguagagacgggguuucaccguguuagccaggauggucuugaucuccugacuucgugauucacccgccucugccucccaaagugcugggauuacaggcaugagccaccacgcccaacuggauuguaaauuucuuaaaggcagcaauugucuuuucauuucucucaaaucgccccuccccaacccuguacauccagcacagggcugagcuuauagaacaugccagugagggcugggcacgguggcucacgccuguaaucccagcacuuugggaggccgaggcgggcagaucacgaggucaggagaucaagacuagccgagaccauccuggcuaacacagugaaaccccaucucuacuaaaaagagaaaaacaaaauuagccaggcgugguggugggugccuguaguccuagcuacucaggaggcugaggcaggagaauggcgugaacccguaaggcggagcuugcagugagccgagaucacgccacugcacuccagccugggcgacagagagagacuccaaaaaaaaaacaaagagaagaugccagugaggacuaguggccaguugacucacuaauuagucuagcccuucaauuaggcuaacguuggaggagugauuucuuauguacacagugauacauguauucaguggucuucacagguagguuuggagggugggaagaaggcagcccagagcugugccaucuuuucuucaucauaguccccagauaccaccaaccucagccucuugaaugguuaagaagggggcugggguggagaauugggggaggguugagggugggggugaaggcagaaugaugagggcuaggagauggccugaacccagcggagagaaaggaggggaugggaacaggaaaagaagacagggggccuucucacccuuugcuugaauucagacuucuccuccagggucauggugucagccuuagcaaugacagggaugauguucacaaccuugcugagguguuucaugaacucaagauccagaggucgcaagcuggggcacagaaaaggcagaaucaucagagccaccuugcccuccccaacucagccaccaccaccacuccaggacacccacaggagaagaggacugggcugggcaucuggcugaggccaagaggcugcuaccucucgucuccgacacagccccacugccuugccgucuguagagcagccucaacaccugccuuuuucuuuuucaguccccuugcagauucugccucucuuuaagccccccucaaaccaccacuucaggacaucuuuucugacucagggauuucuuucuccugggagcaucuguggacuacugucucuacucauauguccuugugcgugugugucuuuuuuccuuuuuugucugucucaaaaacaaaaaacaaacaacaacaaccaaaaaaaaacaacacugugugugucuuuuuuuuuuuuuuuuuuuuugagacagggucucacuuugucacccaggcuggagugcagugauauggucauuggcucacugcagccuugaccuccagggcucaagcaauccucccaccucagccuccagaggagcugggaccacaguugcgcacuaccaugucuggcuaauuuuuaaauuuuguguagagacaaugucuugccauguugcccacgcuggucuugaacuccuggacucaagcaaucuuccugccucggcuucccaaagugcugggauuauaggcgagagccaccgugccuaguguguacaucuuguucugccuaucagacuacuucuugacaggucuccuccuagcccccagaguuaguccugcagggccaaacuggaggccuugcccuucccacaaucugacagucuaugcccccauccuaccucaggcucugagaccccaacuuggcucuauuuugcaaucucagggacucacuaagucagucugucugaugguucauucugaccagggggucgaagccuagggagggauaaaaccagccuucuguugaguuccugggucuagcccaggggucuuguuucaucucucuucucccccuaccaucacugccugguuccuagaaaauuuggggcuuaccuugcuugugccauccucugaagagcuuaacucuggcccagcagcugggcuuaguaauguuaugggaccccccucccccggucucugcaggaagguuucuggccugcccccuaggaucuccauccucugccuguucccagcacuuccuucauggggcccaccugucacucacaaucagaguucccaacaugcuugugugugucuuauucugccuaucagauaguacuucaugacaaugguuggccuucaucucugaacacacaaugccucacuccaggcugguaccuucuaaaugccuacaacugggucccuacccuccaaacaccagccccaauccaggagcccugcacugcccuauuucacccuucuugcugcucccuccgacuccaauuauuuuccaaagcagguauuuggugaauaaaugaagugcccucugcucacauucaccaaguccucuuugcugauacaguugugccaugcugcugggacaccagugggcagauauugguggcugauguuggacagcuuuaaccuccuagcaagaaagucaaacuuccucguggaaagucuagggaaucccaaggucaugggccaugacuauguaccaacccaucuggcuggaagggcuaggacucagcuagggaggccuagcugagucaacguauggaucauccaauccagaugggcacagaugauacaaaccagaccaggccugacaauagggguaggguugguacauacgaguguccugugggagagaugaaguaaaggcagcaguggacacgagugucagggaugcguuucuuccuggcgauguugaccuccuccuucaggaacuucucguacugcucauugauguacuucucaaugggcucccagcugauggggagggaaaguagauagaugcaucagaagaacaagaccuagggcucagcuuaggcaugaucugguagcaaucuccuuacauucaugucauucccugguuggugggccuaggauaccugcugccagauucccccucagcccccgcaccgauggcuuuccuggaugguuaguuagcagggguggagcuccccaggggcccuggccugggcugucgggaacuacagagcauggagggugcagaugguucucaacgugaaugaaucugcaccauaguaaguaucuucccagcagagucuuuagggcaaagaucucagaggcagacagauaccaguuuucauuguugauuuggucuccaaagccuggggugucgaugacggucagcuucauuuugacaccgccuuccucuaucacugggggugaaaagaaaauguaccagagaggucaguccuacagcugaccccagguaccuggcagccuacuagccagggagacccaggccuugucuucaggaucaguuauuggaaaagucaaauuuagggucuuuuccaucucgauaucauggcuuaugcuguucccuguaccuggaaucuggaauacccucucuacucauuucuuuuucuucuucuuuuauuuuuuuuaagagacagggucucacucugucacccaggcuagagugcaguggugcaaucacagcucacuguagccucgaacuccccagcucaagugaugcugucgccucagccuccccaauagcuaggacuacagauaugcaccaucauacccagcuaauuuuuuuuuuaagagacaggguuucgggccgggcgugguugcucacgccuguuaucccagcaguuugggaggccaaggcaggcggaucacgagcucaggagaucaagaccauccuggcuaacacagugaaaccccaucucuacuaaaaauacaaaaaaaauuagccgggcgugguggcgggugccuguagucccagcuacucaggaggcugaggcaggagaauggcgugaacccgggagguggagcuugcagugagccgagaucgcaccacugcacuccagccugggcgacaaagcaagacuccgucucaaaaaaacaaacaacaaacaaacaaaaaaagagacaggguuucacuguguugaccaagauggucucgaacuccaugacucaagcgauccucccacuuuggccucccgaagugcugggauuacaggcaugagccaccguaccugcccacuccuuaccucuuucuaccugucuaaauccuguacuuuaucauccaccucaaaucucaccuccuuccauucgagcucccugcucucucuucccugaaccugcagucuaaggaguuugcuucagagugaagugcucacgucuguuuugucuuaagguugccuuuuauugaucuuauucuucaauaagccccauucuuuccccuuuccagcagaggcacucacugaacaaagcccauaggggucccugccugguccucaccaugcccgauagcuuugaucuccacugucuuggggaucuucuccucccgguuccagcuggaggccuugcggcucacuugggauuugaagagcguguugaccagcguugauuugcccaguccacucuggccuacagcaaagcaggaggaggagguagggagacucugcauccaccuccugagccuaauauuucuccauaagcuuacagaauucuagagccaugauccaggccacaccuugucugaccacucacugggggauggccaggcugaguggggauugcaggcaggugggaauggcuuccugcuuacugcagagggccuuggggaaacaucacuuggauuccauauucucuccuucccagagccacaggaccacugggaaaagggacaaccucugcauaugucuagugucgugguuuucuguuuucucgugauuccauuuuuugcuuagguuuucacuuuuuaaugauacuaaaaggaaaaauagaaugacuuugcauccugauacugccucacagugcauauuguacauucacauuuguuagccaaauucauuuuuauaucagcccuguggauccugaagcagaacuaucuuuauccucaguugagaugguccuagagagaugaauccucuucuaacaaaauaugugcagagcaacauaacuaauacaugcaagaccaggaacucaaacccuaauaacaucuuggcucuauauccacucuuucuucuaguguagugguuuuuagauugugcucccagaagccuuaguguccugugaagauacaugccagagagggcacugugagaggaggaggaggcugggcaggcagggccccugcauccacuuccuucgcuauggcucccuuucaccuguuuuccagaugcauaucugcagaagauuucauuucaaggaaaaguuucacagcuaaagaacauuugaaaaccacuggucaggccguuugccguggcucacaccuguaaucccagcacuuugggaggccgagacaggcggaucaugaggucaggaggagaucgaguccauccuggcuaacacggugaaacaccgucucuucuaaaaaaaauacaaaaaauuagcccggcgugguggcaggcgccuguagucccagcuacucaggaggcugaggcaggagaauggcaugaaccugggaggcagagcuugcagugagcugagaucgcgccacugcgcuccagccugggcgacagagcgagacuccgucucaaaaaaaaaaaaaaaaaaaaaaaaagggaaaaccacuggucaggccaggugcaguggcucaugccuguaaucccagcacuuuggaaggccaaggcgggcagaucacuugaggccaggaguucgagaccagccuggccaacauggugaaacccugucuccacuaaaaauacaaaaauuagccgggcaugguggcacaugccuguaguccuagcuacucaggaggcugcggaucguuugaacccaggaggcagaggcuguagugagccgggaucacgcaacuguacuccagccugggcaacacagcgagacucugucucaaaagaaacaaacccacuggucugagcagagcuucucaaacuucaacacguacaagaaucccacaagaaagacuugcaauugacaagcagccucggcauugcccggacacuaguaggaaaugcagaaucucaggccccaccccagaccuaugauucugaaucugcauuuuaacugggcuuccagaagaguccuauggacaauaagaucuaagaaauacugggcuggugaauucuugugauuauauuagaaaaagaaccaugcugggggacaagggccuagaguuccagacccaccugcauuguuuucccugaaugccuuuggauuagucaugccuugguuucuuuacugauaggauggugaggagagaggaaauuggacaagaccagggaugguaaauaaggugcauuucucauuccugcugauuaucugguaguagucaccuagaccauuauguuaaaaaggcuacaucugggcucagcacugaacacgugccaugacugacuagcagucugccaugcacaccacuggggagagaaguggcucacggguguuggauuugccaugcuugcucugagauguuuucuaagagcauucauucauuaauuauucuuaggugccaaguguuguccuaaaauuuggagguacuaucgugaacaaaacaugauccuuacccucaaggagcugcuuagugugagagugaccaaaacauaagcagacaauuauaguauguugcaauaaccacugugaaagagaauagccacaggguauugaaacagcauugccaagggaauccaacccagucucucugggacuaaggaagacuucuggagaaaugcaacuaagcugaaaccggaagguugauuucaaaagagucaugaguucuagccagagggaacagcagaugcaaaagcucuaggguaggagagagcauggcauguggacgagcacugccucuucugagugaggaguacaaugcuagaugggaaguggucagagaugagcugaagagguacaaucaggacagucuacgaguuuaaacuuacccugagguuaaaggagaguuuguuacagaguuuuaaguaaguugggugacucgauaaguuuugcaaggugggaagauuauuuggucacugguggacaagggauuggagaggaaaggagacagagagcuaggaggguuggugccacuccgaguguggcccauaggggcccagcuaccagggucccugacccauuugcuacugguucuugagauaagaagucugccucaggagagaaaucuaccuugucacugagcacacuguuuagcucaguggagguuuuuuauagcaagauuuuccagaugauuuauacucuggcccaagccccagcugagcuuaucuugcugcaggucagcacuuugacagcacagagucagguggccacggcaagccaggugagagaaagucaguauaggguggcagcaagagagaggagagaagugggcagacguaagagauacguaugagguaaaauggacaggacuggaugacugauugggggaugaaggaggaagaggacagaaggaugacgccagauuccuuuuucagcacugacuggacaucucacugagacggggcaaaggucccuuccuacucuuuuuuuuuucuucuuuuuuuuuugagauggaguuucacucuuguugcccaggcugggguccaauggugcagucucagcucacugcaaccuccaccucccagguucaagugauucuccugccucagccuccagaguagcugggauuacaagcaugugccaucaugcccagcuaauuuuuuuguauuuuuaauagagacaggguuucaccauguuggucaggcuagucucaaacuccuguccucaggugauccacccaccucggccucccaaagugcugggauuacaggcgugagccaccaugcccagccccuuccuacucuuacauucugugacgcagugaugcuacucagugaccaaaucccuggaaauucucucaaaaucuuuuuuguuuuuuguuuuuuguuuugaggcggaguuucacucuuguugcccaggcuggagugcaauggcgugaucucagcucacugcaaccuccaccucccggguucgagcgauucuccugcuucagccucccgaguagcugcgauuacaggcaugcgccaucacaccuggcugauuuuguauuuuuagcagagaugggguuucuccauguuggucaggcuggucucaaacucccgaccucaggugaucugcccaccucagccucccaaagugcugggauuacaggugugagccaccacacccggccuucucucaaaguuuuaaagcacuacaaaagaguagaaauaagaccacccuucauccaauccuuccaccagcucucagagguaaggaagaacauugcugauucucucaugucacaaacccaaaagcaggaucagaguggugaaggggcugccuguguacaccgagcuggugauggggggcugggcuggcauccaccugaagcuccuaccccugggucagcuagucuuaaggggagacaggggucaggccuuugugaucagcauggugaaauucucccuucuacaaacagcucaucuuagaagagccagggucacagccauuugggggaaagaaaugggauccuuggugcugcccgccaccaggccugcagcagccccacagccuuccguaccaacgaccaugauguugaagucgaaaccggucuucauggucuucuugcgcaucugcucgaugauggugucgaugccgauguagcccagcagguuggaguugaugcucaugggcuucaugggcaccgcuggcuuaggccugggcucaggcaccagcucugacauggcugcguccguccuggucucugggagcccugcagagccaaggugggaggggucggaggggugaucaggaggacggcagaggucacauggaaaccaugguauuuuucucuugcuacagaaucauacaaaguugggccuggaagggaucuuaguaucauccaguccaggucccucauuucauagacaaagagacugaggccuggaggagaaagaacucaacuaagaacacagagcaggucagagguaaaaucugggccagugccagguucucugguugcugggcacuuucaaaugcaccucacugcucugaagcccacaucugugcaucuaacccaggggcugcuccaucuuggcacuaaugacauuugaguaauuauugugggaggcugucacaugcauuacaggaugauuaguggcaccccugaucuuaguagccccccaggcugugacaacccaaaaugucucuagaugguaccaaauguccccugggaagcaccauugcccuggcugagaaccacuggucuaagaaaugucugggguuguucagaccugagucaugccucccuccccgaauaaagggcaaagacuuuuuaggauccugcacuaacaucuauuaacugucacugaccucggcugcuucaucuuuuagaagcaaacagggcuacccuucucuggagaguggcuaucacucucgucucccagccucgauguccccucuguaccaugagcaccacugcagaguaggggugucuguaccugaaggagcccagacacccucccagccauuguucugaaucuguggaaccaguggggaggggaugagaaccagaugagggcagucacuugccuaagacgacacagugugcucuuggagugguggauagcagaugaaagagaaggcugaggaaccagccccucccuagugaggaagggcaaacgucccccuggguuuaguggaucauggguguguucauacacaggagaaaucuguggguuuccuuaucaggccacuguccaccagggcagguuccagaauagagcaccuccauuuccccauccauacaauugggguauggggugaaguggaaagagccuggcucugcuacuucucagcuuuguggacuugggaagaccaccuccccacuaugagccugcaucccucucuauaaaauggaaagaucaucacuaagacuguggugagcuuucaugagacaugaugcuuagaagcacugagcaauggccgggcgcgguggcucacgccuguaaucccagcacuuugggaggccaaggcaggcggaucaugaggucaggaguucgagaccagccugaucaacauagugaaacccugucucuauuaaaaauacaaaaauuagccaggcaugguggcaggcgccuguaauccuagcuacucaggaggcugaggcaggagaauugcuugaaaucggaaggcggaguugcagugagccgagaucgugccacugcacucuagccugagcaaaagagucaaacucugucuccaaaaaaaaaaaaaaaaaaaaaaaaaaggcacugagcaauaucuuacagucccagacccuuuugccccagccccuuucaggucuguaggggaaaugaaacaguacaugugaaagcauugguuaaaggaagguguccccagaugccaguuacacaagcaugguuguuggacuccaugugcucuugaggacaccuuccagcucugccguucuagaauccuauguuucaugacuaacacccugcagagucucaaccuuacagggaggccugauggagcagcagaugggcgggagggagaggggacagaaguauucccuucccaccccuaaacccagccaggagccuacucucaucucccuccaccugguccuuccaccgguacugguaagacccucucucccaaugggaaacuguucuuucuucugucacucccaggcacagccaaaucugccaaagccucaggaccuccccagggccuggcauggcucucucuugcuucccaggaagcuguucccagccaggcagcuccgcauggcagcaagauuggcccagcccugcagcagcugacucucagcagccuggcccugcuccuccacucuugcacguggcucacaggccccacucagcacaccugcacugggaccaaugccccauuuuuccugcccagcugcucacacaagcugggccuuuccauugccccuuaugccucugcagcugagcccauuuggucucaaccuguguuauaagauagagccacaugguuuggggggguggucuuauccccauuuuacagacuuggaaaguaugccuuguauuuacuuaugagagguuguguaaagauuccuauaaagugugugcucucaccauggccugcuccgcccuggccugucaacugcagcauccuaaaagagcacgcccaaaagauagacccugauggagagaggguccuaccagauccccaagcagcaucuaggggcuaccacaggcccacuacaggaccaggaccugguagaucucacuuucauuccuccaacaagcacauaugagcacccacugugugcacuguacacagcgccugcuggcaagucagccuccccaccacaugccagugacaugccagucacaugcuaacaagccacccaccagccccaaguacaguaaaugugugcaggucacugugccacaagcuuugcuggaagauccuguucccccuccaaccccuggcucccuccuccuccuccuccuccuccuccuccuccuccuccagcauucagccccacugcuacucccaggaaagccucugcuuugccuucugauguggauggcccucuucugugcccacugcacauuuucugguacucaucacauucacucauucauucauuccaucccaucuaggccauuucauaugcugucaaaugggggucuacaccagccaagcccuaggcgaaauuccaaggacacuuauguaccccagacaagguuguugcccuugagggcccccugucugguaagggugccugacaaauaaacaaagaccucuggggcacagaaccaaugcugcucuggagcuggauucuguaguuccauccucugucccuacaacuccccuggucccaccaugucaacgucagaugggcaggugacccaggcuugaauccuggcugggugacccuuaugagccucauuuucugcucagacaacuggggauagaaccuaccuugcuggguuucuaugaagguuauacagaaugaagaauguaaauuaucuggcacaaauacguacuaguucucacccuucuuuagggcggggccgugucuuauugaucucugugccccagucuacccagcauaccacaggcacuccucaauaagugaaugaaugaaugaugagugaaugagaacuucagagugaggcagguaucagacacaucaccuuucucuucccucagaugcuucuccccaugcagagcagcugaccccccagugagcaauggcuguugucuccgccacagucaagggaguagaauuguugagaccuccuccuuccucugcaacaaggauuggaggggggcuccccaaggguggggaagagcucgggucacagcagggugcagcucaagucugccauccuggcuagaugguccuuggggccccccucagcuccuggcucuccuagggccccuggagaagggggaucugccugcagcacccucugccagaagcuaccugccccaucagugcuccagggagaggcaccauccaccugacucgguugcagccaagaaacagccccuccauucccaugcuaagcaaagacccuggcacuuccuuuuacaggcaaaugaauggcuuuggcuuugucuggcccagggaccccaccccuguguuaggaagguagcagcugggggaggguacuuuuccaaaauagcaccugcuuagugcaggcccccccucuuccuuccacccugaagauggaucuuccucagccccccgcagccuucaggaccccaccgccccccacaaaggcaauuccagcccaccccaguuccagcccuaggcucugggaaaaggaaucacgaaagcucucucgguccuuucccauucgcaggagcagagggcccugggacacccguucccccaucccaguccucuggaggccaacggguucccuuggagaccaccagcuggugccugucucagcgugugccuguagggguugcgggggaggggacguauguaucagugcacaggucucucauccggcuggcauggcccuggcaccugugcguggugugugugugugugcgugucuugguguacuccagcauggggcuuucugugcgcaucugggucccugcuugcguguccgugggucccugcgucuccccgcguccuaugucugccucucuccaagauugucucucucgaggugggugccaccgugugugcguguguccgcgcaucugucaccgcgcgugggcuccucggcgcggaaacccucccccaggagcgccuccagccgcgcuggccggggccgcagccuccuccuggcgggugccgguggccuggccggccgcccuaccuuuggacaugaauccuccuuugucuccguuccuccagggagaugcuccgggcgcggggcugcaaggcugagcggggcgcgggcuuccccgggccgagcggccccugcaaacgggccucgccccuucgcgcucuccucccacccgcccggcccgcggccccgccgcgccgccccugcgccccgcgccgccgcgcccuccccgggaccucgccucggcucgcucggcgccgcgccgccccuguccgcgcgcaccguugccgccgccgccagccgccgccgcugccacccgcaccacgugaccgcgcgcccgucggccccgccgagggccccuccccuucccgcggcgcccgcgcccgcaagcgggaacuggucccggguccacgcugcgggcgguccaggagccgcccccgcgggcuccaggugccaggcccggaaaggugccugcaucccagucccgucucuccccgcuggaccugcuccccgccccuuacccacugggcugcggcggggacgggcggaggggcgcaggggaccaguggcagcugcgggcggccgugagcgcgcgugagucacgcgggggcugggguguugcgcgggugccuguagagccgagucaggggcccggguuccaggcccugcucca

SEQ ID NO: 17886 - RNA, 12443 nt, Homo sapiens
cccgcccugcgugcuagcgaggcaggcauuggcagaacggacucggggcuguccuucguggcccggaccccgcgaggccuguccuuccaccucuguggggaccaagagggcaaggaucgugccaggcucaccgugggcgcucaguaagcggccgugcagaggacgguugagggcuuugugcagaggaaaugagagacugcucugaagcaaggcccgccuagugagcugcuaggaaaauggaagucugggauuaaucgucucuacaaggagggugcgugggaggcaccaaagcaggcggucacagcucccgcaaaggcagccggcucuccuuccccgccugacgcucagggacuacucgcacagacugggcuacuuccuucuucauucauucaucaaguauuuauugagaaacugcuaagugccaaaugcuuuguucugggcauuguaggggcagaaaggugugauauuuucccuuacucaucccaaaggucacagcggacacuccuacaaauaaaauauagguuagcaagagaaaagcauaauagauugauuuacucaauguuuuaugugacuugagagccuucaggaaugaagacacaaauacucagggaaaucuuuauuuuuaugucucgguuugaugaagaauggacagcccuggccgggucugguggcucaugccuguaaucccagcacuuuggaaggcugaggcagggggaucgcuugaggccagacauuuaaggacagucugggcaacauagugagacccugucucuacaaaaaauuaaaaagccaggcaggugccuguggucccagcuacucgggaggcugaggugggaggauugcuugaguccaggaggucgagguugcagugagcugugauugugucacuguacuccagcccgggcaacagaaaaaaaaaaaaaggaauaaggaauggacaacuguguauaaacgcgauuagacaaaagggaaugauuuaauguuaauagcugaguguggaaacccagcaaugucuguucagauucggauucuucuuguucucucuguguggcauucccuccugcugggaggagggcaggaccccuucuggaaugagagucuuaugaccuaguaucaggcaagguagaucagagaauuccuuuauggccaggcccgacacagaaaggugggggauguuuccaguaauauuuguaguuacuuuuuuuucuuuuuuuuuuucuuuugagacagagucucccucugucaccaggcuggagugcaguggcgcgaucucugcucacugcaaccuccgccgcccagguucaagcgauucuccugccucagccucccaaguaguugggacuacaggcgcacgccaccaugcccagcuaauuuuuguauuuuuaguagagaugggguuucaccauguuggccaggauggucuugaucucuugaccucgugauccgcccaccucagccucccaaagugcugggauuacaggcaugagccacugugcccagccaauauuuguaguugcuauaacucaccuuagggaggaggauuuuuaguuucuauggccugccuugcaggagaaaaacaggagaaagaaggggggcaggagaaggucagagagauacuuugcuucugaggcucuuccaguguccuuugguucaaaguacucagcaugcccaagugccauauuuuuaggcaucgcuuucugagccccaacagcaccuucacucagauggccacugggugucucaaacauaacccagaccaagcaccggccacuuuccacaucucagauaaugacaacucuccuaggugcucaagccaaaacugugcaguccugccugcucuuucccucacuccccacauccaacuccucagcaaauccuguguucucuaccuucaacagccauucuaauucuggcugccucucccuccccgcucuugccgcguuugugacaucucgccuggauaguggcagcaggcuccucacuggucuccagccuccacugacauugauucucaccacagaagccagaguaugccuugaaaucgcucaggucccuccucacagcccugucuagaguaacagcccucccagauuuacagagccccaucccaccccuucuacccccaccuccuacugucugccccuccccaggccucccagccucacuggccuucuugcagguccucaagcacaacaggccugagggccacugcgcugacuguucccucugccuggaauuggcauggcuggcucccucauuuccuucaaguauuuguccaauguuacuuucucagugaggccuacccugaccacucuauuugcaauugcaaccucccuacucccacaauuucccaucucccuuacccuccucuguuuuuccaugccacuuauuaucuucuaacacauuuauuaugguguacaguauuaacugaauaaaauuuaguaggggagacaggcaauaaacaagaaaauaaaagcaugagcauaggaaaguuuacucuagcagugagugcucugauggaaauaacaccccagggaugggacagagacugcagggcagguugcuuuacaauggucccagaggagaccacugagcagagacucaaaucuguguccagaggcguccugaggaguggagcugcgguugggggugggaaggaaggccauucuaggcugcaggaacugcaagggcaaaggcucugaggcgggagccagguucaugggcagauguuugaggacaccuccggcuuccagggccuuccagaaguuccagucucuuggguuugguugugcauuccugcgaccuucaccgcaggccuccuccuccacccacuagugcagagccugggggcugccgguggguuucaggccagggaagcagaaauggguaauuuccagaggcagaaaucagccgaccccgguggcccgguggguggccaacaaagcuuggcuggcccucgcgggcuguguaggagcccacccuagggagguacccagagacaucccugguuuggcucugccgggaaagugggccgagcagggagagggggaccagagaggaagagauggacagaguuuuccggacggugggcuggguccgaggcccgcggaccguccgaggggggccucuggguucgaggccgcccgcaccgaccagugcuguggcucgggcaguucaccgcccucucgggccucaguuucccgcccuggcagaccucgaggcggccucggagaucccgggccuggcgaauacugggcggggaggggcguuaacuccagccucccgggcggggucucccggcucccgcggccacguugcagcccaggcggaggcgcgggaucucgagcugggaucgcccucuugggcuucggugcgaucggcggcgggaggugagagugggcccggcgggcuccgggaggagguggccccagggaagguguggccgcggggaaguggcggcgaacagccccgacgcgaggacggggaaaccaaggcggcagccagggagacccugaccgaggugaccucuguuuagggcgacaaccggguuggggcuccccgcaguggccacuggcccggcggucccgcacccccagcccgccucuccuccaacaaaagaauccaggaagacgguggggcgggcgggaggcccggugugcgguggccuggccccccuacugguggagaggagggagcgcccuuccccagacgcgggggaggggaggggucauggccccacgggcugcccacccccucccugugccccagugcugggcccaggacccccagugaggccacuccucuggcaaacaucugugaucucuucccccuuccugggcccccccuacuggaauggcgucucuccccauccaggggccuggcuuguuuuucuccauaacccuuagcauuaccgguccuuauguuaucucuuauuucacuaauuauucuuucauuaauuuauuaguauuuauuuuguuugccuacaguguguuucccccugugggaauguaggcuccaggagggcgggagacuucgauuuguccacugauguauccccauuaauucaacagaucccuccugagggccucucugagcccugcacggugcuggguauugggguucuccugggaacuuagcugagccccacccuagacauucuggggcugggaacagugcuguaaacacauaugacaucgucgugggaugaaggaaacaaaccagaaaugggggggucuacuggucaggugaccuuaggucaggccaccuugguggucagggccaccuuagaugauauggugaucauggaaggccucccagauuaggugacuucaguuaaagccaggaagugcuagaagggaaaagcuaggaaccaugagggcauguguagcucugaccuggacucaggcagggagcuggggucugaagaguaaaggucaagacaaggggacccauccccuuaagcugcucagggguuccuggcuggguggauggguggggggauucucaggggucagggaaggcuucccgguggaggcugugguuucauuaggccucgaagguggaguaggaguucucauucuuugggauaagcugacugggcuugagaauuguuuugcagguucccugggaaccagguggucgaagggcugagcuguguggccagacaagaggucccugcccucccccagugagcccugcugguaaguggguacagugugagggauuugggagacgaagcucugcgucucauuggccauguaaccuugggcaaguuccccucacugcgcugggccuugguuuuccaugaguaaggacagcuggacuaagugccguucaugaugcugggggcacccacauucaauggcugugguuagcucuucucagcuguacccuggguuugugccacacucuuguguacagaguagcuccccaucuggcccugaaggcugcagauugagacagaaaaauaauguuuuaucugaggaauuggagccccuuuaaauaaucaggcccagacauacugaaacgcaacagcugucaagucuuacuccucccuugagcuaaagaauuaucucuuuuucuuuuuuuuucuuuucuuuucuucaugucagaucgguaaugugccuacaugguaacaagguucgaggguggcacagcucacacaugcaugugaacacccaaucaucacgcucaugaacuacaaaaggaucaagaauuaccucuugaagccacuugcuauguggcucuagagugacaccaaguagccauaaaaugcuguacacuggacacccuauaguucauacccuauaguucaacaauguauagccaaucacuaaucaauguuauuucuuuuuuuuuuuuugagauggaguuucucucuugucacccagguggagugcaauggcacaaucuuggcucacugcaaccucugccuccugggaucaagcaauucuccugccucagccucccgaguagcugggauuacaggcacccaccaccgugccuggcuaauuuuuguauuuagagacgggguuucaccauguuggccaggcuggucuccaacuccugagcucaggugauccacccaccucggccucccaaagugcugggauuacagaugugagccaccgcaccccaccaaucaauguuauuucuauaaaccaaggagaauuccugccaaacaacuuugucauccuugcccccuucugccuauaaaaaccuguaggaaaggcccaacgcagcacaccccacggcaacuuagaaguuuguucugggcaguuauccuuacucucgcucaaguaaacucuuuaaaguuauauuugugccucagcuucugccuguaggucaauaagauucaacagcuauaugcaaauaagaggccaguagaggcccaggagggucauggaaacccuggaagcuuggccucagaguuggaguugagaggaccccagaugaggggauaguuuaagcacagugguuucgaugggucugggguccauuucagcucagcuggggccuguuucuuuggauuuuagaaagccgugcccagguccugccaugccuccugucugaugcaaucucguuauucuuuucucgaaguccgccaguguccaguuuuuuuugcaugauccucacgacaucccuuugagagaaaaggaaggaaagacgagcccacuucucaggagacuuuagggaccuuagggacacagcaagcgaguaggagucccagggcugggguccagguugccucuggagccggugcuguuccccaggagggcacggaaccaccucccucucugaucugcugccaucucucuugccucacaguucccgugggagccaugaagcugaacgagaggaguguagcccacuaugcacucagcgacuccccagcggaccacaugggcuuccugcgcaccugggggggcccagggaccccaccgacccccaguggcacuggccgaagaugcugguuuguccucaagggcaaccugcuauucuccuuugagagucgcgagggccgggccccacugagccugguggugcuggaaggcugcacaguggaacuggccgaggcucccgugcccgaggaguuugccuuugccaucugcuuugaugccccuggagugcgcccacaccugcuggccgcagaagggccggcggcccaggaggccugggugaaggugcugucccgggcaagcuuuggcuacaugcgccuggugguacgcgaguuggagagccaguugcaggacgcacgccagagccuggcuuugcaacgccgcucauccuggaagucuguugccagccgcuguaagccccaggcuccuaaccaccgagcugcgggccuggagaauggccacugccucuccaaggacagcagcccugugggcuugguugaagaagcgggcagcaggucugcaggguggggguuggcugagugggagcugcagggcccugccagccuccuccuaggcaaggggcagagcccuguguccccugagaccuccugcuucucuacccugcaugacugguauggccaggagaucguggagcugcggcaguguuggcagaagagggcccaggggagccacucaaaaugugaggaacaggauaggcccuaagucugggcccuuugagucaggaaaccagggccaguucuuuuucaggaguuaaauguuuacccauuuccaagguugcguuuugggaggggacauggguucucuccuuccugcuauuuaggcauucuccagguucgagauccacccgugugucuggaagggacugcgggaccauuccuuccauccucuuuauuuccugagguccagagaaggaaggagacuuagcagccacagagcaagaccccaaucuccugacugcacuggccugacugcccccucccaggggauguuaaugaaaugaaggaaguggggaaugucacccgagacugucacaggcuugccauaccuuuggccuacacaccgggcucuagagccauaauuuccaaccuggggagucuccugugcacuuaaauccgagguaggcugcaguaucggcuugaagcucugacacugucagagaaaguggauuuauugugucauaggaguuucugggacccagcucuuccugagaggggugggaagauuggggaugggauccucacucagcagucuggguagggcccuuugaggcagagggucuucggccagugaagagagauuuauucugcucagagugcuggggucccauccuuucucccuggcugcccuguuaacagauggugcuggaccuugccccggaaggggcuuguagcuuuuuuacgucaacgaaaugcccuccuguacucugucuucagcagccaacuccuggagcugccaagugagggguuaaagaagagguggggaggcaguguggcucccugggaaaagucuguugcuuugguucucaguccuggguauucuaggagcuuggacacgggauugcguuuccugugcuaaaauucucucuccuggcugggcuccgguaaacugaagcugcucgagaaaucaccugggaacucucauagccguuugucacccaggguguacuugccaggaccucuccuugcuacucuucccaaagucgggaggcaaagcggcugggucaccagagccugaccauacugacgcuccagggggaagacgcagaggccgggaagagacacccccucccaaacacauaaaacuugccccuuccuagccucggcuccccucacuggggccuugggcaggaccgacccgcauccaacuaggccuaagggguaggcucugagccucuuaccccuaagaggcggagaugcgcccaaggcgggcgcccggccuguuccccagcccugccuggaagccccgcagccacugcauuuuguuuaaacacagauagcacgggccuuucucuuauugcuacaguguuuuguacacgguuaaaacacuaguaaagcuuuuucguuauuacuccuuccgcucccuggguuuauuuccacaaccggccgcugaggccuguucugacggccgggcggacccaagaccgcggccacgcccagcaggacgcggacugagggagccggggcugcgccgccacucucgugacgccaccaugccggccagugacaaacaccucccucccgccgccccaggagccgccggcacugcgcgagugggagggcugggcuucucguguacuccucaaacucucgcgaggcuucgggcggcuuucuucccgagggcggcacgagggcugggcgguggggugcgggugcccgggugaggggcggagcugggggcauggcguccggagcggcucgcuggcuaguauuggcacccgucagguccggggcucuccggagcgggccuagcuugaggaaagauggcgaugucuccgccgcauggagcggcucaggccggagccugguaccgucgaggucagucaucguuacccgcagcggcgccauuuugcccaaaccggugaaagugaguguccuccuggagacggggcgaaggggcugaggccaaucauuguggggagugcgugagggcggcgcugauugauaggagccaaggccaaucauaacgauuaccguagacuggaaggcggaccaagaauacgcuaaugaguugcuaauuuugacagguguguagaaaaugguagguagacagaagauggggggcaaacgcugaggaaguuggccuuuuacauuagcuuguccugagaggugcggugcucugcuccucuggagucagaagacuaggccgugugcuucuagcuuagagcaguccuguaaucucugcccugccugucuccuaguuuaugggaugaaauaugaauuuugaaaggacucuguaaauaaaggguacgugggacgggccucaucuuuuuauuaguugucaccuaauauuuaauucaugugauuuacaguccugauagaugugcagggaauuauuacaaucacggguuuucaaaugaagaaucgggcuagagcggugaagcucguauccaaggccagcgcugaggacgcagcauccggguuucuuccugguaccguccccaccagguccugucuuuuuccaacacugaacgcuaucacaugcuugaguuuuucuagggaaaacggaaacagucccuuauaucaagcgaaaguuugcuuuacgacugcagggcuguguggugugggaguuaaaaaaacaaauucucuuaaagcuagucuagccuaugcuaacucacacaauugacuguagguccauguugggaaagaccugccuuaucaaaacaguugaaaaaaaaauuuuuuuaauucuaggaauacgagagaaauguugcugagauuuuacugacauucucccaauccaucuaaagucuuugaguguaaauacaugcccacuuucaaauacaucuguuucuaaaauuuuuaaaucaaauuucucaggcaucagggaaccuguuacuuagugaacuguguagaauaucccuucacuguacaucuuucugucaucgguuuucguguauuucguguucaggcagagcucaccguagucuggcccuccuaguacuggugcacccgauugccuguagggauuuaaaguaauuagcaggcuguguccuaacuuuagaugucuagggugccuuagacuuuucuuuccaguggacuuuucguccauuuugauggccauaacagucaccuuaucuccuuuuuuuuuuuuuugagacggagucucacucugucacccaggcuggaguacaguggcacaaucuuggcucacugcagccuccgccucccggguucaagugauucuucugccucagccuucugaguagcugggacuacaggcauguaccaccacacccggcuaauuuuuuguauuuuuaguagagacgggguuucacuauguuagccaggcugauuucgaacuucugaccucgugauccgcccgccucagccucccaaagugcugggauuacaggugugagccacugcgcccggccuuuugucuuuuuuuuagacagagccucacucugucucccaggcuggaguggaauggugcaaucuuggcucacugcaacuucugccuccuggauucaagcaauuauccugccucagccucccgaguagcugggauuacaggugcgcaccaccaugcugggucaauuuuuuguauuuuuaguagagacgggauuucaccauguuggccaggcuggucucaagcuccugaccucaggugguccacccaccucagccucccaaagugcugggauuaaaggugugagccacccugccuggccuucuccuuuucuaauuacuuuucuugcccugaauuuuuccaaggacuuuaaaaucaaguugcuuaugaugggucugaggguaugucugugagagggccaggucuucuuugguccugccagagugggcucuggagcucacagcugccacucugacccucugcagauguccuucggccuucuccguguguucuccauugugauccccuuucucuaugucgggacacucauuagcaagaacuuugcugcucuacuugaggaacaugacauuuuuguuccagaggaugaugaugaugaugacuaacagguaagacuugcuuuacccuagauggagcaggaagcaggguggagcaucugucugugaugcagucuggccugguagcagcauuuggacacugggggcagaagcauuaaugaauuggcccacuugguggcuaauguuuucguuuguuuguuuuuugagacggaguuucgcucuuguugcccaggcuggagugcaauggcaugaucucgacucacugcaaccucugccuuccagguucaagcgauucuccugccucagccuaccggguagcugggauuacagacaugcgccacugugccuggcuaauuuuguauuuuuaguagagacgggguuucuccauguuagccaggcuagucucaaacucccgaccucaggugauccacccaccuuggccucccaaagugcugugauuacaggcgugagccacugcgcccagccaacuucaugugcucuaauaugugcugcauggcauucugucaagagaugaggacacuccuguuccuuagccuggcauucaaggcuugccauaaucuggucacaccucuuauuccagucucaucuuccauauuuccagccacacaccgauucccaguauucaccauuucuugaguuuucacacucauacccacccccaaacauuggcucauuguuccucccacauggaaggcuccuucccagagcucugggucuuaauuccacccauucuacagugucuuugaagucuucguuccuccuuucauuugaaaguugacggcuccuuccucuaagcaaccaguaccucucuucaaauacucgguauuauguggcuaaacacacacaaagcaaaauuuuacuagacucugagcuucuugcuggcaggggacguuuuuuauacauugcggcccccagugccuggccuguggugaaugcccaguuaacgugcgcaugaacaaccaaacgugcucaaagcugccuuucuccugccauguuugauagaagcacuuuguggaauucuuucagucugcggauggaagacuacgcuguugcccaguucacugcugcuuuccuuucuuacaggaauuacagaaaggagaaagcacuaacugaagaaauggugaugcucucaguuucucugccuucccuaucagcagaaaggcucggggaaggcccucagccucccagucuggugaagcuuccuguaugguccaugaccguauuccaccccaggcucugggaggcucccugagaugugcuguccacuaagcacugcacaaacaagcaaucaaauuaugaauaaacauaauaaauaucagccgugcgugacugagugauggcugcaguuucucaguauccc

SEQ ID NO: 17887 - RNA, 2341 nt, Homo sapiens
caaaaauugugacauugggcaugaggcuggacgacuuguuaauguaguuguuucuauagccccuaugauuagacacuucagugucagggcacagauuaucuaaaauuagccagcucuuccugucagggaucagggcagcacuaacaggcgcaaaaguagagcugucaagaugggcuaguuuuccuuggguucugaagaaaauggaugugcaaaggcuuggcuccgcuacuuguaacaagcuccagcccuuaaaaugaaauuaacuuccuacucaggcacccugcuuaggugcacagcuguucaauauacacagagaacagaaauauuccuacugucuuuggaaacccugguguaccucucaguggcagaauaaacaucaacacagguucaagaacugaucucuguuuggaugguggucuucucuugugcuucccagggcaauccaaaugauggagaagggguuuggaaucuauagguaugaucacugaggacucccauacuuuuuuuuuuuuuuuaaauagagauggcgucucuccauugcccaggcuggucuuuuuuucuuuucuuuuuuuugagauggagucucgcuguuguugcccaggcuggagugcacuggugugaucuuggcucacugcaccuuccaccuccugguucaaguaauucucccugccucagccucccaaguagcugggauuacaggcauggaccaccacauccagcuaguuuuauauuuuuagaaaagacggaguuucaccauguuggccaggcuggucucaaacucuugaccucaaguaauccacccgccguggccucccaaagugcuggcgugagccaccgcgcccaggccagucuugaacuccugggcucaagugauccuccugccuccgccucccaaaguguugggacuacaggcaucagccauugugcauggccccaaaccuuauggcaccaaggaucccuuuauaaucuuuucacguaaggaaccugagggaaaaacucaagguguuuuuguguucucucacucaauaacaauaaacacauaagacuucugugaucaaacguuaugaggguuucuccccacacuaagcaagcagucaguucugcagcagacaccagcugccuguccuccaauucucuucgaacacuaucuaccuggagauagcaacagauuccacagguuuggggcucagucccacaagacugcucccacccccauuagacaacauucacaaguccaagccuccagaacuucugagcuucaaguucccaugaccccuucuuuuuuuuuuuuuuuuuuugagauggagucucacucugucgcccaggcuggagugcaguggugccaucucggcucacugcaagcucugccucgcggguucacgccauucuucuccugccucagccucccgaguagcugggacuacaggugcccgccaccacacccggcuaauuucuucuauuuuuuaauagagacagaguuucacuguguuagccaggauggucucgcucuccugaccuugugaucugcccgccuuggccucccaaagugcugggguuacaggugugagccaccgcaccuggcugaccccuucuuuuuaauuugcuggagcagcuugcagaacucagaggaacacuuagguccguuuacugguuuauuauaaaggauaucacaaaagauacagcugaagagaugcauagggugagguauagaaggggcguggagcuuccaaguucucuccaggcgugccacuuugcaaagccaaguguucuguucuccgaaagcucucuaaaccugucuucuugggccuuuuauggagaccucauuggauagggaugauugaagcauggacaacacuggagaaaugggauuggacaaaagaggcauaaucuaauacagauggaguggggaaguccaacaaggccugucuacauuucuuccucucagguauggggcagaaucccuucugaaaugggggucucaugaccuaaaaucagacaagguaggucagaggauucuuuuuauggccaacuggaagacgggcaaaggaagauuauacuuuuaguuucuauggccugccuuggggagaaaaagcagcaggugaaaggaggucaggagaagaucugagaaacagccugcuguuuucugaggcccgaagugcccaacauuauaacaaaagccuaaaacaaggguuuugggaguuauaagccaggaaauagaugaaaaccuaucuauauccucauaucacagaacccgaguuuugaaucauucuaguuauauuuaaguaguaugcuaacaagcagagcugucaugacuggcacugaacacagaauggcaugaggc

SEQ ID NO: 17888 - RNA, 3042 nt, Homo sapiens
uuuaaaaucuuucaauauuauuuaaugaaaaagucucacacugucauguacaggauauaucaacauuuacuacucaucugucauguuaggaaaaacaucauuauuacacgcuuggaaaauccucaaacccaucucuaguggaugucugucauaauuuaaacgguauuuuccccauucaaauaaaacaaucucuuguaaagcuacaacaguuauauaccaaagcaauaccuaguuacaugcuuuacacggucccgugaaaaaauaauuuaauugcuccuaaucccugaugcaaggcacuucaaagcacccgcacaaaacguccauguaaacagcaguacagugcaucauuuaaauaacauaaaugacuuuuacacagcuugaccuaggaaaaaauaaaauccaucauagccacagcuaaaaagcauguuaagauucacaacaagaauuuguuucucuuauuauaaagagaagagcaaucauaaaaccuccugggggugggggagaccucauaaauauuuuauauugauugacaaaacagcaugcucccuggguauguaugaaaucagaauauucaggaguaacugagaggaugcaaaugacauuucuuaguacccagcuuuaauaucuaccaggccugguagucuggauuauuuguagcaccauggaaaacucauuagaaaaucacaaagguauauaccucaaccuuuccaugagguucauuuaauuauaguaaaaaacagcagugaugcagauaaagaaucuuuaaaauuauuggcuuacuggauuuaccuagcaagaaaaacucuauauuacuuauuuuaguacaucucauguacauaaagcaccaguuuaaaugagauuaucaaauaucuccagcaucuuuuugcuuagccuaaaaguucauuucuuaucacuuuccauggcacauucuuaaagccaaggaagauaaaacuagaaugguuauaaauaugaauggagaaauucaguuccuucccuaucauauuuacgugucucaaguaaaacauagaugaguggcaaaaggucuacugcauucucuggaaccugccaccccagaguaguuacuagcuacuagaggauuaacacacagggcugagcaggucaaagccagggcucugucagguaagggccaguuuuuacuacugagcaacccacaaacaccacugguaaagcaaagaggucugagugugcauauagcucaggaaacccugaguuuacccuuaguuaccacuaaaaacuaacaaaugagacucugcugaggcuuaacuucauauacaaaaaucaacaccuuugccucuuugacagugguaauuauuagcaugcccuucuuagguauaaaagggauaaugguauaucuagguuuaugcacaguuaagaaucaacuacaaauauucagacuuguauuuuaaaauuacagaucaaaagugacucccaaaagaaaaucaauuucuucauaaaugaaacauaguauauaaaaagcuggaaugaugauuaauucaaauacaaaagcuaguauacaacaacccuacuuuuucuuccaaacuacuuagguucauacgguucacacuaccacacaacuguucuacauuacaauuacaccacuagaguaaaauacuaauaaaacacuucaguuagcaagcugagguucuacuuguugacaacugcauuaaaacugcagcauuuaagcagagcugagaagcaccguucuuaagcauggcuuucuucuuccuguucuuguguuccacagugauuauuaaaggaaggaauuuggucuguaaaugacugggucauccacugcucauuaggaaugccacugaaaguugauucuccucuuaacuccaggcucucaauuagcccauuugaagagaagcugcaagguucacugucgcauggauuuucuccguaagcaccaccauaugcugccucauaacccagaucauauuuuucuuccuuaacagccaucuucuuugcaucuucuugggcaagcuguaggucaaauguauauugcaccucuugaacguccguauuucguucaaugccucucaacugaucucuuaagucuuucaguuuuauguaguaaugaacuuugucuugggcccgaggaaacugagcacuucuugcacuggaugacggcauaacauagcagagaguuucugugccuggaaucuuauggggcugaagcccaaauuccaaguucuuaaccuuuacaccaaaaacuucuuuacuaaaaauuucauaaauacauuuuccauuaaacacugcuauucguggcugauauuucuauaauuucuguacuagaauacguccuccuucacgaaauucuuuacuggagagaucuuugcugccaggcgugguccuuuccaccauguugguaaauccaauaccauacuucccugguagagugugaucauccauaugguucaccuggaccucacugagcccugacauaaacaaacacuuccaaaaaugguuuccagguccaggguaaugaugcccuuuguaagcagccauuagacccggguuuaugccaauaaugacaauguccagauugaaggucaaaauaucggggagagucuuggucagaaguucagcuucugaaacaccauuaaaacggucuacuuuucuuuugacuuuaaaugugucuguaauuuuucuugcuuuucuuuugauuuugcagacuugcuagauuuuuuugacucaacagguuuuuuggguuccacugguuguuuugguucuguuguucuggguuuucuuuuucuuccuuuuggagccucuugcacugguuccugagcaggagcuggggcuggaacuucuucuggcauuugcuguucauucacaacugccauauuaggagcuucagccaucaguuguugaaauggaaacguauaaaaagcuugagcuugcugaagggaguagcugcccgcguucuccgcuuccauuccccgaggccgcugaugcgggcagcuccaccugccaggcacacgggcagccggucucuguaguaccgcgugguacucacugcgg

SEQ ID NO: 17889 - RNA, 5093 nt, Homo sapiens
gggcucuggccccaggucugccagcaauucacgggagaucuugggaaaguugaagaguucgcuuccuccagugggucccccaagcuaguguccuggguggacaccccagaugcugggaagggauuuccugagccuggggacuagaagcaagaucgugggcugagccugugcccagccggaccuucuggcuccuugcauuuccagccuugaaauggaaucgauucuccauucugggccacagcuucggugaguacaguggccaggagcugaccgggcccggaguagggcugggagggaaggauaggagcugcugccccaccccuuuccccugcacuuaugagaucugcaaagagagaugagagggucagucagagguugaccacuguacccucugaccucaggcaacugccgcaagggacacagggaugagggaaauguggucuuuugaguggucaggucugaugaaggggacaucauggcccagaugcugagcccccagccacccauauggugccccccccccccaacuggugggaagaagcuuuaggguaugcagcuggggagggagugagggaaugucacccacagcucuuuugucccccagguggcgucgugggcggaauggugaguagauggcuuugucuggccaacuggggcucccuuggguggaguggggaggggagcacaaaggaggaaggagaagguaccugggacagaaagugccuccuccugucacagugacaguccuuauaccaggaaguugguguaaacgguggagacuccugguagaguucauguuuccacgcccccauacccggucccaccgcacccuggaguccagccaucaccaaggucuggagcucagugcugggugcagacuuagggguggugggggaaggcacaccauagauagaagauucuccucuggccucuuggucagcacccuccccccagccuaaaagauguuucggggaacuccaggguccccagggaaaggcgggaguguccuuuccuucuucccccuauucauucuccccuuuuggcauccucacaguuuuucuguaccuuccccgagaugguggauaaacuuaucuugcuggacacgccgcucuuucuccuggaaucagaugugagaagcgggcuuucgugcaugcugucauuagggaggaccugggccccgggcagcgcucccagcccugucuccuuugguggacacuagggaagcacgaggaggcggcagagggugggaaaggggagucagggacccgcuccccaacagaugacaggcuucugcugcuuauaccccuagcaguggucaggacaaggggugugggggaccccuuggaaacuggauguguggcucgggaucugcagaaugccaggcugaucacgcaguggcaggcaguggaagagggcagcggccauggguggaagauguucuagggcacacagcugggccggcacacugcacucacacccagucgaaugccuuugcacuguguccacauugcaccaccacacaugacagcccuaaaugugaacugaaggaacaaggacugaccccucugaccaccacuacccauaaccaguacugucucugcgucugaguccuggccugguuuaccugcugggugaccccuggcaaguuacuuugccucucugggccuuaguucccgcacguguaaaaugagguugggcucaaugaccuggccagcucugacauccugucauuuucuugccaaggucucagccuaucaguugugacacaagucucaucaguuucaguuuucuuguccauagaaugaccacagaucggccagaugcgguggcucacgccuguaaucccagcacuuugggaggccgaggcuggcggaucaccugaggucaggauuucgagaccagccugaccaacauggagaaaucccgucucuacugaaaguacaaaauuagcugggcgugguggcacaugccugucaucccagcuacuugggaggccgaggcaggagaaucgcuugaacccaggaggcggagguugcagugagccgagauugcgccauugcacuccagccugggcaacaagagggaaacuccgucucccaaaaaaaaaaaaaaaaaaaaaaaaaagaaugacggcagaucccauaaggauaaggaucauguccaucucugucaccacauccccaauccuggcaccuaguaagggcucaguaaauguuccuugcaugagcucagcuagcucaggggcuauuauaaggauccaauuuacagauggcagacagcagacacucccuucuuucugcauuucacccacugaauugacaagugcagugcccccaggggcuuccuccugggcgagucaagaggggcauuugguccucuuguccugcauucucaggcauggguagaugggagaugccccccucugcagccccaggcagugggccugaggcuguccucacagagugagccacacaucaugggggagcuuggaagccccagaaaugcgcccuuucugccagucccuuucugccacugagaaugauggcauucguugaaccagaugaaacugccaaccccagaugguucguggccuccggacccuaauuucaugccuuugcaaagcacuuggcaguugacagagauuccccuuccucuccaucaucccaccugaucucuucaacugucccuggccgcaggcaagaccaggcuggcugugacugaggcgaagcaaagacucguucagaaucguggggcugacuagccagggcuggggcugugugccccuuugccgagaggggcucagcugagagcagagggcagggcuaggaggggcagagaccucgucugcagccuggaucccugcccaccagccaacugugccuccuuaggaaauggagaacuugcugaccuacaagcggagagccauagagcacgugcugcagguagaggccucccaggagcccucgcacguguucagccugaagcagcugcugcagaggugggugcccgguguggacggggagcuggugggguccaggggaggacaucccgugagacguggagaagcuucuuucucccucucacccaacaagccuguuucucccuggggucacgcugagcaccaggcuucccagggucuucagggacguucucucuuucccucugccccugcuccagccaugccccuuacuuccaauacccuccccacaccucucacgcacccgccucucucccaagcacaugcugcuuccacgccuucucuccccucugggacuccagccugggcucccuuaccuggaauucuccccugugcuugcucacuggcuuccccacuccuuggggccucagcugggaacccugcccugacacccccaggcaagcugucccugcccugcagguaaccacacuguccaauaagagccuauugauuccucuguuucccgaggcaugugaacuccgcaacccccacuauggcugauuuggucaucuuugugccuccugcaucuggcagugggccugguaggucagagcuccacacauauuuguugucugaaggaggagaagccccccacugccccaccacacgcacgcgcacacacacccacacacacacacccugccgcuguaaacaugcaaucgaaacacgggacacaggccaggcgcaguggcucacaccuguaaucccagcacauugggaagcugaggugggaagauagcuugagcccaggaguuagagaccagccugagcgagauagcgagacccuguauuuaaaaaaaaaaaaaaaaaaaaaaaaaaauuagcuggucgugguggcacacgccuguggucccagcuacucagcagccuuaguugggaggagugcuuagccccaggaggucgaggcugcagacagccaugaucaugccacugcacuccagucugggugacaaagugagacccugucucaauuagaauacaagguccaggcacgguggcucaugccuguaaucccagcacuuuggaaggcggaggugggcagauuacgaggucaggagauugagaacaucauggcuaagauggugaaacccugugucuacuaaaaaauacaaaaaauuagccaagcguggugguggcgggcgccugaauaucuauccagaagaggcguuagacauucucuagauguaacgaagaauggcaugaacccgggaggcagagcuugcagugaacccagauugcgccacuguacuccagccugggcaacagagcaagacucugucucacaaagaaaaaaaaagaaaaaaaaaucacgagacacaugcacgcuuugugggugaccucccuuuugcugcccuugucuccauuuuuuuguuguuguuguguuuuguuuuuggagaccaaaucucgcucuguuccccaggcuagagugcaguggcacaaucucagcucacugcaaccucugccuccuggguucaagugauucucaugccucagcuucccaaguagcugggauuacaggcacaugccaccauguccagcuaaguuuuguauuuuuaguagagaugagguuuuaccauguuggccaggcuggucucaaacuccugaccucagaugauccgcccaucuuguccucccaaagugcugggauuacaggcaugagccaccgucccccccggcccuccucuccuuuuuaucugaccuccuuuuuauuggccuccaggcacccagcauccuucugucuccccccagguuacugaagagcaauagccacuugagugaggagugcggggagcuucuccugcaaagaggaaccacgaagguggccacagguaagggacucuacuguccaaggccauuuuauauuugucacuauucuuaccgaggaugucaaggacuugccuuagaccaggcaggauacuaagcgcuuugcaaacagcaucucacugaaucccccuccugccucacccucaucccauuuagagcaggagaaaccaaggcucagcauugccaagcaacccgggugaggccauacaguuacugcacaucccagaaagccacgcucugggagaguuuggucaggugucuuggacuaaauguuggugaaugucacggccau

SEQ ID NO: 17890 - RNA, 2013 nt, Homo sapiens
agagucucccuggugggccccagcgggggguguggaauggcaccaggaggugguuguggcucacugugccacagccucagagggaagcugguucaggucauguucugccgcauccaguaguuucacaaauguuaggggaccaccuggucuguagcucagacggcccuuccugcccccauaggccaaguucaaagggauccaggaauagaucuggaauguuccagauccauuuccaaggcuuccuuuaguucaguagcuggccggacagcaaguggccccagcaguucucuuguuugcguuucaggaagaguugggcuguggaaggacaucuucaccgucuccaugaaugagaaguuugacuugguguauaaacagaagaugggaaagugugaccucacguuugacuuuuauuuauaauaacagaaacaacaaccugcaugcucacaauacccagacagucuacuagccaaaaguccuguaugcauucauuuauuccuugcuggacaaacucuggaagcagcgugugaaacagcgggggaagggaagagcggcgugagcggagggagugugaugauucccaaccgaaagcagcugucucgccuuuagaacgugcagccucuccaugucugauuacaaacagucuccacauugcaguuccaauggccuggaccguaaggauaaagccuguaauauaugcaacuagaaugucugccuuuucaaccccguauuauuguauuuuauagagcuuuucacuggaaaucuacauaaaugucaguaaaccaaauaaaaguucauuuccaaggggaaucaggagcgagccacacccgaaugguagaaagaucucaggguuaacucuuuauuuuuguaguuuuauuaucuaaggcacagccauucuguucucacuugguucugagauaguggugagaacagaggaugaguugggucuguuggggggaaucuggacacuuguuuauucugacggaguucacuucuucagaaccuuccugaaaugagcagaaauuguucacuaggucuucagaauggacguccuucugccagagacuuccagcgggcggcuccaaaggcccaaugcagaggagcccgcggagcaugugcugagggaagucugccuggugaggcuggcaggugggagucuaaugcagucaggagcauuugcaugcaguggguggagagucggccaccaaaggaccgaguugcgcucggaauuugagcugaauuccacagccuuacuuuguuuccugaagugauagccuacuaaugcuggcaagcagaugcuuaauaguaaauuucuaaaauccccgggucuuuaucauucaguuuguucugugcaccugaggcgcucagccgugggaggaccauuuugcgaguguagcccuguuucacucggaucagguuggcacggccgccugcgugucuguccaccucaucccuccguguaucugagggaguaaaggugaggucuuuauugcuucacugccuaauuuucucacccacauucgcugaagcgauggagagucgggggccaguagccagccaaccccguggggaccgggguugucugucauuuauguggcuggaaagcacccaaagugguggucaggagggucgcugcuguggaaggggucuccguucuuggugcuguauuugaaacggguguagagagaagcuuguguuuuuguuuguaauggggagaagcguggccaggcagguggcacguggcaucgcauggugggcucggcagcaccuugccuguguuucugugagggaggcugcuuucugugaaauuucauuuauauuuuucuauuuuuaguacuguauggauguuacugagcacuacacaugauccuucugugcuugcuugcaucuuuaauaaagacauguucccggcguugcgucgagcguuucugcuuguggggguagaggggucccugcagcggugcugucggugcuugggacaauaugacugugggccccguugacaccccauucccu

SEQ ID NO: 17891 - RNA, 1067 nt, Homo sapiens
gagacaccauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaagaggaagagagagacccuca

SEQ ID NO: 17892 - RNA, 1067 nt, Homo sapiens
ugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucuc

SEQ ID NO: 17893 - RNA, 4172 nt, Homo sapiens
ucuaaaaccgcaguuucuggaagaaccacuuguucuugccugucuuguaucuagaagggaaaaaaagaggacaccaaugaggaaaggaauggaaauagugaaaccauacuccaccauucacuaccaaagccuacuuaccucucuucaaacuugaccuuggccucccgucgggccuugcguuuaagagcaggaucucugaagacauccuuauugacgacaguuuuguccaaggggauauccacagaguaccuggggacaaagguggagaggcaggauuagcccacauacugccggggccccuauacagcccaaauccuugugggacacuagggaaucagggucugacuccuuagaagcaaccaucaaaagccaugucccgaugacauuaucugaaaauucacacuuuuuuuuuuuugagacggagucugaaucuuucguccaggcuggacugcaguggugugaucucagcucauugcaaguuccgccucccggguucacgccauucuccugccucagccucccgaguagcugggacuacaggugcccgccaucaggccuggcuaauuuuuuguauuuuuuuaguagagacgggguuucacaguguuagccaggacggucuugaucuccugaccucgugauccgcccgccuuggccucccaaaaugcugggauuauaggcgugagucaccgcauccggccugaaaauucacuuuuaacauuuauuggauucaagccaauaaaauguaaaauucaauguuucauucucaauuucccacaacuacuuuauuuuucuagcuaagaaucaucaaaugaggcccucccccacuuuuugagacacagucucgcuguugcccaggcuggagugcaguggcgcaaucucggcucacugcaaccuccgccuccuagguucacgcccuucuccugccucagccuugcgaguagcugggacuacuacaggcgccugccaccaugccuggcuaauuuuuuguacuuucaguagagacgggguuucacuguguuagccaggauggucucgaucuccugaucucgugauccgcuugccucggccucccaaagugcugggauuacaagccugagccacugugcccggccaaauuaggccuucuugacuuucaucaugacaguuagcuaacuuucuacuugaaaucauuuccuuauuguucaaguucugccaaugcagucacucucaugacagcccaaacacuagcugccucaaccccaccacaucccagcacccaagaaacagcucucucugcccuuuuauuauuauuuuuauuuuuugagauggagucucgcucugucacccaggcuggagugcaguggugccaucucagcucacuguagccuccaccucccaaacucaagcgauucucccaccucagccuccggaauagcugggauuacaugugccagccaccaugcccagcuaauuuuuuuuaguagagaugagauuucaucacguuggccagguuggucucgaacuccugaccucaagcgauccaccugccucggccucccaaagugcugggauuacaggcgugagccaugguguccggccucucucugccccuuuaggucagccaacccagaguaaaugugcaauaccagcagcaaacuuuaaggugcaugcugcuggguucuggcaauuauuguucaggacuuucucaauucucgcaccucuuuugcuggaggugcaguggugugaucucggcucccugcaaucuccaccucccagguucaccguguuagccagugcggucucgaucuccugacccugugauccgcucgccucggccucccaaagugcugggauuguaggcgugagccacugugcccggccuugcaccucuuugagacggagcuuugcucuccuugcccaggcuggaguacaauggugugaucuuggcucacugcaaccuccaccucccggguucaagcgauucuucugccucagccucccaaauagcugggauuacaggauuaccaugcccagcuaauuuuguauuuuuaguagagacaggguuucaccauguuggucaggcuagucucaaacuccugaccucaggugauccauccgccuuggccucccaaagugaugggauuacaggcgugagccauugugcccggccucuuguacuucuuaaaaaacacuuguacuggccgggcacgguggcucacgccuguaaucccagcacuuugggaggcugaggugggcagaucacgaggucaggagaucgagaccauccuggcuaacauggugaaaccccgucucuacuaaaaauacaaaaaaaaaaaaauuagccaggugugguggcaggugccuguacucccagcuacucgggaggcugaggcagaagaauggugugagaucccgccacugcacuccaaccugggcgacuccgucucaaaaaaaaacaaaacaaaacaaaacacuguacuaagacaguguauguccccagacuaaagggcccaacaggugaguaaaauuaauuggggaagacuugcuuucacgcacucacagacuuuuugaaaccuauuguauuuauccuugaggguggaacaguggaagagggcagaucagaccccaugccuguguuuacuguggauggaaaacaaucuuuacccaacacuuaaaagauggaucaaaggcaaaacuggaaaccauagccacuuuaugaguugaagaugaacauuuuggaaaugauaucccuuccugguguuggaauggcugcaaggucugucucauuauucaacagagcagggagaagaaauuuaaauucuaguucuugaaaugcucaccuugugggcauuaggugauuguaguuauacacuuucacaaaagauuuuaucuuugaucucuuggcgaucuucuucuugcccauggcagcugucacuuugcggggguagcggucaauuccagccaccagagcauggcuguaggggcgaucugaggugccaucaucaauguucuaaaugaguaagaauuacauuuguuauucacugagggccuauuuaggcccuguguuagagguagugcaguguccaaaaaauauuuccacccucaggucuccaagauccaccauuauaaagagaaaaaucacagaaagcuaugagaaaugaccaaagagaaacagaacaguguuuaucuccaucaggaagcaucuggaacggcuuacuagagguaagagauuuaaaaguagcaacaguuaacauuuaagaaguacuugcuauaugccaagcacugcucacaggacuugguaucuauucacuugcuccacugcuagugaaguguacagccaagguuaagacaccacagccuaacuccagagaucagucucaggagaugggagaggggaauccagggguacuccaguguccccacaacaacaaaacgcagugguguauguggccagagccuagggaacucucucaagaagcuacaaaaucauggauaagaggaaaacagugaggggcuaugugaccuuucuaaaagcaauuuccuccucuucuuacagauucccagcugcagcacuucagguaaauaacagaacaccuccaaaccuuagcaacaggaaggaacccccuauagcuggggaugguggcacgcaccuguagucccagccacucgagaggcugagaugggagacucgcuugagcccgggaggucgaggcugcagugaucacgccacugcacuuagccuggacagagaucccgucucaaaaaaaaaaaaaagaaaagaaaagaaaaggaauccccuaugauuacuucaaggacugcacaugacaauaccugaaaggcagugggagcacauagcaagcgugcaaugucagccacuauuacuauauauuuaaagccucugguggagaaggcuuuaugcguugggagcccaauucagcucacauuugcuuuuacugugcuucuuccucucucaaaaacucucccacguucacccugaccgugcucacuggcuacugccccagaaacaggccuugaauuccaagccugcccgccccgccgcagccagccuggucccggcaugcaaggacgcagagucccgcgaggcugauaccuucacgaugacagcuuugcguccggaguagcguccagccaggacaagcaccaccuucccagguuucaugaacuugcccauu

SEQ ID NO: 17894 - RNA, 5790 nt, Homo sapiens
uggggcggggccgcucaggcgccuuggacgcggagccgugggacgagggcggcggugaguucgagguggcagagugacuggggcgagcgugcuguggcccuucccugcgcugccucagggugccucccgcucgccgggacugaguuccgcgccggcguggccugcuggguuccaagcgccaggagucggcgcagccgcucucagcuuuggggacgggaccgagaagcggggugugggccucacgggacuguccccccugaccucgggcagcgcuggggcgagagagggcaggcggaggcucgcggggaccaccagcauccccggacccucucagccgucccuguucacaggcaccgcccccaggagccucggcaggggccuaggacgccccggcgugcagaagagaagcgggaucagguucacgcacacccgcgaucgaucguaacuuuuguuuugagacagagucucgcucugucgcccaggcuggaaugcaguggcgcgaucucggcucaccgcaaccuccgcccccccagcccccgcuccccaaccccccgcucaagcgauucuccuaccucagucuccugaguagaugagauuagaggcgcccgcccccacgcccggcuaauauuuuauuuuauuuaauuuuaauuuuuauuuuuuugagaaggagucucgcccugucgcccaggcuggaguacaguggcacaaucucggcucacugcaaucuccgccuccuagguucaagugauuccccugccucagcuuccuaaguagcugggauuacaggcacccgccacuaugcucggcuaauuuuuguacuuuuaguagagaugggguuucgccauguuggcuagguuggucuugaacuccugaccucagguaauccgcccgccucuggcuaccagagugcugggauuacagguaugagcaaccacaccgggccagacuuaacuuuuaaagucacugguaacccaugcuuccuggaguugcaucuggggacacccaguggggaaagccaucgcauuugauacgccuuuauacaccacgcucaguucaggcgaggggaggucacagccaagagcuaggggccagcugauaaugucguacuugauuccauagucaaagaaggagcuggguaaucagcaaaauuguaacuuuugaugaacccaucagauggcagccauuuagccagaaaucuaaggaaagagaggccuccaagacccaaccaugaacaugagaaggggguuccauacaagcagauaagaaaacaguuuuuuuguuuguuuguuuuuugagauggagucucgcugucucccaggcuggagugcagugacgcgaucucggcucacugcaagcuccgucuccuggguucacgccauucuccugccucagacucccauguagcugagacuauaggcgcccgccaccacgccuggcuaauuuuuuguauuuuuaguagaggcgggguuucaccauguuagcuagauggucucgaucuccugaccucgugauccgccugccuuggccucccaaagugcugggauuacaggcaugagccacugcgccuggccaagaaaacaguucuaauguccacaccacguguggacuaaugugagggcauagagcuucuaggagcagcagaaacaggagauuuugcacccacucugggcccuucuccaccagcguucacugggggcuugugguaaagaauggggcagagcaggagaccggaacgcuuuuaccguggugcagaccuggaagaagagaugggugcucuggcuugauccugucuggauccuucucucuagcaguacaaaaaccuuaaaccauuggaauauggacagcaaauccugucacucugggcaccggugaaaaccuguuucagcuggggauagagaaaaggguacgguagggaggcaagaaacugugcuaggacuauaugguuagggucuucauagcugggaaaggggcaggauuccugagaaagccugugacccagggacaccccaucucuugaucuugcagauggcgucccauguagagugccguccucugggaguguuugagugugaacucuguaccuugacagcuccguacagcuaugugggacagaagccccccaacacccagucgauggugugagugcaugccuuuugggccagugccggggaggccugugcccagugcugguugguggguggugugccuaggucugacaacugucucagguguggagcuuuagaccccacccuggccaggcucugaaugcuucugguguaaucucuggaggccugggcaaggcuugaggucugacucuuccagaaccuuccuccacaccuagcccagaguccaauaccugcucuagcugugggggagcagcucagcagcugggggaccugugguggccucccccuuuggggcugcacccuugccaugacacuuucuuaaugggaggccugucuccccugcagaccuggauuagagccagugggucagggggcuuaucucuugaccuccagcuuguccuucaucaaaugccacuuuguuggaaagcuggccgguguguuacucacaugggaugcaguggcaggggcauggcuuuuuccuucuggcugucgucccucugcugaccaggagccugagugucaucaugucacccuggggucucauucugauguguagcaugaggccagcuggcuuccaggggcugugaggguguggcuugggguguagggaggccugggguauucagguggcagccuugugcccccacuguggugaaucagucagggucugggggcccauguugcagcagcccugcuuuuggcugagaacaagggguucucucuaccauggcuguuacagaggugagagcagguucaauuucagugccaguguggcccccaauugcugauccuuucugucacugcccugcagcacggguggccuaguccccugcccugaugagcccacgcagguaugcaggcccugcagaggugcaggcugcugcugccuggccauaggucauggcugauuuuccgacggcagagauuugggcuguucugacgcugcauucacucuccugcagccuccuggaggaaagcuaugucaugaaggaucccuucaccuccgacaaggacagauuccugguccucggcucgugcugcaguuugugcagcaggcuggugugugugggcccgguggguaagcagcgugggcuggggccaccuguccuugcugugguuauccuggagcucucccuggguagggagggcugggagagagggagcagcggguucaccccauuauagauggggccccucagcugaugaaggggagaggugagagggcaagcuagggucaguuagagggucucagccugguguaggaauggaaauagguaauugguggcucugcacccaccccaguggccccucaggguuccuccccuucccaccaacagugcagacaguccuugugcgcccucucaccaggauggugacuuacuuucuagauguucuuggagggaucuccaggagaagggacuguccuuucaugagcacuuguugugugccagguccugugcuugggaccuguuuuacugcugaggcuucauucaguccugccccuuagucagguaaagcaguauuauauuccacccauuuuauagaugagggaacugagcuucagagaggcugggugggccagguucaccuggguagcuguaaacccaaggacggauggaaguggagcagcauggcuuucacagcgugcccaguguacucagagugaccccagagucugagaagucccugagcaucugccacagguugacacacacaaaggggagcuguaucaauagccagggggacgagaugggccagggugggaggagccuccgcaguguggcaugggaguaucugaggcucauggaggagcuggugguccaggagaagcugggaaaggaagacugcaaaggugggugggccagguggggagguggaggucuugaaugcaacaccuuggccuugggcugcucuucgugagcagcgggguggcggggguggggggcgcacgcagguaccacaagucugcagcuuucuuuguuuaaacaguagguuguuagugagcggaucuccauggcgaagggucuuuucuaagaacugcaggagggcagccuuauguuugcgagcacacuaagcuuuaagaacagacagacaccaaaaauaagaguggccuaaguaaagcaaauaguuauuuacuuacuuucuccuauguaagaguccagaacugguggccuuggcuggaagggcaccccuguugucuucagcagagucucuauuugggucccuuguggcuguggagcucccaccaucauauuugcaucccaggcagcgggaagggacgugagagcacaguccaugccuucaaagggcaugaccaggagguggcacacacaguugcugacgccccuaaccagccugagucacauggcgaugcccaguuacagagggggcuggggaaugucauccuuagccacgugcugugcaccgugaugaaucucgggaguucuaguguguaagagagaggagagcggacauggcugcacgguucuggccuccugcccagacuagcuggcucguccauggcgucuuuggucuguggggcuguccuuccuguccccugccgcucccagcaccagguggccacuguucgugcugcgauagcugggacgggaggacucugggauuuucggggcauggccugugcuccagcuuuccauuguugucacugccccgugauggagcagagcaggccccagagucuuucugucccaucccagcuguucccacccaggguagcccaggccugcauugcuuuucuccuggacacccugccaggcccucaggccuggcucucccucuugcuggucuagcucuggccaccugcccacacugugcaugcuggggccccagcccagccccccaagugugggaagggcuggccccugggaggagcugcaccauguucccaggauacucaagccuccauccuuguccacuucuuuaaggaaugcaguuuauucuacuccaagagauucugccucccuuguguccgggagaacaucaaugcuuuuccucaggaaauucggcaagacuuggagaaaaggaaagcuccaucaaagaggacccccagccagcccgguucucggacgugagugcaacuggggcuaggucaucgggcggcacccugcacagagcuccugggccagccugcgccagggaugcugcugagcugggagccgccaugccuggccuuguuucuggaccacugggagcagcacugcagcccaggggagcuggaguccagcuuggagcagccacaggcccagggagcuguagcaagaggguaguccaaaggcagaugccagacaagacacagccaggaacccggccagguccccccacaugccccucagggcccaggccugagugagugcugcucagaugugacugagagggaugaccuccuucagcagggcagcuccuaagaggcugcgugcaggugcguguggggggagaugccacacugugucggggccauggugcacuguagguggcugcaauggucucucuguaaggaaaaucacugacagcagcuccuucuggacccagucuggaaggucuagagggggauagaauuuuuauuucauauccuuauguggugcuuggaaaauguuuuuaaccuugaccauguauuauguuuauaauuaaaaacccaaagaaccag

SEQ ID NO: 17895 - RNA, 33981 nt, Homo sapiens
aucaagauaagcuuaaaaaucaagauaugcuucaauaaguccauuuauuuuacaauuuaauguaaaucuagaauaucuaacuauuuauacaaacuuaacuuuaaaaauagccacuugcuauuuuacauacaaaacauucaaaagaaaauucuucauuuagagugacugaggcuucacauuccagcccagagaauggcagcgaggaggguggcggcgggaagcagaggccuugggugguccgugcuggccccagucccucagcccacccucuccagcacugggaauauauuuaugcuuauuuuucuuuuucaaauaaaacuucuacuaaaacauguuucuuuuuuuuuuuuuccaagacagguucucacauuggugcccaggcuggagugcaguggcacaaucacagcccacugcagccugcaucuccuugagcucaggccauccucccacuucagccucccaaguagcugggacuacaggcaugcacuaccacacccggcuaauuuuuguauuuuuuguagggacaggaguuucacuauauuucccaggcuggucccgaacuccugggcucaaguaauccgcccaccucagccucccaaguucuaggguuacaaguguaagccacugcgaccagccuaaagcuuguuucugaggguugaaaaccacuuuagggcuguucuuucaaggcaaaggauuugguucggcuuagaacuugaggaguggggaauccacguucuccuugucagccucagggcucagcuggaucagaggggagcucaggucuaugagcuggaagagagcagaguggaggaggugagcguggauccggcuagggccucccuuccccucccugcacagaggacuggcugcgugggucaucacagccacucgcucauccuggcucgggugcacugaaaagcacucugggccaccacgucuaagaagcuggaaggagacaggacacacacggagaagcccaggcccccaccaugcacauuccucugucccacaucuggcccuggggucuaugggcaggagagaggcggucccuguccaacaagagcuggcaggguccuggcagggcaccucagaggcagcugaucuuugagaagcucaggcugccaaaggugcauccugcccugagguguguagcugagaagacucaacagccacucucaagggucccacgauggcccugggaggaugaacaaucccagaacugaggacacccagggcugagucaacaugaaccaccugccacuucucaccugucccaccaccggugaagguuuggccacauuuuuauucaugucuggaguguuugucaugaggucgaucagaggccugcuuucagauccuacagccacgugugcuucugggguaucgcagaagucgaugagaggaaggucaaugaggggcuggcuugcagcaucuggagugaccgcgagugguuccaguuugauaucuacaagaagagccuggguacaaaaccaagguuaagagcagaguccagcaucuuucuggcaaccaucuugggagaaugugagcuuugcucauguuccaggugggcuggcgguuuggaaagccaaggaaucaggcggggccuugguggaaggaggcucuguauggggugggccgugccucucugacuguugcccaccucccuguccauacccgcucaccagcagccaccagcuccugccacccugcuucccgcuuccucagcuuugaucccugacccuugccuuagucaaaugcagggcuuucuccccuggaggccuggaaguccugacugccucccuuuggguugcuuggcacggaggcacuggccccaggaugaagcauggcagggaacuccgccagccacagcccuggguuccacgggcuucccgagcagccuccaggaaucucagcuaacagaacccagcugcgcccguucugcccaccucacuaggggcugcaucuccacccggcuuggcuuccucccgagcuacuucuguggcaguacuuuuggagaaaguagaaucgcuuuccucuggagaaaaguuaagugccugaggcacacgggaaggaggagaaccccugucaggggacacauccaccagccuggaaucugucuuucuguugcucucccuuguugguucaguucugugggaaggaaaaaaacuuaugagaaaaugucucuaaaaugcucguucacuuggcugaugugggaagcaagucacucuggaggaacaguguccuggguggagugcgucccggcucuagggccuucacccuccagacccccaguuuccuguguauggaaggggcucagugaucucuccaguuccucucagcucacaaaucuuagcuguccagcaucaccaggggcugauguuagccccuuccuuucuaguuacuaaacacaagguaaugcgcacgcccgucaccuccugaagggagcccagaccacacacagggaccccuccuugagccacggccagcuccuccucgcaugcagcuaguggggggcuucuccuaggccuagguggguaugcagcuggcuccuucugccccagaugcccccuccccugcugcccagugcccugaucagggcugaggccccagguacaggcugcccacaccagcuuuccaauggcgucucccacaggacccugcacgggcgcugcugggcuugccugcugcccacagguccucgaguaccugccacgcaaaacugaauuccuuccggaaacccagcaaagccgcagguccaucaacuaacacacaguaccuucuuuuuaauacuucagagguuucauaagaaaauuccaaaaacaagcagaauuuuguuucuacauuuacacuuacaaacauacaagauaguuaaacacauauuccuauuuauauaucagaucugguguuuucagugaggccuuguuucucauuuucucuuuggcauuccaugccuuucccucucccucuguaaugcacacacaugccagcauauuuucuuccagagucuucugcauuaucauagaacuacauagauacacacagugucaacaccuacuguugguagauguacauacacagaaacauauaagauauauaaaaauguguaauuuguguauaaauacacggauauuauauauguuuuuuuguuuuguuuuucguuuuuuugagacagggucucuguugcacaggcuggagugcaguggugcgaucuuggcucaccccaaccucugccucccagaaucaagugauucuccugccucagccgccugaguagcugggauuacaggcgcaugccaccaugaugcccagcuaauuuuuguauuuuuaguacagacagggucucaccauguuggccagguuggucucgaacuccugaccucgugaucugcccaccucgggcucccaaagugcugggauuacaggcgugagccaccgcgcccggcuaagauaguuaacuuuacacacuagcaugaucuguuucaaagguuauacacgacugaggugugacuucauuggaaucaggugccuuuuucaaucuuuaaucauuucugagcuccagcuauggcuuacuucauguguucugggucaauuuagauaaauuuuauuuuauuuauuuuauuuauuuuaauuuuuacagacggggucucacucugucccccaggcuggagugcaacggggcaaucucagcucacugcagccucaaccuccugagcucaagugauccucccaccucagcccccuaaauagcugggacuacagugcacgccaccacaccuagcuuauuuuuguauuuuuuguagagaugggguuuugccauguuacccagguugaucucaaacuccugagcucaggcagucugccugccucggccucccaaagugcugggauuacaggcgugagccaccacaccuggccaauaacuugcaaauuuuagaaaaccauuagguuuucaaauugauuaucagagaauuacacgcaguauuuccuuguaauaccuuuaauuuuccucuaugcucaugucuauugcauuuucucuuugcaaugaaaaaaaaaacaaacaaacuuuccaaauacuauuuacuucacuaaaaccuggagcaaggcaagaaaaagguaugucacugucugggacagcaagccuaggaauuugagaccaauuuauuaccaccuucgugucuuaccucauugcagaguucuugcggggcucagaggaacgucuccgagcuggcacacacaggggagagcccacggcccugggcaucguuuugggggucaucgguggaaggccagagcagcgccggcuggcgggugugggcaaggcugacacacgccaugcgcucagcaggcuuuguggugcuggcccagaugagcgucuaaccggggugcuguggacagugacccuggcaaacacaacaucagugucgugagcugagaugacauagaaaaaguaagaucucaucauucagccugugcuaaugcagugcugagggcuuugguuucagcccagaagagccaagccagggagcccgugugagcuccgcucuccugggacaggccccaaggcgggcaaggcuccgagcugcuaccaacccauccuggcgugggcuucgggcucccagugggaauggcuucacugcccuuccucacaggcaacucaaaagaaaauugaucaaaugugauuacacuuuacggaugcuaccauuaaaugucacuucacacgagguucagaagagacugagcaaaucaucuuucaguuggugucauagauauugccauaaggaagucagagccgcagccugucuggugggccagcgaaugggggagcaggucucccugcacgcccacucauacccaggcuuaaggucgccugaaucagaugugaacacaaaugagugaagaggaagcugggcacuugguccucacaccccucacgucccuggcaauaccugugguucgggcuacccaugggucuugccuaacuguugcuuucuuguguugcuguugaugaagaagaggcugagucaacuggcauuugcuguggacugaaugucuguguccccagauucaugugcugaaauccuagcccccaaggugauggcauuagaagguggggccuuuaggaggagaucaggucauggagccaaagccucaggaaugggaucugugcccuuauaaaagagggcacauuggugcauaccuguggucccagcuacucaggaggcuggagugugaggaucacuugaacccaggagguagagguuacagugagccaugauugcacuacugcacuccagccugggcaacagagcaagacccugucucaaaaaaauaaacaaacauaggccgggcggguggcucacgccuguaaucccagcacuuugggaggccgaggcggguggaucacgaggucaggagaucaagaccauccuggcuaacacggugaaaccccaucucuacuaaaaauacaaaaaaugagccgggugugguggcaugugccuguggucccagccgcucgugaggcugaggcaggagaauugcuugaacguaggaagcggagguugcagugagccaagaucgcgccacugcacuccagccuaggugacagagcgagucuccaucucaaaauaaauaaauaaauaaaucagcauaaaagaaacuuguucaccccuaacccagugaggacagagaaggcggcagcugugaaucgggaaacaggcccucaccagacaccaaaucugcaggugccuugaucuuggauuucuagccuccagaauugugagaaacaaauguuuguuguucaagcuacauagucgauagaacguuuguuauaguagcccaaaaaggacaaagacauuauuuuaaaauaaaaugagucaaggacaucccaccaccauggccccucgggaggccagggagaccugucuauugcucuauucugggcaauuguuacguucuucaaaaggagccugaaaacagacugacucuagccuauuuaaauggaagaaaagcaacgaggcugaaaucaagagagaaacagaaucacuccagagagcaacugcugucaaccccagcugcugcucuccgcgaaguucuaggauuccccacccuccucccuuuauugcuaaguucuggcagccccaccacaaauuccagugaaaauaaaaauuccggccaggcgcgguggcucacaccuguaaucccagcacuuugcgaggccaaggcugguggaucacgaggccaggagaucgagaccauccuggcuaacacggugaaaccccgucucuacuaaaaauacaaaaacuuagccgggcgugguggcgggcgccuguagucccagcuacuugggaggcugaggcaggagaauggcgugaauccaggaggcggagcuuaccaugagcugagaucgugccacugcccuccagccugggugacagagugagacucugucucaaaaaaaaagaaaagaaaagaaaaauuccaauaaauguaauucucaaaguaacccugggugaggugaggaaacugaggcacagagaggcaagugagguggccaguggcugccuggcucuggucuuugcucuucaccaccaugcaugggagggacggcagcuuagcauggcaccaugcgcagcacgugagggacuggcuaguucgaccucgcgaagcgugucucaagcucacacaggaggaaacuaaagcccagagucaccaaaagacuugcaaguggccccagcugagcuugggccaucccuacuugacgugaggaaaaaggucagcaacauucgggaacuuaaacuggaucaaagaccaggaagugguggagcugggauucaaagccaagucaggccggacacgguggcucacgccuauaaucccagcacuuugggaggcagaggcgggcggaucacgaggccaggagaucgagaccauccuggcuaacacggugaaaccccaucucuacuaaaaaaaauacaaaaauaauuagccgggugugguggcgggugccuguagucccagcuacuagggaggcugaggcaggagaauggcgugaacccgggagguggaguuugcagugagccgagaucgugccacugcacuccagccugggcgacagagcaagacuccaucucaaaaagaaaaaaaaagccaagucagaaucaaggugccacgccagugcucuucaacugcgguacaagucacagucacccaggagcuuuaggaaauccagcugcugggccucagccuagaugaaccaaaucagaaccccuggggugggcugggcacgggcaguccuaagagcgcuggagggacuucugcugugcagccuggcauggcaaccacaccaguccagggcugggagcugccguacugcaucgcggaagucucagaugucuuaagucugcaguagaucuaaaaggggcugguacacaucaggagcucggccugcacccaagagacuggcguggaagccagaugcgcaggccaggcugcaggguuaccaaaugguugagguaagcagaugcgugagucauucuacagcaauaaagagaggaagcggaccaacgucacucaccugccaacugacgugcacgacugcggccgcugugcccgcgaaagcuuugguguugagcuguccggggagucaccuaaguccaagaaaggaagugugcggucagguaaagugaucagggggagaccuacuguugggggaucgucaccgaaugggcaauucuccgaguaucuccacugucccaacuugaguguagguggcacuggcucagacaaguacacaaagggccacccugcugcaggcagccacaugagaggcauucaccccuacacggggaccccugcccaggcaaaggcuguggucugauggauggacacgggggagaaagagaagagccaucuucacugcgccgccccacccuggcuguauaucccaucagggccgagcacgaccuucacagagcgaagucgacuugucagacggcaccugcaugcgcuagacacuugcccacaggaacaacaccgcagggguuuagcuucccaggcacgcgcaacagagcccacauucccucauuuucccgaaccaugacuuuacugggauaauaauaauucauuacacuguguuugugcuguuuuaguugacaagcauuuccauguguaugaucucaucugauauucacaacaggaugaaaagcaggcucagagggcaaaggggucaccaguuaccgagcuaaggcccaacacaggccccagagguccagucccgccaccacgcccccagacacuggcuccaugguuccuccuccucuauacuggcuccuugaaaaucccagugugcacuugaguaucagcacaugugcucuggggccuccaaagccucaggcaccaggacccccuuggaacaccuugcuaugucugggaagccaugggaaaagaggcugucccucagagccccuuaccccagcaccaagagggaaggguggggccuggagcugaggccucuucuccacaggugcuuccaggaggccaggcgaggguccaggcugcugcccccacagacagccccucucucuggcaacagcacagcugcugcugggcccuccaucuuaacaagccuaugcccgcccuccugcgccugcacccaagcuccugucccacgucccugccccgcuuuaaaccagaucuccucagaaaggcugccugcacuuacauuuccucucuccugcucuuuuuuuuuuuuuuuuuuuuuuuuugagacagagucucucucugucgcccaggcuggagugcaguggcaugaucucggcuuaccgcaaccuccgccuccuggguucaagugauucuuuugccucagccuccugaguagcuggaauuauaggugcccgccaccacgcccggauaauuuuuguauuguuaguagagacaggguuuugccauguuggccaggcuggucuugaacuccugaccucaagugauugcccgccucggccucccaaagugcugggauuacaggcgugagccacugccccagccucuccuauucuuuuaaaaaucaccucuaucaaagugacucaugcacaguuuuuaaaaaugaagguuaaaauuuuaugagacaaacaagucucccaccacacccagcucugcuuccagcgugcuggaagcuucuugcgaugucucccuucacucauuucuaaaucacgcacccacauugcuaccuccgcauucuucagaaacuccguuuguuacaagaguuaagaaucugccccucacaccuccccaccgcccccaccugugcguucaccaggccuccauguucaccccagcacuggagaggcgcgcagcucgcacacagcugagucaaacaugcucccacccucucuccaccuccguuuucaguuuguuuguuucuuuucuuucuuacaagaaacaaggucuugcucugucacccaggcuggagugcaguggcuugaucacugcucacugcagccuugaacuccuggguucaaguaaucuuccugccucagucucccaaguagcugggacuacaggugcccagcaccaugcccagcuaaauguuuuuguagaaucggggucucacugugucgcccaggcugguguuuguuuucuuguauggagugggguggucugugacuaagucaucccauaaucccugucuuuugggaacauucuugggucacugaccccgcaccauucacagaggucucugugagacccaaguuggucacuccuggcggguguggaggcaagcccaccucucucucccucgccgccucccucucccuugccgccucccguguuggcucccucucucccgagaccccuuccucucgguuguccucucccucagcuggguggagcgcacucuucagcagcuuccaugguggcacgggaaggucauucuuaugaaacagaacacgaacaagccaucuccugacacccucacgacugcccuagggcugccugagcacgcacgccucccaggcccacaucagcucuucccuaaaccuggacggcgcgucuccacugcagcucccaguaccggggaggcaaagcccacagccagaauuccaagucucaauccucugggugacccggcagcauggacucauaguaaauagcaacauuuguaacuggacuguuuuacaaagaaugcugcuugccucgaguauuuugagaaagugcacauaugaaagccuccacuacagggcaccguucauguggucccacgcugugagugcccucagcccucaccucuccuccacggugacagcuggugucacagccaaugagcaacaccaccagugcucucagccaaaaagugcacaccaccacgugccucccagagcuguguguucccaacagcguggcugcuccccuggggccucucuuccggccagugcugaguuugugggaccaguuuugacccugaugaaugaccaaaggcgugcaagagacaguccuguucccagcauuguggagagaggaggaaccgccugccgaaggugaaaugcacaucugagaggugcguaaggagaccgcagggacacgcucugggaaacagggcaaagccaacagggauuugggauuagcagaaguccuguggcaucaagcagcccgacagccaggagaccagccaacacuugugccaacguggucaggagagacauggcagacgcauguccuggcuccaggcauucaggcagaagggaagcaaacacuacugaacacaccuccacaugaccugggccguagggugucccugcagaacccacccaaucacagcucgcauuucuuuucuuucuuucuuucuuuuuuuuuuuuuugagacagucucguucugucgcccaggcuggagugcagugacaccaucucggcucacuacaaccucugccuccuggcucaagugauucuccugccucagcuucccaaguagcugggauuacaggcaugcgccaccaugccuggcuaauuuuucuauuuuuaguagagacaggguuucaccauguugaccaggcugcucucgaacuccugaccucaggugaucugcucaccucggccucccaaagugcuaggauuacaggaguuagccaccgugcccagcucacagcucccaucucuacaaacucagcucucugcuguugaaaccuacacugaggucuccagcuguggcuucuccucugagcucucagccugcuccaccccucagcugcagccuaaguggccucucacccucacuacuuccaaaauggggccguggacucugcccgcugccucuuccagcccuccugucacaugaguggcagcacccagguuccgccagaaccucagggacacucgagucccucucugcacugccacaugagcccuaagcuaccagaacgucaggcagaccgcagcgcuccagccuccuuccccagcacuagcuuccuccccaacacagugagggccagguccgcauuacccuccccaccacucuucggcccagagacucugcucuucccucuguggagggaccuucugaaggucaagucgcucugcucugaucucuccuaugcacguccuccugcacugacgguacuccaggguccgcucuggucacgcggcgcucugggagccggccucgggcugccccuccaucuucaucucuucuuacccugccccucggucacugacuggcugagguugcuaguuuuuguucaacagcaacuuuccucuucucaguaagaaauuucagcugugugcggaauaaagacaacguguccuagcauccugugcagggaagcgucguacucaaugggacacaaacggagucacagggacaacuugcagugaggguccuugaaagguggggauuugcucuucuucaccuagaagaaggcuuccugccgggagguaugagggccagagccggugcagccacacuagaccaugaggaugagaagcucaucacggcagcacaggauggaguaagccugggucccugacaccaaggaguacugaccagcugucgcacgucuacgcagaaucccgaccgcagcggcugcacucccacccuccggcccccaugcugcucccagagcacgucccacgccuuccugccccaggaccucugcacuccugccguugccucugccuggagugcucccccuugcacuuuccuaccggcugccucagucuccugguucagaucucagucccgugucaccuccugaccaucuuugccaaagaaccacccgaugcaaauuccuccccaaacaugccagcuccaggacaccaucuucccuuagucccuuuguugugcuaggaucugcaggccugcucaucugauaacauuucguaucuuuuccuauuaaacagaaauucugugagaguaggucugucuuaucaugaugucccuugucccccaaagcauuccagcacagagaagacacucagcagaacagcuuguuccuacagcaggacucagaaugcaguuucugggaguugcaggcugccugugcuggccggcacugccagaacuuaaaauccucaagcacccagagggcagaucugccugacagaggaggccaggacgcuccucucaccuuaagucagcucugagaacuuucugcauugcacacaauuguucaagaaauucaugaaaacuuuacaaacacccacccacuaauggccagacaccugcuggggccaguggccucacugacuggagaaggcaguggcuggagcucaggaggcugagguggcugcaaucugagggccagaaacuagagaggagggggcuacuccgacagaacgagcucuaggaacccaagggaaucucgagucucuggcugagcaccaggcagugcacaggugcagggcaggaguccucaaggucaagagaagagcaacuaccagggagcaacgagcggagcucacagggccgagaaaccgccgucuuaccagggagcaacgagcggagcucacagggccgagaaggugucaucuugcagcagcaggagugcaggggucucgcgggccuugcgggacacacgggugugcagcagaggccuugggaaggacgccgguggcgggaggcggaaaggcuaugcuagacccaccacuucaaagcauaaaaagccucggaaggaugaucugcaccuuaacugccugccaagcccaacccaacuccucagagaaagacaacaaaauccagacauucaaaaguguacaccugacaauauccaacaaccaagaaaaacuugugaaaaauguagaggcaggaaaaugaggccaaaacccggaaacaaaauuagucagucgaaacagaccccaaaaugauggggaagaugguaugagaagaaucguagacccuaaaaccauuaucaauuugcucacgaggauguaaaagaaaacccaaguaccaugagaagaaauaaggggaaacuauuauguuagaaacaaaguuaacuggaugggcuucacagcuguuaggcacugcagaagaaaugauaucugacaacagaaacuacccaaacuguagcucaaggaaaaaggcugggccgggcacgguggcucacaccuauaaucccagcaguuugagaggccgagaugggugggucacuugaggucaggaguuccagaccagccuggccaacauggcgaaaccccgucucuaccaaaaauacaaaaaaaaaauuagccgggugugguggugggcaccuguaaucccagcuacucgggaggcugaggcaggagaauugcuugaacucgguagguggagguuacagugcgcugagaucgcgccacugcauuccacccugggugacagagcgagacuccgucucaaaaaacaaaaaacaaaaaaaaagaaagaaagaaaagaaaaaagauaagaaaaagaaaaaaggcugaaauaaaaaaaagaacagagcuucgguguccugugagacaacgucaagaggccugaaauagaugugauuagaguccuaggaaauaaaguggaaagaggaaaagauagcugaagaaauaauggccaacguuuuccaaauuugcugaaaaaaaccaacccacagaucaaagaagcuuaagaaacccucagcgggauaaaggcaaagaaagccaccucaaagcacauaauaaucaaauucccgacaguaacacuaaagagaaaaccuuacaagcagccuacgagcauuggggugucacacacacaggaacgaacguaagacauucagggagccuccagugaccccccaaaacaacgugggcgagaagacagcgggucacaccugaaagcacuguuggaggaaagaacuaaaaacaccaucaaugccaucaauaauuguuuaaaacuuuaaaugcaauuucuucaguauuuuuuaaagacacauuaaaauguaucuauuacucaccaauagaaaacuuaggaauuuuaaauugauuuguaggaguaggcauaaccuuugucuuggaauuuagacaggaaucucgccgucugauacuucuagucuuauucaauugagaagauucugaccaagcgcaacuggaguucagccacuggccgccaccuuccggagucugggguugggugggggaugcugaggggggugccgugagcugcuccgcugccagcucagaaacaucgacccgcuuggccugccaggaggaugcccccacagggccugcaggcagagcuggccgcagcauggcgggucccauucugccugacuugcugauguuugacagaggccgggagcuauuugcaggaauacuugcaaauucacuugauuuagcuagaagguauacacacaaaaaucacauuauuauaaaaguaugaagcuauuuaacaaacacacagaaguuaugcugucuuuagcauaucuaccuuaaacauaagacacauuaacaauauucuauaagcccuucaggcaacaucaucaaacacaggauggcucaggcagcuuuuagcuuagcugaguguauucuaagguacuuauucucaaaauaauuacuaacauguacauaagcaugcauaaauucaagcucuccuaucuucguugauuauguuggcaggagaaaucuacauuaguugagcagauggaaggggauagucuagucacaugucucaccugucuggucacagaggugggcagggaacaaggaaaaaagacgcaauuguuacugguugauuccuuuaaaauuacaaggaggcugcgucauauuaaccauaagcacuauuuaaaauagaagaccagauaaacuaggguaauacauacugagcuaccaauauacgcagacgaucugguaaaggauucuuaaagaaaaacuuuagcccaggagugguggcucacgccuguaauccaaacacuuugggaggccaaggcaagagaucacucaaggccaggaguucgagaccagccuggcuaauauagugagaccauccucucuacaaaaaacacaaaaaugugggccaggcgcaguggcucgugccuguaauccuagcacuuugggaggccaaggcgggcggaucacgaggucaagagaucgagaccauccuagccaacauggugaaaccccgucacuacuaaaaauacaaaaauuagccgggcgugguggcaggugccuguagucccagcuacuugggaggcugaggcaggagaaucacucgaacccgggaggcagagguuguagugagccaagauugcgccacugcacuccaaccuggcaauagagugagacuccaucucaaaaaaaaaaaacccacaaaaauuagccgggugugguggcaugugccuguagucccagcuacucaggaggcugaggugggaggauugcuugaucucaggaggucaucaccucagucuauaaagauaaggacacaaaccucucuuaaucacagaauggcagagucagaauuccagaucagaucaaucugauuagagaguucacacuuaucauuuuuuuuuuuuuuuuugagacggagugcagugaugcaaucucggcucaugguaaccucugccucccgcguucaagccauucucguggcccagucucccgaguagcugggacuacaggcacccgccaccaugcccggcuaguuuuuguguuuuuaguagagacaggguuucaccauguuggccaggcuggucucaaacuccaggggucaagcgauccacccaucuuggccugccaaagugcugggaucacaggcgugagccccugcgcccggcccacuuuuuacauuuugugaacacaauccacaccaugcugcccugaacgaccccgagacgccacauggccaaugcaccucgaagaggauuucgcucugaagagcagaaaggcgaaggcuuucccuuaccacuagauggcagcuguggcuuggcaagguugaaauguggcuugaccucaaacaggugugggagcauggauuuaaacaggcacccaggaguuauggggccauaugcccuacauuaucuggaauaguccuauuuuaaaacuggugucucaugacauggacaugagggugauuccaguguccauguucucaggcacgggguaucauacaugcuuucuggccauguguaccccguagacugaagccacccaucugagugugcccuccucaugggacagaggcacugagggcagguacagcaacucaguccacagccugguccaccgcacacagcacgcccuccgggacguccugccaagccuaagugguucugcagaaacagucuccaaggccugagcagcacuccaggccucaccuggccagauguggguccaagcaugaugccggcugccucaccuuugcccacugcuggggaugugcacgcacuggaugccccgcuccaaacaggccccgaggaggacuuccuugcgagauugcugguagagccgggugcuuuuaacagggucuucuucagccccaacuggggcaaaaugugaaaaaacagaaucagcaaagaucucguuauuuaccuauuacuugugucugcaaaaguaagggguuuuuggcugggcacgguggcucacgccuguaaucccagcacuuugggaggcugaggccggaggaucacaaggucaggaguuugagaccagccuggccaauauggugaaaccuugucucuacuaaaaauauaaaaacuagcugggcaugguggcaggcaccuguagucccagcuacucgggaggcugagguaggagaauugcuugaacccgggagguggagguuguagugagcugagcucgugccauugcacuccagccugggcgacagagugagacuccgucucaacaacaacaacaacaacaaaaguugguguuuuuacuauuuuaaaauaaucuaauaauuaucaucuugaauuuaaagaagaaaaaagucaagcagcacuucucaaaguguagucuucaaaccccugcaugaggaccacauuagggagcuagcagaaaugcagauuuggggccccaacccagaccccaugagucagcagcugcagggcccagcuuugggcaguucuaacaagaacugccaguacacacagcuugguuuaccgccaaugccagaaaauaaguggcaaagauguggcugguagucuccaugccugugaggaaccgcaauuuucuuucuuuuccuuuuuuuuuuuuuuuuuuuuagacagggucucacucuguugcccaggcuggaauggaaugcaguggcaugaucacagcucacugcagccuugaccuccugggcucaagcaauccucccaccucaaccucccaaauagcugggaccacaggcaugcaccaccaugccuggcugauuuuuauuuuuuaauggagaugggggccucacuauguugcccaggcuggucucaaacuccugggcucaagugauccucccgccucagccucccaaagugcugagauuacaugugugagccacugcacccagcugcuguuuucaaaacaucaacaucucaugucaucuguucaagaacucuacaugagggaaacggaauauccccaccuacaaacuggggcuccgagacgcugacuuuucccaacccacacagcucccagggcagaggcuagccaucagugcacacugcgaagccaguauucuuugcauguauuuugcaggcugccucuuguggguguauuuucaacuuuuccaccucuuuuuuuuuuuuuuuuuugagacagggucucauucugucacccaaccuggagugcaguggcgugauuaugacucacugcagccucgaccuccugggcucaagcaaucaucccaccucagccuccugaguagcugggacugccguugcucaccaccaugcccagcuaauuuuuguauuuuuuguagagauggguuucaucauguugcucaggcuggucuugaacuccugggcucaagugauccucccaccuuggccucccaaaaugcugggauuuuaauccaaagcacuuguacacacagcugccaccucauucccagcaaccacaaguuugggccccagcagccaacucaccuuguuuggaacagggaucgcccgcuugcccuggcccaaguggcuuccggcggccggcacauugacagcacccggggcagguuugucagggagaacaucccggugggauuccuucucagcugggauuuuuguccuggaaggacuagcuggaaucucuuucuugggcugaaaauuuuaauuugaacugugagaacugucuagugcuuaacaauguacagagauacucaggcuuccauucagagcgagccuaggccccaucuuccccagugcuacacaugccccuccauucaucagccagauugaagggaacagggcaagcaguucgcauccuccaccaaaucacuauggacauaagugaugauggauuuugcuuccucauuaaaaacagcaucaaaugauaccuacacagaucauuaauaggagagagguucucuaaagccauuccccagucaggauccuuauuuaagaaugauaaugagaaagcuggucuaguuacacaaauuuuaaaaugcuguacagaaaggacucauccauuaaauggucaucucuaccagagaagcugcucaauugcaauaaaucuucuuggucuaguacugaaagccauuuucuuuggccagcagagucaaaaaauaaguucuugacauauuuagggacaagggcauucauggaacuaauuuauacuuacauaaauagcccccuuauaacaggagaguuaauaagguaacagcaauagaagcucagagugguaaagacgcagcaguaacuuuuucccuuuauagcauuucuaaaaacugagauacuucucauaacauaaaauucacuauuuuaaacaguauacuucagugguuuuuaguagaucuguuauguuguacaaccagcacaagcuaaucuuaaaauauaguggugucccaaaaaagaaccuguacucggccgggugcaguggcucacgccuguaaucccagcacuuugugaggccgaggcgggcagaucaccugaggccaggaguuugagaccagccugacuaauaugaugaaacccugucucuacuaaaaauacaaaaauuagccgggcgugguggcgggcgccuguaaucccagcuacucgggaggcugagacaggaggacugcuugaacccgagaggcagaggaugcagugagccgagauugcaccauugcacuccugccucggcaacaagagcaaaacucugucucagaaacaaaacaaaacaaaacaaaaaaaaaaacaaccuguacccauuagcgguucuccccuuucccucauccuccccagccccaccuagggaagcacucaaccacgccucugucauuggccugucauagucauuucauauaaauggaaccauacgacaugggaccuuuuguuauggccucucucacugagcaaaauguuuucaguggugccaucuuggcucacugcaaccuccaccuccuggguucaggcgauucuccugccucagccucccaaguagcugggauuacaggugugcaccaccauacuuggcuaauuuuuguauuuuuuuguagagacgggguuucaccauguuggccgggcugggcucaaacuccugaccucaggugauucgcccaccuuggcuucccaaagugcugugaucacaggugugagcuaccacgcccaguaguguuucuuuuuauugccaaaaauaaaccauuguuuggauagacugcauuuucguuacccaaucaucauuugcuggaugccuggguugguccuacuuuuuuggcuguuaugaauaaugcugcuucgaacaucugcauguggauuuuucuguggauaugguuucaauucucucaggucuguguacuaaggaguggaauugcugggucccaugggacccucuacauuuauuuuuuugaggagcugccaaacuguuuccacaacagcugccccauuucacagucccaccagcaaugcgugagcuuccagcuucuccacauccucagccuucuccucauccuccacaacauccucauccucaaaauaacaccuguuauuuucuuuuucuucuuccuuuaggcauccuagcaguucucugucaagcacacuuguaaguagguguuacacucaagugguccacccauugcuaaugacuccucacaggagugagcaugugccaugagccacucuagaagugacuucucccagagaaacaugcaggacaugguggggcucccacgugugcaugagugcaucucagcugugcggacagugcccuguccacugggaacaagcucucuggaccccagcucaccacccaggaccaggagaucaaaagagauacuucgaugggucuggagcagcccaaaucacaccaccucucuccccgaguccacgcgugcuacaugcacaaucccugucccgaguccacgugugcuccacacagcaggacccaucccacucucauucuagaaacaucacgguaggaaucuacaucccaaacgggcuccaaauaaaggaguuugcaggccccagcuguuggggguggcagugccgggcauaccuccuugucaagggcaguguguggcguggcggcugcaccucggcugccuuccauccuuggcucucaccacagggagucauguggcucaggagaugggcuugguggggguaaaggaauuucugggcccuugcugagcauucugcauuugccugcaccuccuaucagccccacccagggucauuccucuguacgugcugcccaggggagggggcagagcugggaacgggcugcagggugggccccggggcucccacccgccccgucuuccucucuguggccucucccgagcaagagccagaucgggcagcccuggcagcaaguccugugcucacacccagcuuucccccagaccuccaggacccucagugucccagaguaggcagacugcacccaaaggcaccccugucaacugccaccucccaggaaagcucaccucacucagugcccaggaggaaugcaguguaaacugaggcacggucaaggaggcugacuagcagccauugcagaggaggggaguuuuuggaagagguugcuuauuaaagcaaaugaaaucccuacugugugguauauccagcauuguaacaaaacaaaaggaacaacuucagacagaauuuaggaggaaauauuaggucaacccaacuuauccaagccacccccacaucagcucccuauuggcaacugcuuuuccuggacuccgcauuccuguguuuuguaggccucagagacucgccaccucugaggcuuuccgcauguggcuucugugagagggcugaggggcaaggagugggggcuccccaggcaggcgcucugcuguggcauuuaccuucuccgcagccccagggaugcuucuuccucuaacagaggccgcucgaggcagcagcaauuuggucccgggcuuccucugagucgcugccugacuugcagcaugagcagugcaugauucccugggcaaagcaugagcagagugcggaggccccggcgcccgggugaggcgggccugggcaccagagcugggcagggccggggaggaggccaagagccgaggcucacccacagggggccccagcaaggggcugucugacagguaguaugucucccuuuuaagagacguggggcuuuucuucauuuccuuuucuuucucaaagagguuuauuuuuaauuuugacuccuguaugaaucuuuccacgcccuggcuccgagggucuucaggcuuggcagcuugggcugccugguuccggcugcugcucucaauguguaaagccaguaagugagcuucuuuguacaccuccacgaacuucuccccggccagagggcuccaggcaaagggacucucagaugugggcaacggaggcuguucgggaaccggauuauuuaauuccaagcuggcagcaauacaucuuucuuuauguccaaaggguccgaagaagacuucaucaucuucauuugcacuauuuguuuaaaaaaagaaugauuaauaacucauaacacuggcauuuaaaggaaagacuuuacugaaugugguuaugcccaaggcaagggaagaaaacucauuuguuuaccucgaagaagacaaugaaagaucgaagucaaauuuuucaucggccaaaagaagaaugucuagagggaaaaaauccacuguuauuuuagugccacagcugauaaagagaaaaauauuaccaggcucuauggcuuggaauuaaauaaagguacugugaaauuucacuccccaaaguguauccugucaugaugcuaauuuaguuuuucauagggggcucuaaguuauauuuuuuccuuuuuaaaaaauuuuuuaaauuuuuucuagugacgaagucucgcuauguugaccaggcuggucucgaacuccuggccucaagugauccuccuggcguggccucccaaaguguugggguuacaggcgugagccaccaugccuggccaguuuuuuuuuuuuuuaauugcaucagccggcugggggcgguggcuuaugccuguaacuccaacacuuugggaggucuaggcgggcagaucaugaggucaagagaucaagaccagccuagucaacauggugaaaccccgucucuacuaaaaauacaaaaauuggcuaggcaugguagcgcacaccuguagucccagcuacucggaggcugaggcaggagaaucgcuugaacccaggagguggaaguugcagugagccaagauggcaccacugcacuccagccugggugacagaaagacacucugucucaaaaaaaaaagaaauuacaucagccauucuauguucacuaagccacccaaaagcuuagguccuuacuuuuaagauauaaucuaaaaugcauucacugacucauucaacuagcuuuucaagaagagauaagucauuuuccagguauagaacauuuucaaaagaccaccuuccucagcuccccuagaauuaaauuccccucuuacaagcuacaaaacaucuauucauaguucaacaaugaauuuaauauuacucaaaugcacggaguagggacucuauaagaauucguugaccgccauugcuucuuggaguccuuccugaauccucagaugaaauuacucuguaccccaccccauccauaauucuaucacagcuggcauggcccugucugcccaggucccucuaaaacagaucacaaguuccagguuagugggucccucugcaggggcaccugcucccuccuccagcuccccgcaaggcucccgcagugccuggaccucacuucuaccacugcacuagccucugugagugccucuugacccuucuauggccccaacuagacuauaagcuccuccaagauaacagugucuaacacuaacccaaauucccaaauguccagcuaagggccuggacacuuagcaaauauuuaucaaaaugcacugaaauacaguauuugcucaauacuguaaagcuuauaaagcucucccauaaauguuuuuaucuuaauaaacaaugaaggccgggcaagguggcucacaccuguaaucccagcacuuugggaggcugaggcaggcagaugauuuguggucaggaguucgagaucagccuggccaacguggcaaaaucccaucucuaccaaaaauaaagaauaaaaaaauuagccgagcgugguggugugcaccuguaaucccagcuacuggggaggcugaggcaggagaauugcuugaaccucggagguagauguugcaaugaaccaagauugcgccacugcacuccagccugggugacacagcaagacucugucucagaaaacaaaacaaaacaggcugggcgcaauggcucacgccuguaaucccagcacuuugggaggccgaggcgggcggaucacgaggucaggagaucaagaccauccuggcuaacauggugaaacccugucucuacaaaaaaugcaaaaaauuagccgggcgugguggcaggugccuguagucccagcuacucgggaggcugaggcaggagaauggcgugaaccugggaggcggagcuugcagugagcagagaucgcgccacugcacuccagccugggugacugagugagacucugucucaaaaaaauaaauaaauaaauaaaaauaacaacacagcaugcuucucaaaaaucauaaaauuugaaaauauacuaauauccuaauuugguccugauuaaucaauuauucuuaauuaccuaaucaaggagaagucagaacaaaugcacaaaagaaagaaaagagaaauaaccacacagagagggaaugaaaagauccauaagcacaucugucaacuucaugcacauaaaccuaagaacuuggcugaaagagauaauuuucuaggaaaauauaauuuuauuuauucuuuuuuuuuugagauggagucucacucuguugcccaggcuggagugcaguggggugaucuuggcucacugcaaccuccgccucccagguucaagagauucuucugccucagccuccugaguagcugggauuacaggcgcgcgccaccacaccgggcuaauuuucguauuuuuaguagagaugcgguuucaccauguuggccaggcuggucucaaauuccugaccuuguguuccaccugccucagccucccaaagugcugggauuacaggcgugagccacugcacuugguauauucuuuuuauuuuuuugagauggagucucacucugucacucaggcuggagugcaguggugugaucuuggcucacuacaaccucugcuucccagguuccagcgauuuuccugccucagccucccgaguagcugggauuacaggcacgugcuaccacgcccagcuaauuuuuuguauuucuaguagagacgggguuucacaauguuagccaggauggucucgaucuccugaccucgugaucccuccaucucggccuuccaaagugcugggauuacaggcgugagccaccgcauccagucuauuuuuuauuuaaauugucuaaauguacuuauuuauaaaacugacuccagaagacagggaaaaucuuaauacuucaauaaucauaaaauaacuggugaaauuuauuaaagagcuauccucuucaaaaaagcgucccaacuagauucauaggauaauuguaucaaaacauuaaagaacaaauaauuccaauacuauuuacaucacuccagaggauuaaaagaaaaaaaacuuuccaacuuacuuccacgaggcaaguaaguauguuaccaaaaaaccuagaaagugaucaauaaagaaaguaaagaccagccuuacuuacaucagcauaauaauccuuuuucuuuuuuugagacagggucucgcucugucacccaggcuggaguacagugguacaaucauagcucacugcagccucgaacuccuggacucgagggauccuccugucucggcuucccgaguagcugggacuacaggcacgcacaaccaucccuggcuaauauuuguauuuuuuguagagaugggaucuccucauguugcccaggcuggucucaaacugcugggaacaagcauuccuccuaccuuggccucccaaagugcugggauuacagguaugagcuaccacaccuggccuaacaucaaacucuuuaacaagaauaccagcaaaaagaauccugcaaacauuaaagugguaauaacauaacacaaccaagcucccugcauuucaugacugugagaugguuucauuucauacaaucuacucauauaaucauuuuauuacuagagcuaaagagaaaaccaugaucgucugcacauauguugaacgggcauaugauaaaauacaacauacauucuugauuuuagaggcucuuaauaaaaaguaauagauauauaaggaaauccccaucucaacccaaagccagcauuagguucagugggauaacgucagaaguauuccuucuaaagacaggaacaaauugaucuuaccaguuaggauaggcuaacaugcugaaguaacaacccuuaaaacaacaaagguaggccagguaugguggccugugccuguaaucccagcacuaugggaggccaaggaggaucacuugaggcccagggguucaaggccagcccucgcaacauagcgagaccccagcucuacaaaaagaaaaaaaaaaaugagcgggguauggugccauauaccuguagucccagcuacucaggaugcugagcccaggagcuugcggcugcagugagcuaugaucaagccacugcacuccauccugggcaauagagcaagagacacugucucaaaacaaaccaaaaaccacaaagguauauuucucacucaaacuauaugucugcagagggguaggcuggggcccugcucccuggccuccucacuccaggaccccaacugauggagccuccaccaucaggaacaccgcucgucuccauggcaggaaggaaaagaaccaauuccacacugguucuugaagauuuccacccagaaaugacacacacgacaacauucccauuucacuggccaagugagucaccagagccaacugaauuucaagugaacagggaguacaauucuauuacaugcccagaagacaaacacauagaaaugcucaugaauagcacaccuacgacuaccauuuacuuggaaauuaacccauaacccaguaucggacuuaaugaaaaaccacagaagcaauuccauuaaagccaggcacguggcaaugacaucuccaagcacaauucuuaacacuguucuggacacauaaagcaacacagucaggcaaaggaaggaauguggagguaacaugaucacacugcacagaugccaugauuauagacacgagaaacaaaucaagaagaucaacuggaaacuacuauaaguaguaaaaggauaaaagaacauggcuaaggacaaaaucauuacagagcaaucaacagcuuucauaucuacaaagaacagugagaagauaacauggaagaaaauacuucguuucuagcagcaacgaaagaugcaaaauaacgauaaacaaaccuaacaagaaauaugcaaaauggauauaaagaagacuuggcauaucauaaaaguaacauaucaaauaaagagggaaaguagaccgggcaggguggcucacaucuguaaucccagcacuuugggaggccgaggaggguggaucacaaggucaggagaucgagaccauccuggcuaacacggugaaaccccaucucuacuaaaaaauacaaaaaauuagccgggugugguggcaggugccuguagucccagcuacuugggaggcugaugcagaagaauggcaugaaccugggaggcggagcuugcagugagccaagaucacgccacugcacuccagccugggugacagagcaagacuccaacucaaagaaaaaaaaaaaaaaaaaagagggaaagugaaaaaaugguauuaaaauaaacuacauaaucaucuggaaaaaugccaacuaaguuugguccaugccucacaccacaucaggccuaauuccaaacaaaucaaggacuuaauggaaaaaaaacaaagcccuaaacaaacaagaaucagcuaugaggaaacuuuuguaacuugggaguguggacuucuaacuaugacacuaaacuggaagcuaccaaagauuggucggcugggcccaguggcucacaucuguaaucccagcacuuugggaggcugaggugggaggaacgcuugagccuaggaguuugagaccagccuagacaacauagggagaccuugucuguacaaaaaauacaaaaauuagcuaggcgugguagucucagcuaccagggaggcuuaggaaggaggaucgcaugagccugggaggucaaagcugcagugagccacaaucucgccacuacacucaggcccaggcaacagaacaagaacaugucucagaaaauaaauaaauaaaaaauaaaagauugaccuucaaacauuaaaauuuuaacaucucuguguggcaaaaaucacaauaaguuaaacaagaaauggggaaaagaauauuugcaacucaguucauaaagggcuaauucaugaagcauaucuauaaaguaauaaaaaauuaauaaucuaauaaagauagaaaaaggauacaaacagauaaaguucacagaaaauaaaacaaaacauucuuuuuuauuuuucuuuauuuacuuuuuuugagacggaguuucacucuuguugcucaggcuggagugcaauggcgcgaucuuggcucaccgcaaccucugccuccuggguucaagcgauucuccugcccuagccucccaaguagcugggaucaguaugaaccagcaugucuggcuaauuuuguauuuuuaguagagacgggguuucugcauguuggucaggcuggucuggaacucccgaucucaggugauccgcccacccuggccucccaaaguguugggaugacaggcgcaagccaccgcaccuggccgaaacauucuuaaauagauggcaagaaguucagccucacucaaaaauaagaguaaugaggcugggcgcuguggcucccaccuauaaucccagcacuuuggaaggucgaggcggguggaucaccugaggucaggaguucgagaccagccuggccaacauggugaaaccucaucuuuacuaaaaauacaaaaaauuagccaggccugguggcaggugccuguaaucccagcuacuugggaggcugaggcaggagaauugcuggaaccugagagggggaguuugcagugagccgagaucgcaccauugcacuccagccuaggggacaaaagggaaacucugucuuaaaaaaaaaaaaaaaaaguauuaaaaauaaacuugcucugagaaugcaguuuucgccuauaugacuggcaaaacucaaagauguaugaacuauaggcaagguuguggggaaagagacaauuucuacacugcuggggaagguguaaauuaucacagcucucuagagggccuggcaguaccuaucgaaguaagaaacacacacccucuucgacccagcaagucuacuucugcaaguguauccuacagacacucacagguguggaaagcaauguguugugcaguuacacgguguccacaguuauuuacugcagcaucauugguaacagcaagacucuaggcacaaacuaaauguucacccacagcagaugagaugaaugacauauccccaagguggaacccuauauagguacaaaagcuaguaaugcucuucauguguugauacacaauauucaucaagauaaauuaagccugaaaaacaagauucaggacagggcucuccaugcuauauggaaagggggaugcaacacucuaugcguguuggcuugcaccugcacaaauuaugucuggaaggauacccaagagacugaugacaucgauggcccuuggaagggcaaguaggugacuuagagauauagagaggcagacauuucacuuuuuacaccucuaaauuaggaagucaauuucagaaacuucuaauggucuggcguggaaaaagaauccaggaccagaacucagggaagcagucuucugcuccaggcucugugacuggcuccgaggggucccgggcuggcugacuugcucauccugcaaacacaugagcacccacaacagaccacauccuucgcuaggugccaggcaggcuugggguacaugcagcccacccuggagggugccucaggcagugcggugagagacauguagaggugggaacaccucugagaaaauaucaaagcgugugugagaggaacgggucagaagucagaguggcuggaagaggugaaaacacaaguugggucagaucacagaggguuugcaagccauggcaaggagcuuuuauuuucuccaaagugggauaggaaacuauuaccgggcuuuaagaaaagaauuuuaggccuggcgugguagcucaugccuguaaucccagcacagugguaggcugaggcaggcggaucacuugaggucgaguucgagaccguccugaccaacauggugaaaccccgucucuacugaaaauacaaaacuuagcugggcacgguggcucaugccuuuaaucccagcuacucaggaggcugaggcaggggaaucacuugaacccaggagacggagguugcagugagccaagaugucgccacugcacuccagccuggugacagaacgagacuccaucucaaaaagaaaaaaaaggcugagcacaguggcucaugccuguaaucccagcacuuccggaggcccaggcgggcagaucacgaggucaggagauugagaccauccuggcuaacacagugaaaccccaucucuacuaaaaaaaaaaaaaaaaaaaaaaaaauuagcugggcgugguggcgggcgccuguagucccagauacucaggaggcugaggcaggagaauugcuugaacccaagaggcggagguugcaguaagccgagaucacgccacugcacuccagccuggccaacagugagacucugucucaaaaaaaaaaaagaaaaagaaaaaagaaaagaaaagagcuuuauaaucuaacuuguguuuuuaaaaggugacguuacuguguagaaaguguauccgaaaggaagcagauaauauccccugacauuacaaaugcacauauuagccaacgggaaguagaagccggugagacagcguggcugagacccagacagcagcauguggauggagauggagagucuguagauggauucaggauaucuucugaagguggagaagacguuagcuggugauggcaugaauguaggagguucucagcuugcacagcugggugaaauggagaaauaaaaugggugaugagaaagacaaaaagaacaggguaugcagaugcagaggggguaugccaaguuugagaugagacgugcaugugaagacgccaaauaggcaggugaauauacaagcccagagcucggaggagaggcugcgcucaagacaaaacgugggugccgcagagagcagauacgcugcacagcuauuggaaugcugaccgcccugagggcgaaagcacaaagcggucccagagcaggucuuggggaaaucagccucagaagacagcagagggggagcccccgacagagaaaagauacaccagccagagaggcaggaggaaaaaaccaagagcgucuuggacuccaagcaagggaaguuuccagaaggacgaauguuacugaaaagcugacuggcgauagaaaagugaaaagagauucagcaauguggaagucgucaacgacugaugaaagcagcuugaauggagugguaaggacagaagccggaaugggagggauugagaggcggaaaaaaauggcauaacaagugagaaagcucucaaaguuuggcuuggaaggagaaacacagcaauggagaggcaacggaggagacguggcgacaagugagacaagggaacauuaucuguauguggaugcgcaugauccaguaguggacaggggaaaaguaaggaaaugaagucaggucaacggaaguggggaaggccucaagaaggagcagggggugcaguaugcacguggaaaggacauauuugaaaggaaggacaugacaggaaggaggagaggggugcagaggcaagcgccuugcuagauaugaagaugcaacauugauuuguaaagucuccaggacaguuccugcaaaauggaggcauugaggaugcuuggggccaggcgcggugguucacaccuguaaucccaguacuuugggaggccuaggcagguggaucaccugaggucaggaguuugagaccagccuggccaacaugguaaaaccccaucucuacuaaaaauacaaaaaucagccaggugugguggcgggugccuguaaucccagcuacucgggaggcugaggcaggagaaucgcuugaacccgaaaggcagagguugcagugagccaagaucaugccacugcacuccagccugggagacagagugagacuuggucucaaaaagaaaggauccuuggguagugugagaaaacuacccaagggaugucaaaaugcuuugugaggcugggugagguggcucacaccuauaauccuagcacuuugggaggccgaggcaggcagauugccugagcucaggaguucgagaccagccugggcaacauggcaaaaccccgucucuguuaaaaauacaaaaaugagccagguguggcagcgggugccuguaaucccaguuacuagggaggcugaggcaggagaaucccuucaacucaggagagagagguugcagugaguacagaucacgccuuugcacuccagccugggugagagagcgagacuccgucaauaaauaaauaaauaaauaaauaaaaacgcuuugagagaaaaagaggguguggccuguaacucauucugugaagcuguacccucaccuugauacccaaaccagucaaagacacaagaagaaagggguuuggggccaggcuuacucauuaacauggucucaaagauccuaaauaagucuuagcaaacagaaaccagcgacaaacaaaaaagaaaacaucgaauucaauacaauaaauauuugagagcccacaaaguguuaggugcuguucagggcaugggagcacugcgguaaauaaaacggaugagaauccuggcugugaugaaacuuaaaauggggaggaggugaaagaaaaccagaaaacgaaggcagaugucauguguuucacaggugcagaguacaagucgagcacuugagaaagaauuucucagggaaacauuaaaucacccuccaucucuacugaacauccugaacaacaacagcgccgcagcagcaaggacuugccuuccuucuuagggucauccauguucacguccccugcccggcaggcugaaggcucaucgcggccgccgccuccuuccauggagagagcugucagaagucacugcaggguggaacggggccagaaagugaguacgugucagggcccagggcuccggcuuccuucagcccucggcucacagaggcagagagagcugaaggccgcggccaggucugggagaggcggcgcgggggccgcucugaaaugaucgcaucccaggggaccccagggcccgagugccgccaggccgggagucagcccgaacgccaucagacgagauaacggaauucucggcuucugggccagaguguugggggcucuguuugccuggggggcagcccuagaccucccggcauccccgaccacggcgcgaggggccucagugaccccugcucgagcccaggcccggcuccuggcggggcgcggccccuccccgucccgaaaacggcgggcaccgcgccgcaccgggcccaccgggcaagccucgcccccgacccugaccccaccuuacccaaagcggcagacgaugcaggacgcgccuccggcacggauuuaaacgcggcgccgggagacgcggguugccgauug

SEQ ID NO: 17896 - RNA, 1375 nt, Homo sapiens
caguggcccgggcggcgggcggcgggcggcgggaggcggcgcugcgucaccccguacgcgggcggcggggaccgcggaggggacgggcggggcgggggcgaggaggaggcguggguagaggaggggccgggagccagggagagacggggggacccgagaaggggagaagagggaggaggaaggggccgggauggggcuggccgaggccagggcgcuggggccgggaggcggcugccuuucucuccucucuucuccggcgggugccgggugcugaaucuggcgcucccgcggccggccgggacucaguggcgccuuccgcgcgggccucgguucaggcgggguccgggcggcguggaaacgcaguccuggcgaucgggcgcggcggggggcgggccuggaugggggcgccacgggcgacgugaccuugggcggcgggugcccucuacgauccuggcguccugucggccugggagggggccugcagcugggccccgacaggcagguaaggcuuucaggaggcggaggucuuuuuagggggcgggggcgcuggcccuuugaacugcucuggggccugaagccacagagcagacagcugagcagccgcccccgagcuggcccuaggaaccggagccugggccccagacuuggagagacacggccccuguggccccaauucaccgccuccccaggaaggccuccuugaccccacagcugaaggaaucaccagccugcagggacuccagcccugccuucagagcacgccgugcgccuucaugcaagcuccagucucugcguccgcagugcuuaacacagccccauaggaagcagccacaaccugguucggagggcacaucccucccugauuuaucagugaagacugugcucacagagguuaagucacuugcccaagagcacagggcuccaguguggcagagccuaggcucacacugacacugccuggaugugacacugaggucugaggccugccccuccccucggcuccccuacccagcccugcugcugcaggcagaggugaggugggcuagguccacguggccuugcugcugugccuggcaccagguggcagcauauacaggucuuacccugccagcuccuugugacugucuugucuauagggcgggaaccagccaugaaucauuccucccugggagcccagccccuguucaggccaugcagugaaggccccaggacaguccugcagccaccgugggcccagucagaguccuagcaggcaguaccugaucguggcacacaguggggugugcagcagcgaggccugcccagccuccucccucccucagcugccgcucugaggccugggaaauguggaucugaaacuuacuuggaaagaaaa

SEQ ID NO: 17897 - RNA, 1022 nt, Homo sapiens
cacuaaagcuccagucugaaaugacagucccugagcauucaaucuuuggucuaagaagcacagaaauguaaugcaaaccagacacgguuuuuuuagugauuuucugcacacacacacacacacacacacacacacaguaaaaagaucuagucauaacgugugcaccugcaguuccaacuacuggggagggugaggcaggaggaucacuagagggcaggaguucgagacuagccugggcaacauagcaagacacccacccccagucccccccggaaaaaaagaauaaaaaagguaaaaauaauuuuaaaaagaguaaaaggaauguaaaaauaauuuuaaugcauuuuauuuaauccaauacauuaaaaauguuaccuaacaugcaaacaauauacaaauuauuuuauacgacgucuuuggaauccuguauuuuacacguaaagcgcaucucacuccggacuagccagguuucaagcacgugauagccgcacaaggcuggaacccaggccuggggaauuaauucuuguccucggugcucaaaccauucuucccuucaagccuggccuaauccccagucucucucaucucuucgaauacgcuccgcgguuaugccccucaccucacugcacugcaaauauuucguccacugaguauuugcugaucgucacucagugccgggugacccagcuugaccagcacccgcagccgcccugccacuguugggccggguauggugugucuggcuucccucuguucugggccggcuccgaaacgcgcucaagagaaaucggaaucagacacggggcaguucagcuuuggaaaugaggagcucgaggcuccugggaguccguugcgggcaggugggcgccgcuguugugucgggagagccaggagcgacagacucaaacucagaaacccaaccaccuccgcucccuccgcgaugcguguaacgugcguugcgcggcgucgcccuuuaauaacgacgggcgcucggagugcugcgucacucgccaccagggacu

SEQ ID NO: 17898 - RNA, 1022 nt, Homo sapiens
agucccugguggcgagugacgcagcacuccgagcgcccgucguuauuaaagggcgacgccgcgcaacgcacguuacacgcaucgcggagggagcggaggugguuggguuucugaguuugagucugucgcuccuggcucucccgacacaacagcggcgcccaccugcccgcaacggacucccaggagccucgagcuccucauuuccaaagcugaacugccccgugucugauuccgauuucucuugagcgcguuucggagccggcccagaacagagggaagccagacacaccauacccggcccaacaguggcagggcggcugcgggugcuggucaagcugggucacccggcacugagugacgaucagcaaauacucaguggacgaaauauuugcagugcagugaggugaggggcauaaccgcggagcguauucgaagagaugagagagacuggggauuaggccaggcuugaagggaagaaugguuugagcaccgaggacaagaauuaauuccccaggccuggguuccagccuugugcggcuaucacgugcuugaaaccuggcuaguccggagugagaugcgcuuuacguguaaaauacaggauuccaaagacgucguauaaaauaauuuguauauuguuugcauguuagguaacauuuuuaauguauuggauuaaauaaaaugcauuaaaauuauuuuuacauuccuuuuacucuuuuuaaaauuauuuuuaccuuuuuuauucuuuuuuuccgggggggacugggggugggugucuugcuauguugcccaggcuagucucgaacuccugcccucuagugauccuccugccucacccuccccaguaguuggaacugcaggugcacacguuaugacuagaucuuuuuacugugugugugugugugugugugugugugugcagaaaaucacuaaaaaaaccgugucugguuugcauuacauuucugugcuucuuagaccaaagauugaaugcucagggacugucauuucagacuggagcuuuagug

SEQ ID NO: 17899 - RNA, 3601 nt, Homo sapiens
ugcgccugcgcggagugagagcgugagcgcggagagcggaccgacgcgacacgccgugcgccuccgcggcugcgcuacgaaaacgagucccggagcggccccgcgcccgccgcacccggcccucgcccgcccgaagacaggcgccaagcugccccgccgucuccccagcuagcgcccggccgccgccgccucgcgggccccgggcggaagggggcggggucccgauucgccccgcccccgcggagggauacgcggcgccgcggcccaaaacccccgggcgaggcggccggggcgggugaggcgcuccgccugcugcgcgucuacgcgguccccgcgggccuuccgggcccacugcgccgcgcggaccgccucgggcucggacggccgguguccccggcgcgccgcucgcccggaucggccgcggcuucggcgccuggggcucggggcuccggggaggccgucgcccgcgaugcugcucuccaaguucggcucccuggcgcaccucugcgggcccggcggcguggaccaccucccggugaagauccugcagccagguacgcgcggggccggcggggccggggccggggccagggcggggaccgggggcgccccgggccgcaccaaccccgcccgcgccucccugcagccaaggcggacaaggagagcuucgagaaggcguaccaggugggcgccgugcuggguagcggcggcuucggcacggucuacgcggguagccgcaucgccgacgggcucccggugagucggaccgccgggcgggcccggguuucucgcgcgccuugcgccucgcuuggcccggccugacccccgcgucuccgcagguggcugugaagcacguggugaaggagcgggugaccgaguggggcagccugguaaguuggggcacgggcggcggcggcggcggggggcgggcgcggggcuuuugcugaccgccgugucccccagggcggcgcgaccgugccccuggagguggugcugcugcgcaaggugggcgcggcgggcggcgcgcgcggcgucauccgccugcuggacugguucgagcggcccgacggcuuccugcuggugcuggagcggcccgagccggcgcaggaccucuucgacuuuaucacggagcgcggcgcccuggacgagccgcuggcgcgccgcuucuucgcgcaggugcuggccgccgugcgccacugccacagcugcggggucgugcaccgcgacauuaaggacgaaaaucugcuuguggaccugcgcuccggagagcucaagcucaucgacuucgguucgggugcgcugcucaaggacacggucuacaccgacuucgacggugagcgcgggcgcggggcagggaacguuccgggggccuugccggcggguuaacgccugcaggggcggcacauggaggggcugaugacuguugggcggccgcgcgcccugggucugcucucguggggagcagaggcccacgcgcuacccuggggagggcugagcgagggaucaagagcgggaucgugcugggugggggcuaggggcgcgcucaauauugcuuccuccaucgcguugggggguacggggccucuugccccggugugggaggcgcgugacauccuuccggcccgagagacccccggcugggggcgguagcggaggagucuccgugcgugacgcagggcgcagccgggcugggucugcgccgggagccuggaggcccccgcggcgcgguuggaguggcggggccuccccugcgugggggcgggagcugcgugcgugcggagcgcgggggcgcggcggcagaaauccccgcauugcggagcuuggggaagccggggcuccccgcccgccccucccuccucccucccucucuccccuccccccguucccgcaggcaggcgcgccgggcgguaagggacccgcgcugucccccccccacccagguagccucacagcgcaucuguuuguugugaaagccgagcucuuacucaugugaccugcuccucccccgcggccggcggagggggacggccggccccucccccagcccccccaucgccugccgggguuuuuccagggugaugacgagcaggauuuugaggccuggcucugcuuccuguuacugaggccagggaguuaaccagcagggaccucgccgucuguugagcggcucugccucuguggugggcgugcuaagcccuguguccccuuaggcacccgaguguacagccccccggaguggauccgcuaccaccgcuaccacgggcgcucggccaccguguggucgcugggcgugcuucucuacgauaugguguguggggacauccccuucgagcaggacgaggagauccuccgaggccgccugcucuuccggaggagggucucuccaggugcgugguggcucgaggcgggggugggggccucgcccugcuugggcccucccugaccucuccgcuccgcacagagugccagcagcugauccgguggugccugucccugcggcccucagagcggccgucgcuggaucagauugcggcccaucccuggaugcugggggcugacgggggcgucccggagagcugugaccugcggcugugcacccucgacccugaugacguggccagcaccacguccagcagcgagagcuugugaggagcugcaccugacugggagcuaggggaccaccugccuuggccagaccugggacgcccccagacccugacuuucuccugcgugggccgucuccuccugcggaagcagugaccucugaccccuggugaccuucgcuuugagugccuuuugaacgcuggucccgcgggacuugguuuucucaagcucugucuguccaaagacgcuccggucgaggucccgccugcccuggguggauacuugaaccccagacgccccucugugcugcuguguccggaggcggccuucccaucugccugcccacccggagcucuuuccgccggcgcagggucccaagcccaccucccgcccucaguccugcggugugcgucugggcacguccugcacacacaaugcaaguccuggccuccgcgcccgcccgcccacgcgagccguacccgccgccaacucuguuauuuauggugugacccccuggaggugcccucggcccaccggggcuauuuauuguuuaauuuauuuguugagguuauuuccucugagcagucugccucucccaagccccaggggacaguggggaggcaggggaggggguggcugugguccagggaccccaggcccugauuccugugccuggcgucugucccggccccgccugucagaagaugaacauguauaguggcuaacuuaaggggagugggugacccugacacuuccaggcacugugcccaggguuuggguuuuaaauuauugacuuuguacagucugcuugugggcucugaaagcugggguggggccagagccugagcguuuaauuuauucaguaccuguguuugugugaaugcggugugugcaggcaucgcagauggggguucuuucaguucaaaagugagaugucuggagaucauauuuuuuuauacagguauuucaauuaaaauguuuuuguacauaguggaua

SEQ ID NO: 17900 - RNA, 3601 nt, Homo sapiens
uauccacuauguacaaaaacauuuuaauugaaauaccuguauaaaaaaauaugaucuccagacaucucacuuuugaacugaaagaacccccaucugcgaugccugcacacaccgcauucacacaaacacagguacugaauaaauuaaacgcucaggcucuggccccaccccagcuuucagagcccacaagcagacuguacaaagucaauaauuuaaaacccaaacccugggcacagugccuggaagugucagggucacccacuccccuuaaguuagccacuauacauguucaucuucugacaggcggggccgggacagacgccaggcacaggaaucagggccuggggucccuggaccacagccacccccuccccugccuccccacuguccccuggggcuugggagaggcagacugcucagaggaaauaaccucaacaaauaaauuaaacaauaaauagccccggugggccgagggcaccuccagggggucacaccauaaauaacagaguuggcggcggguacggcucgcgugggcgggcgggcgcggaggccaggacuugcauugugugugcaggacgugcccagacgcacaccgcaggacugagggcgggaggugggcuugggacccugcgccggcggaaagagcuccgggugggcaggcagaugggaaggccgccuccggacacagcagcacagaggggcgucugggguucaaguauccacccagggcaggcgggaccucgaccggagcgucuuuggacagacagagcuugagaaaaccaagucccgcgggaccagcguucaaaaggcacucaaagcgaaggucaccaggggucagaggucacugcuuccgcaggaggagacggcccacgcaggagaaagucagggucugggggcgucccaggucuggccaaggcaggugguccccuagcucccagucaggugcagcuccucacaagcucucgcugcuggacguggugcuggccacgucaucagggucgagggugcacagccgcaggucacagcucuccgggacgcccccgucagcccccagcauccagggaugggccgcaaucugauccagcgacggccgcucugagggccgcagggacaggcaccaccggaucagcugcuggcacucugugcggagcggagaggucagggagggcccaagcagggcgaggcccccacccccgccucgagccaccacgcaccuggagagacccuccuccggaagagcaggcggccucggaggaucuccucguccugcucgaaggggauguccccacacaccauaucguagagaagcacgcccagcgaccacacgguggccgagcgcccgugguagcggugguagcggauccacuccggggggcuguacacucgggugccuaaggggacacagggcuuagcacgcccaccacagaggcagagccgcucaacagacggcgaggucccugcugguuaacucccuggccucaguaacaggaagcagagccaggccucaaaauccugcucgucaucacccuggaaaaaccccggcaggcgaugggggggcugggggaggggccggccgucccccuccgccggccgcgggggaggagcaggucacaugaguaagagcucggcuuucacaacaaacagaugcgcugugaggcuaccugggugggggggggacagcgcgggucccuuaccgcccggcgcgccugccugcgggaacggggggaggggagagagggagggaggagggaggggcgggcggggagccccggcuuccccaagcuccgcaaugcggggauuucugccgccgcgcccccgcgcuccgcacgcacgcagcucccgcccccacgcaggggaggccccgccacuccaaccgcgccgcgggggccuccaggcucccggcgcagacccagcccggcugcgcccugcgucacgcacggagacuccuccgcuaccgcccccagccgggggucucucgggccggaaggaugucacgcgccucccacaccggggcaagaggccccguaccccccaacgcgauggaggaagcaauauugagcgcgccccuagcccccacccagcacgaucccgcucuugaucccucgcucagcccuccccaggguagcgcgugggccucugcuccccacgagagcagacccagggcgcgcggccgcccaacagucaucagccccuccaugugccgccccugcaggcguuaacccgccggcaaggcccccggaacguucccugccccgcgcccgcgcucaccgucgaagucgguguagaccguguccuugagcagcgcacccgaaccgaagucgaugagcuugagcucuccggagcgcagguccacaagcagauuuucguccuuaaugucgcggugcacgaccccgcagcuguggcaguggcgcacggcggccagcaccugcgcgaagaagcggcgcgccagcggcucguccagggcgccgcgcuccgugauaaagucgaagagguccugcgccggcucgggccgcuccagcaccagcaggaagccgucgggccgcucgaaccaguccagcaggcggaugacgccgcgcgcgccgcccgccgcgcccaccuugcgcagcagcaccaccuccaggggcacggucgcgccgcccugggggacacggcggucagcaaaagccccgcgcccgccccccgccgccgccgccgcccgugccccaacuuaccaggcugccccacucggucacccgcuccuucaccacgugcuucacagccaccugcggagacgcgggggucaggccgggccaagcgaggcgcaaggcgcgcgagaaacccgggcccgcccggcgguccgacucaccgggagcccgucggcgaugcggcuacccgcguagaccgugccgaagccgccgcuacccagcacggcgcccaccugguacgccuucucgaagcucuccuuguccgccuuggcugcagggaggcgcgggcgggguuggugcggcccggggcgcccccgguccccgcccuggccccggccccggccccgccggccccgcgcguaccuggcugcaggaucuucaccgggaggugguccacgccgccgggcccgcagaggugcgccagggagccgaacuuggagagcagcaucgcgggcgacggccuccccggagccccgagccccaggcgccgaagccgcggccgauccgggcgagcggcgcgccggggacaccggccguccgagcccgaggcgguccgcgcggcgcagugggcccggaaggcccgcggggaccgcguagacgcgcagcaggcggagcgccucacccgccccggccgccucgcccggggguuuugggccgcggcgccgcguaucccuccgcgggggcggggcgaaucgggaccccgcccccuuccgcccggggcccgcgaggcggcggcggccgggcgcuagcuggggagacggcggggcagcuuggcgccugucuucgggcgggcgagggccgggugcggcgggcgcggggccgcuccgggacucguuuucguagcgcagccgcggaggcgcacggcgugucgcgucgguccgcucuccgcgcucacgcucucacuccgcgcaggcgca

SEQ ID NO: 17901 - RNA, 6128 nt, Homo sapiens
ggggcgggacccagguccgaggcgaggaagccggaagccaggcgcggggagccucccccuucgacugcagccucgcuccgugccuucugcgcgccugggaucccggagccugccuagguucugugcgcucccgcccaggccggugcccgccgcccgccugcgccccaggcaggucccaggccuccggcugcucccggccgaagguggggacaggcaguggcaggcaccacuagcgagggcguuugggaacccagggugaccacggcgcagccauggggaccgcgcuuguguaccaugaggacaugacggccacccggcugcucugggacgaguaagugggaccuggccgagguggggugcggggagggaccucugaacugagcuccucaucugccccagccccgagugcgagaucgagcguccugagcgccugaccgcagcccuggaucgccugcggcagcgcggccuggaacagaggugucugcgguugucagcccgcgaggccucggaagaggagcugggccuggugcacaggucaggacgggggcaggccccacgauggggggcggggcgggcagcccagcuagaaaccuaagaaccugggccuaccccgagccugccagccucgaauacagagccucucccuaugcaccucgggugggcucacaggcuugaggaagugacaggguggccacucccaccaugaaucccagguccccgccucccgccccccugcuccugcuggugacccugccucuccugccugcccaucugcaugcagcccagaguauguaucccuggucagggagacccagguccuaggcaaggaggagcugcaggcgcuguccggacaguucgacgccaucuacuuccacccggugcguguccccggacacacucaccugugcagacacacaugcacgugccuuugagcguucacagccacggccgccaaccccagccaguguccccugguccauacacaugacauugcccugcacaccugccugcuggcacugccagagccuggggcuggccuguucugcucagcagcuggugucuugcagccuggcacaaguguggguauggccugcaaagggcagcagggaaggcagggggcucaucugcgccccugcgcccacagaguaccuuucacugcgcgcggcuggccgcaggggcuggacugcagcugguggacgcugugcucacuggagcugugcaaaaugggcuugcccuggugaggugagagcugccccuuccccuggcugcuccuccguggguggcccugugaggggccagggcgacccugacgugacccaaauccuacucucacgccguaggccucccgggcaccauggccagagggcggcugccaacggguucuguguguucaacaacguggccauagcagcugcacaugccaagcagaaacacgggcuacacaggugugugccaggcuggcugcaggggggugggcccaggccacacagcaaggggcagcgcaggaggcgagagaacccagccagcaccuucccaucccuggccgggcuccuggaggugggaggcccugccccuuugccaccagcgcugucuguacccaggauccucgucguggacugggaugugcaccauggccaggggauccaguaucucuuugaggaugaccccaggugagcaggggugcggaaaccacccuucccugcagccccaguuuuugggugcacagccuggccugggaaaauccaggggugagauacagacaugugcucaggggucagcguucuacagggagcuguagagcuguugaggguccugaccuuugaccucuggcccuggcuggcuguuggcagcguccuuuacuucuccuggcaccgcuaugagcaugggcgcuucuggccuuuccugcgagagucagaugcagacgcaguggggcggggacagggccucggcuucacugucaaccugcccuggaaccaggugcccacccucaagccccagguccccacccagcccccucccccugggccccuccccucccccacaguucacccucaagccccagguccccacccacccccucccccgggccccuccccugccccacaguucaggauguagccugggauguccugccagguugggaugggaaacgcugacuacguggcugccuuccugcaccugcugcucccacuggccuuugaggugacugcacggagggcucccccagggcagccgggugggagggggaccuugugccuggagugcgccagugaaggcaggaggaggguuaugagcugucccacuccuguguggcuggggaaggugcucaggaggggaugggaugggccuggcucgcccucaccugggcuccagccccucucugucgacccuccccacuccggccuggccuguaguuugacccugagcuggugcuggucucggcaggauuugacucagccaucggggacccugaggugagggccuugccuugccagggagggcuucugggguccuggggcccaggucccccaucacacauggcucugguuccaggggcaaaugcaggccacgccagagugcuucgcccaccucacacagcugcugcaggugcuggccggcggccgggucugugccgugcuggaggugacuggggagggcacacagggagggucucugggccagaggccugggggucaggagcaugggagccaggugcccacgggguauuugggaggggcguccugcccgggauagagccaggcaggggcucucccggugacaucccaucccagugauaucucugccccaaucaugucuccacccuccucccagggcggcuaccaccuggagucacuggcggagucagugugcaugacaguacagacgcugcugggugacccggccccaccccugucagggccaauggcgccaugucagaggugcgaggggagguagggcgggcagggccggggugugagaccaggugucacgacuguugugucucccucacagugcccuagaguccauccagagugcccgugcugcccaggccccgcacuggaagagccuccagcagcaaggucaguguggccgggugcuaggcugcaggaucccaccucgggcuccugugcaguggcuaugacuccgaacugucccuagaugugaccgcugugccgaugagccccagcagccacuccccagaggggaggccuccaccucugcugccuggggguccaguguguaaggcagcugcaucugcaccgagcucccuccuggaccagccgugccucugccccgcacccucuguccgcaccgcuguugcccugacaacgccggauaucacauugguucugcccccugacgucauccaacaggaagcgucagcccugagggaggagacagaagccugggccaggugggcagggcuggccuggggagaaggauggggccgcaucuacaccugugccugugugugccugaccugcggucacuccgugucugugugucccucuggucuguccaccacaggccacacgagucccuggcccgggaggaggcccucacugcacuugggaagcuccuguaccucuuagaugggaugcuggaugggcaggugggagcaccugggagggguuggggaugcuguggaccuaggggcagggaccaggaccugccaacgagauguggccuguccagaggagggcuggguggugcagaaccacauggaugugaacauugccuugugccaggaacuguucccagaacagccccagggguggggaucacuagugugucugaccucugaccucagcuucuucaguuaaaugcucuuuggcagagaggugaagggggugauuuaaaguauacauuuaggcagggugcaguggcucaugccuguaauaacggcaguuuggggggccaaggugggagaaacgcuugagcccaggaguucaagaccagccuagagaacauauggagacccugucuucacaaaaaauaaaaaagucagccaagcgugguggugugugccuguaguuacuuaggaggcugaggcaggacgaucgcuuaagcccaggaguuugaggcuguggugagcuacaauugcgccacugcacgccagccuggcuacagaacgagacccugccucucuaaaaaaaaaaaaaaaaauuauagacguaagcaucuuauuuacagaaauggagugauugaccuuaguguaagaagauguguggcugacaguagccgcagagacacaccgaaugaagggaacuguggaucuguuuaccuggcuugggaguugguuggugccucauucuccacuguuuauucaucccacaggugaacagugguauagcagccacuccagccucugcugcagcagccacccuggauguggcuguucggagaggccugucccacggagcccagagguaagccucacuuggccauccugagccucugacggcaggaccugugggcaccccuauccuggcuggccaagcacagagaguucugggaauggacucuggacaacaugaacaccuguccugaggccagcucuucuuccaggcugcugugcguggcccugggacagcuggaccggccuccagaccucgcccaugacggguaggacucucaggucuugcauauguccagccaugcauguggacgggcaugugauggacgugugccugggccccagggugacggguggguggggcacugugugguacugaauggagccuuccucagcuggggugugggagaagggcugcuggaggcaaugccaggugggucuccagcacagaggcucagcagucacagcaccccugcccauggccccgugaaugcucuuccaccucugccucugcgguuugggcucaggagggugagcagggccuuacacuuaugcaccuguguccuggaaggaggagucuguggcugaacaucaggggcaaggaggcggcugcccuauccauguuccaugucuccacgccacugccaguggugagugaccaugccacgcggcaaggcaggugcuggggagcccauggauguguacagcugcuguuugcuggcauugucaugauagcaggccucugguccuuccugucucccugcuccuacuccaggggcccugagauugggagguugggaggccagagccagcagguguccguagaugaggagcugggcucugcuguccccacagaugaccggugguuuccugagcugcaucuugggcuuggugcugccccuggccuauggcuuccagccugaccuggugcugguggcgcuggggccuggccauggccugcagggcccccacgcugcacuccuggcugcaaugcuucgggggcuggcagggggccgaguccuggcccuccuggaggagguaagcugggcaggguggaggugcugcggggugggacgagggaaaggaccagugacugcuuccgucuucgccccugguccagaacuccacaccccagcuagcagggauccuggcccgggugcugaauggagaggcaccuccuagccuaggcccuuccucuguggccuccccagaggacguccaggcccugauguaccugagagggcagcuggagccucaguggaagauguugcaggugaggcugacugcggaggcauggcccugcccuggggccuggcucugccgcacagaucgguggggagggcagggcaggggagugcccugaaccagcuccagcgccggaggccaacugcgcgccucuucucggcuccuccuguagugccauccucaccugguggcuugaaaucggccaaggugggagcauuuacaccgcagaaaugacaccgcacgccagcgccccgcggccgcgauccggaccccaagcccacggcucccucgacucuggggcacggaaccccgcccacucccaauccccgcgccccgcccucucccacccgugcuucccccgcuccaccccucaccucaccucgcccccgccccacccaucgcgccccggcccgucccaucgaggcccaugcaacccacgcucggucccguuccggccccugcgccccgcugcgcuucgcuccccgcccuugcgccguuaguaaacaucgcucaaacgaaacgcugg

SEQ ID NO: 17902 - RNA, 6705 nt, Homo sapiens
cuuuggauacaagccaagugagagagaacccccuuuauugugcaccccuggugcaggcacuugacacccaggcuucccugggccccucgaggcaagaggucacccccuuuccagggcagagccacacccccaacucagcucugggcagggucccgucuccgagguuacuggaucagcuccauccugggacaaggaaagaggacugacccacagaccagagcaccucagaucuccggcugcagggccacaacggugggcagagguagagagcgggccagggugcagggcagaaguguccgaguccaaguccacauccaggugugcugccugcccuagcguccucaaggccaaaccacccacccacccacccccagccucaggaagcugcugugggucccacauccaaggagaaagccccugcccaugcucaugugguugcccuuuggcccacuggagccgccagucugaaacaccccucaaggcaucaggaaccgaggagagggaaggcaacagcacacccaccccggcuccagcuucuugccagauauggcugcuggccuugggcgcccacagauucacacgcaccacaucacaugugcccugacauaugaacacggggagugcacgcucauccacacgugcccacacacacccacgggugaacacaagacuccaggcagcuuuucucauuugacaccuggugguugucccugcccagccugguggcacacuggcucugccucuccucuuagaccugugggucucagcagugaccaagacagcccccuaccuccaggcugagcagcucuaaccacugagaccucucccuuugagucucccggggucccggccccagcgcguccuccagaaagcccugggacagaagagagcccaaggcugacacucccuugggucggccugggacagacaggggaacuccgcaggggaaccccuuuggcaucuaggaccccacagucaggucccaguggagagugcaguagccagaagaggacaggaggaccaagguaggcccagggacacuugugcccagacuccuacacauggcaagcacauguacacacauguuugugcaugcauacaugcguguagauucuccugaaggcgagggguccuaggccagaagucugugaccauaggagugugggaggugccucucgaggaaaccaggccagcuguggaagggugcaggcccaagccccuccacaggcucucaggggcugcugggcagcaccucacugcucaaucuccaggcugccagguggcuucgguggcucugggggcuugaagcugaggacuuccugguaagugagcucuaggaggugaagggaaagggugagcuugugccucccacagcccggccccucaccugcuugucuggcaccugccacccagcccaggcccaccacccugugacagcagccucagcacagucugggagccagaaccugcccugugucacuccuccgccccgcucccagccugugcuggacaccugaacgcccuuccacaccugaccagucuggagaggaacuggggcauuuccugccucuggggaaauggagcccgcaggccccuggacccacccccagccacugccaugcucacccuuccacuccuccagcgugcgcuccuuggccucaacgcucucaucauauggcucggccucuggcucauccucggggucgugguacuggcugaaguaggcgugggccagugccucagcugcacugacccucuggucacuguccagcaccagcauccuuccaaggaggucuauggcugcagggaagccagugguggggaggggggucagcuguacauccagggccagauauggagcccagucuagcccagggcaguccucacccaggggguuggcuccacggaagaugcugcucagguccuucuggggcauggggggcagggacuggauauauguccgggccugggggcacacaagaacaccuggggaggcugcucacucucugccucccuggccccaaacuggggcuucucuuggcaagcccccagacucauucacuccaacaggccaggacaagggcacaggcagaccagugacccccuccauauaggaucuggugguucuagcuccucaguuggccccuaaugccugcaggagcuggguccaaguacacucccuccacccagcccacccccacugcccuggccaggcacugcuugcuggggucccccagcccacccccacugcccuggccaggcacugcuugcugggcccccagcccacccccacugcccuggccaggcacugcuugcuggggucauggcuuugcacucacugucccuggugucaggaaugucuucccccuucuccuguuuccccugcagggauugggcaccugcccuaggcucuaucccaccacaucccauguuccccauaugguccccgcauuuccacaccacccucucccccagagagccugggggcucagccaggagagggagcugcuggcuggcgggcaccaacucacguguucugaggagauuuuugccagaaccucagggcugggugugcccaccacuuccaugaugcgcuucagcuggucaaugucugugucacucaggaaacacccacgggccagccacagaccccuccugggcccccagacccaaaacuuuggggcgcugcccagagcccgcucuccuauaggugaggauggccagcccaaaguagcauagcauggggggcagaggaggcaagacccgccagaaggggccagcgcuggucccuacccuacaggaggggcccuguuugacccugcuccccaaccugggccaaggauacagucgcuucccgggaagagggccuugcccuggagcagcucagccaugaugcagcccacggaccagauauccacugugcgagggcgaggggaccuccaucagugugcccaccccacgucccuccuccaggagacccacagucacauccagaccccaagaugggcagacccccuccucugccauacccaaccccccuaggcagggggagguccauagcugcacagccagaggaggccagcacccaucaugcucuagcggccucugaagggcuacuuuugaaugugggucccacauucuuggggaccuugccugcccccuaagaccuggcaugcagagccagucgagggccagacgaggcccuuggccuucguccccccaaggccuucccccugcaccuguuugguuguaaugcauccaguugagcaugaucucaggugcccgguaccagcgcguggccacauagccggucaucuccucguccgccuggcgcgccagcccaaaauccaggaucuggggcgaccacgugguguucucaagcuccgcacgggcuccgccgccgcccugcccaccccugcccacgggccucacccugagcucacaguccucguucacagccacguugcugggcuucagguccugcaggucacgcggagcgugagcacaggaggcugggacggagcccugcuggacccgacccucacccugcggucgcaccuacccgguggaugaucccggccgaguggauguacugcgggagggggauuguggugagcgccgggcccggcccgcccgccccccugcgagaggacccgcgaagcccagggcgccccaccuucagcccgcgcagcagcugguaaaccaggaauugaacgugcucgucgcucagcgccuggcacuugacgauguuguucaggucggcgcccaucaggguggucaccaaguaccuggggcggggucagggggucaggacagggccccaccgccccaccgcgaacgcgcuccccgcugccucgcccgccccgccgcucacacuucgcugaaguccucgauggacguggccggcgugaagacguccagaagcccgaugaccuagguggcggggggcgucagggccgggcgacgaacccccggcugucguucagcuccccccgggccacgcccccagugccaggccgcgcccccuguguccccgcccccaucgccagggcucgcccgccuauuggcugcgccgcggccccgcccccgcacgcgcccuccccccacggcccucccccggcucacguucucgugcuucaggugcuugagcagccgcagcucccgguacguucugcgcgcguggaucagcgacuggaaggggcgcgacagcuucuucaccgccaccuucuggcgcagccgggcgucguaggccgaacuggaaggcgggcgagugaggcggcgccgggagggguccgagggcggccgcacgcgcguggacccgggcggcgucccucucgccgcuucuccguggggauggggccguggggcuuuucugccccggccccgccgccccagcucggccucccacccucgggccuacccacuccgcgcuugcugggaaggagccccuggggcuggaccaccaugcguguguucaccccacaagguccuggaccuucucuguccccuggccccacugauucccacgcucaaccaggggcccccauucaaagcaaggcugggggagaggugccccauccagcguggaaaaacacagcaggaaaacagucacuggcauucaccugcagcagacgggccucccucugccccauagaccccaugggcccaggaggcucacagagggggauucuagagccaccucaaagccccuggaccccuggugccuccgaauguucaaaauacggagggaaaguuggucagagguguuuauugcaucauuauuuggaacaaaaccgggacagaaggugauguacagcugagggcgucagcuggacccacagaacagcccuucgcccagccccacuucccagagguccagacccucuacccugcaccagcuuccugagcccacccucccuuugcaggugacccucaucccacccucccaugucccacugcccucagcccugcuaaaggaaaggccuuugcacagccuguucccucuggcugauacuugcuucuucucucccucccacuucugucucuugggauccugucucagagcaaguggaggcugaggccaccccccaugcccacacaaggggagcaggagcggcuccugcugggucugggaugcucaugggcgcaggucgaggugccuggggcagccaugcucccagccuaugaccagggaaaggugcuccugagguggugaggggaguggcccugcacguggggcagcaaguucuuuuggccaauugcaucugugcggucaggugacagggaauuggcaccuggcccgcagccuuggcaguggaacuaagaaaaugggccaggggugcaaggggggagaccaggccucacucagagaaccggacaccucucagcaacucccagacggcgaguccagccaugacccacccuaguccccuauggccacucccacaccgucccagacccucuuccugcccuucaggucucaaagaggaagacagaucugugcuggcaugauggcuagaaugacccaccuacagcuucugauggaaggcuagggaccacaccagaagacagccugcccugggacccccggccccugaugccggcuccugagcuccaaaucuggugggccuagaggucccacuuccaaccugcaagugccuggggcagagcucugcccuggcugccucugccuuugcgccccaccaggaccccccagugggcagcagcuaagcggcauuggccauggugaggacucagcugcaccucucaaagccuguacccaugaucagccucccagucaacauggaggcugaaacuuaggacucccgguaacuaccucacccuaagccccuccagcccuggcuacccgggucuaacagagaccuuggcccaguugaccccccucccccacccagacucugucgucuuccugggccccaggccagguccucuggccccagggccuaagugggguuuguggucugagggggagucugaggccaucccagggggagagaucuuggcuuccgggagcggggcuucccuuuucagacaauagcccccagcccgggcgggggagggucauccgcuagaccccggggggcugccugacccgacucagugaaucucaggugggugcucagacguuuaggggcccggacaucaggguggcucggggcucggucgcgugagacccacccucacgccagcugugaccucccaggccucaggccugguggggagcaguccgaaucgggagaggccggaggaccccccucccucccgguaacggcgucugcuuggaaaguuucuuuacgccgccacccccgcccccccauucauuccucagauccgcuuggcgcccgggggcggaggcagggcgaggccccuccccacgccgagaaccucgcgcgggcgaggaggggacgcgcucuccggcccggcccggcccccacccagcaccccuucugccccgccccuaccagacggagccguaggcgccggagcccaccgggcgcagccccugcagccgcugcggcaccucccacacggucuuguucagcuccugccgguagaagccggcgcgagggcccgacauguccggagcagccgccgcuccgcccgggcccagccccgcgccccgcgcccgcgcccgagccgagcccgagccgagcggagcggagggcggcggaggcggcggcggcg

SEQ ID NO: 17903 - RNA, 472 nt, Homo sapiens
uuuggauacaagccaagugagagagaacccccuuuauugugcaccccuggugcaggcacuugacacccaggcuucccugggccccucgaggcaagaggucacccccuuuccagggcagagccacacccccaacucagcucugggcagggucccgucuccgagguuacuggaucagcuccauccugggacaaggaaagaggacugacccacagaccagagcaccucagaucuccggcugcagggccacaacggugggcagagguagagagcgggccagggugcagggcagaaguguccgaguccaaguccacauccaggugugcugccugcccuagcguccucaaggccaaaccacccacccacccacccccagccucaggaagcugcugugggucccacauccaaggagaaagccccugcccaugcucaugugguugcccuuuggcccacuggagccgccagucugaaacac

SEQ ID NO: 17904 - RNA, 52115 nt, Homo sapiens
gagccgcacugggccgcggcggccgcucgacuguucugaggagcggcccggacgcgcgccgcccccgcccgcguuuccccggcaacccgcggccgccgccauggacgcgcuguugggcacagggccucgccgggcucgcggcugccugggcgcggcuggacccacgucuucaggucgcgcggcgcggaccccggcggcgcccugggcgcgcuucuccgccuggcuggagugugugugcguggucaccuucgaccuggagcugggccaggcgcuggaggugagcgggcgcgagcgcgggcgcgggcgggugggcagggcugcgccucucggggccagucccgccucgcuuggggcccucggccgccccgcacucucccuggccuucggccgccgccuccuggaggggccucuucuccgggcuccagaagcgcuccccaggccgaggagggaaggcgagcugcucggagucggaucuugucuucacauugggauggagcauuuugcauaaccuaagugguacucuuucgauuuuucccaguaaaugucucacaucuccccccuccauuccccaccggagcagugacaccuucauccccucaguggcucccgccagagucccgggcuuacccuccgcuccgcaucccaucucugggcauaggcgaggcugacggcuccuucugcaacaaaggucucggauccguuccuuugcugccaucacugaugucauccccaccccagcugcaccccagaguucaaccuuuguggcucuccugcuuaaaacccugcagcgccuccuuguucaccuagcaucagauccagaccccaugggccccgucccuccaccugcgucuugugguguucuugcucgugggggucuguucaucggcugugcccaugggcuuucgauguggucuuucugcugccugcaggccuccacucaccuacccacacaggcagccuccuuuccuccagggaggccccgcaggaugaucuucucuguguccuguguaacacacaccagggagcugaccagcacaggggaggcccaccugcagauggagggaggcuuccccgcgcuggcgcaaggaaccucgugagggguagugagcucucuauuaccgcagguguccaagaucaggccaaaucaucaucaucaggaaagccaggcagcgcgucucugugguugggagaugcuuucuaaggcccugcugaacuccaagaggccaugagaagcauauagucuucuaaacagaaaagcauuaacucuagcacucucuggagccccucccaccacacacgguccccagcaggugcacagccucaaacagcaucacugggugggggcugaguaccaagaaguguggugaccugcccaggguugaaaaccuuucuuaguucaauacuguugcccagauuguuccccacaaaaucacaaaagaaguuaagagguuccuggccggacgcggugacucaugccuguaaucccagcacuuugagaggccgaggcaggcagaucacaaggucagcaguuugagaccauccuggccaacauggugaaaccacaucuccacuaaaaauacagaaauuagccgggcgagguggcacacuccuguaguccuagcuacucgggagacugaggaggagaauggcuugaacccgggagggggagguugcagugagcagagauugcaccauugcgcuccagcuugggcgacaaagugagacuccaucucaaaaaaaaaaaaaaaaaaaaaggagguuccucuguuccuuaagacauucucguguuauuuucuaaaacccauucggaaaguuauuucugagcuguugaaggcugugugugcuuggacuccugagcuuuugcuggggaugcucagcucggacuaggggcauggucagcuggcagaguguuggggacccagguccaugagcgaaacccuccauagcaaugaucugggcaccugcagaucacugagucugugcagaaaccuggcaguggauccaccggggccugagcacaugacucuugccuuuccucccucaccuggaagucacagggaagaucgaggucguuuuagucacuuacagacuuagggagcacccacugugcaacucagucacagcucagcccagcuaagcacugcaaagccccaggacugugcuugguucugcgauauggaaggaagacucuaguugggaugcaugcagcucagaggaaggaaugggcuuagguaaauaagucuuggaugcugagaagagacaggggaggggguccuguuucagguaaccccucucccaaaaugccaacauaagcaaaaggcaaggagcuggugauucaguuacucauucaguaaaucacuuugaaggcugggcaugguggcucacgccuguaauccuagcacuuugggaggccgaggcggacagaucaccugaguucaggaguuugagaccagccugaccaacacagagaaacccugucucuacuaaaaauacaaaauuagccgggcgugguggcgcacgccuguaaucccagcuacucaggaagcugaggcaggcaaaucgcuugaacccaggaggcggagguuguggugagccgagaucgcgccauggcacuccagccugggcaacaagagugaaacucugucucaaaaaacaaaaccguagaucacauugagcagcuaucaccagcccagccccacaauacuggugcccagcauguaagugaguagacaaggcucuugcccuuuaggaguucacacuaugugccagugauauggagaguaagugguucagaguccauagugcucacaggacucccccuuagcccucacaggauacccccgcaacuguacgcaugggagcaucauggaaaugagugcagugcagccugcuugagagaugagggguccagcuugagaggggccagcagggcuguggggugacaagggaucuggcuugugaggggcugggcaggacuguggggugacuggaguguacaggucagcuuaggaaagggccuggcuccgccuucucagcucuugaaaacucaccucuugggcugggcgcagugguccugccuauaauccagcccuuuaggaggccgaggcaggaggaucacuugaggccagguguuccagacuagccuaggaaacauagugagacccugucucuaccaaaauuaaaaauaaauuagccaggugugguggcaugcaccuguaguuauagcuacucaggaggcugaggcuggaggauugcuugagcccaggaauucgaggcuguagugagccaugaucaccacugcacuccagccuagguuacagcaagaaccugucucaaaacaaaauuaaaaaaaaaaaaaaaaaaaaaaggcuaggcgugcuggcugaugccuguaauccuagcacuuuggaagcccacagugggaggagcacuugagcccaggaguucuagaccagcuuggucaauauagcaaaacccacaucucuacaaaaaauacaaaaugaggccgggcacaguguuucaugccuauaaucuuagcacuuugggaggcugaggcaggcggauugcaugagcucagaaguuugagaccagccugggcaacauggugaaacccugucucuacuaaaaauacaaaaaauuagcugggcauuguaugccuguaaucccagcuacucuggaggcugaguuaggagaauugcuugaacccgggagguggagguugcagugagcugagaucgugccacugcacuccagccugggugacagagcuggagugcagcucucaaaaaggaaaaaaaaaaaaaaaaagagccaggcaugguggcacaaaccuguagucucagcuacuugggaggcugaggugggagaacugcuugaguccaggaguuggagguugacccugucuguuaaaaaacaaaaaacaagccgggcgugguggcucacaccuguaaucccagcacuuuaggaggcugaggcgggcugaucacgaggucaggagaucaagaccauucuggcuaacacagugaaaccccgucucuacuaaaaaaaaaaaaaaaaaaaaaaaaaaaagcauuagccgggcauggcggugggcaccuguagucccagcuacuugggaggcugagucaggagaauggugugaacccaggaggcggaguuggcagugagccaagauugugccacugcacuccagccugagcaacagggcaagacucugucucaagaaaaaaaaaaaaauaaggcugggcacgguggcucaugccuguaucccaacauuuugggaagccaaggcaggcagaucaccugaggucaggaguuugagaccaccagccuagccaacauggugaaaccccaucucuacuaaaaauacaaaaaauuagccaggcauuguggcacgccuguaaucccagcuaucuggaggcugaggcaagagaaucgcuugaaccugggaggcaaagguugcagugagcggagaucacgccacugcacuccaggcugggugacagagugagacucugucucagaacaaacaaaaaaagacaaaaauuuuuuuucuaauggaaaauuuaccucucaacaucccagcucccucagaggucucuggagugaacucuggucaguuagaauaccacuuucacucuggcagccaugcccucccaggcagcagugcccauacucugcagucuuaggacacuuuuguaguuuuaaaaauuauuggccgggcacgguggcucacgccuguaaucccagcacuuuggcaggccgaggcagguggaucacaaggucaggagaucaagaccauccuggcuaacacggugaaaccccaucucuacuaaaaauacaaaaaauuagcugggcaugguggcgggcgccuguagucccagcuacucaggaggcugaggcaggagaaugucgugaacccgggaggcggagcuugcagugagcugagaucgcgccacuguacuccagccugggcaacagaguuagacuccaucucaaaaaaaaaaaaaauuauugaggaccccaaagaguuuuuuuuuuuuaauauugguuauaucuaucaauguuuaccaggaguuaaaaccaaggaaauuagcugggcgugguagcacaggcuuguaguucuagcugcuuggaaggcugaguccaggaguuugagaccagcuugggcagcauagcaagacccaaucucuacacagcaguguaaaaaucagccaugugugggggcgcacgccuguagcacaacaguguaaaaauuggccaugugugggggcgcacgccuguagucccagcuacucaggaggcugagguggaagguuugcuugagcccaggaggucgaggcugcaaugagcuguguucgcaccacugcacuccagccugggugacagugagaccuugucuuaaaaaacauuuuugagaguuagaagggcugggcgccguggcucacaccuguaauccuagcacuuugggaggccaaggcggguggaucacgagguuagaaguucgagaccagccuggccaauauggugaagcccugucucuacuaaaaaauagaaaaauguuagccgggcgugguggcgugcacccuuagucccagcuacucaggaggcugaggcaggagaaucgcuugaacccaggagauggcguuugcagugagcugagaucacgucagugcacuccagccuggugacagagcaagaccccgucucaaaaaauaaauaaauaaaaaauaaaaaguccgaccaaauggaaaacagcuggauucucaucagcacugcauucagcccucuaggacaggacacaccgcggcuucugggagccaugcuguaccugagggugaagaugagagaggaggcucucacacaggagaagggcugugacccccgggaucccaggguggcccggccauaccuugggaaccgcucccugcaugugccuucuccaaaccaagcucccacccccagucuuccuccgggugacuggugaccaggagcagggaccugugcagggcucaggcaagacccucauggaaccccgagcagggcacagccugaccugggaggccuccuugcccugaagaucagcuccauuuguccccuuaaccuuggcguggccaacccuggguggccugaccccuggcuuuguacucaacuucaggcuguaccugggccccagggacacucucaaaaaggaugagccugagaauguggcuuucccuggucagacaugcugagggcccccugggcaugggcacggagcucagaggccacaggcuccugugacuggcagaccaggugcagaguccugaccccaggcagaagguacccgccuuuucucaguucuccucagugcagacacaugaaggcucaggcugaguggcccuauaucuccagccccucauggagcuauccugaggcaccccuguggguccagccuacucccagcuuccacccucguccuccuccugaccacuccuuggugccuguuuagcuccccuccacccaccuguucuaguaaaccucagagaccucuucacacauuccacgaacacuguauuuggggagggucuguucugugccaggugcugggaggcagaaguaaccaggacaggguccuuagagagacuuacucugcauuggaagaggcaaagcaggaccaugguagcaagcccagagcaaacagaagagcagggcuauuuucacagagcaagcugggcguggcucacgccugcacucccagcacuucaggaggcucaggcgggaggaucgcuugagccuagaaguucgaggcugcagugagcugugauugugccauugcgcuccagccugggugagggaacgagacccugucucucagaaacaaaauggcagaugcuuucauccagggcccggcuccucacugucugggggcucagggcacaccuuggaagaagccuuguuauagccuaaacccaacucaguggagaagcugggcagaugggaugaggaggggacagugugcagaggcccuccuggcaggcuucaggcagcccaggagacauugcagggcccacugggaaugggggcucugggagcucccuagagggaaagugguccaugugugcguggaccuacugggcugggcucccaggcucaccugccccaccugccgccucugucagcgcacaccugucuuccaagucauucagcgccugcuuagcaucaugcucuccuccacuguccacuccugggggugcaggccuuguccggcugggcgcuacagguggggcacaggcccuggcagggggagggugggugaagacugcugagcaggacggggagagggccugacagcaagcugccaucauggggcaggggugcuucugggccugcaucugagcaaaggcugggggagcagcacgaccggggcccucuggcuuggcggguggugagggagcuggaggaccagccaggcggggccccgugaccaucccaggugaggggcccucuggcuuggcggguggugagggagauggagggccggccagguggagccccgugaccaucccgggugagggggccucugggucccugaagcacuacccuucugaugcugugaacagauguccggguggguaggggcaggggggcccaacugcagucugggcaagaggugguuggguggcugugaggaccaggggugugagaaaggggucaggaagcucacccaauugugcuggccucuuacugagaggggccuggggaggugggaguagagaagccucuggccggcaggggaguugcccggggccuggugccuggaggucagagauaggagcgggucagcaaggagccagacaucacagccagagaaggugguguggggaggaugcagcaugcuguuggaacacagagaauaugguguggggaggaugcagcgugcuguuggaacagggagcagggggcgagccagcaccuugggcacugaccugcgccccacagacagaugcugcagcugcugggacggucacaguccagcagaugcugucgaggggugucgccuccucggacagauggugucaccaagcacucugucuuccucugcagcugguguauccgaacgacuuccggcucacagacaaggaggugagucccggcccucuugggaauggacaggacccaggagugggucggcccucaccgggguuuuauauguuucagaaaagcagcaucugcuaccugucuuuucccgacucgcacucagguaggcaaccccaccuuuccuggggcuggacaugaagccagcugggcaucccuguagccugggccaggggcaucauggcugccucggcugccccggugcccagagugccacaggggugagcagcaccagccccaugcccacuccguggaggcacccagagccccgcguugcagcaggucaggccgguccccagauucacguagaaagggugucucuuugcagagggaccaacagucagucuccuacaccccacacaguggccgccaggggcugggccucccucccgcuccugccccaggguauagacaucuggguggccauuuucuggugccugguuuucuaucucaagcaggucaagccaaucucccagagaaguugaaggugcuuuucuaugcgaauauauucuaagacuuguaggugcaggguguacagaagucagaauaggagcccauugggaaacacagaccccuugggcugggcauucuuucuggggcuuuuuuuauuuaaacggagucucacuccgucacccaggcuggagugcaauggcaccaucucagcucacugcaaccuccgcccccuaaguucaagugauucuccugccucagccuccugaguaguugggauugcaggugugugccaccaugccuggcuaauuuuuguauuuuuaguagaaacgggguuucacuguguuagccaggcugguuucugggguauauuuaccagcagaggccaggcucgcagggcccuugcuccccggucaccagcuccagggccugcagaagaggcucccggccuugacccgugugguggggcugccccuucuuaggcugccuuggagacacucaguucagcuuccgcaugcgccaguguggagggcagaggagccccuggcaugccgacgacaggcacuacaacagcagggccccuguggcacugcaggugagcacugggcugcgucucuggccugcuucuccccugcuccccaaggguccugccagggucaggcugguaggagaagccccuucagagugccugggcccuguguggcaggagaggagcuggccaggccccacuggcccugcagucccaggcaccagccccaacugaggaugggccagcucuuccagggucuccccagggucccugggacuuuuccuuggcaccacacaucuguggcugggcaccugcauaguugaacaggggcccucccagggcccccagccccccgagccccucuccacuacaccagcggacucccugcuguaucagcagggguguugcccaccuucugagcccaggaccuccuggccuccaccuugguggccagagugcacggacagcagcuccaggagccuccugguucuccagccuuccaucugcagcagucccugcaugcuccuugccacucccagcccuggggcuggccaggugguccggguggggcguggcuggcuaacaccaugcuccuugcagagggagccggcacacuacuucggcuacguguacuucaggcaggugaaggacagcucugugaagaggggcuacuuccagaaggugcgcugcuuggccacucugggcuggcaccucaagagcggcaggagcuggcaggcagcaggaggggcugugggcgggcaaggggccugagccuccagcagugcccaccccuccugcagccccaccugggcuguguccagcucuccuugccgcccccccacccuguccucgccgccccccacccuguccucgccacccccccacccuguccucgccgcccccccccacccuguccucgcggccccccgcccuguccucgccgccccccccccguccucgccgcccccccccacccuguccucggggccccccgcccuguccucgccgcccccccacccuguccucgccgcccccccgcccuguccucgccccccccccgcccuguccuugccuggcaugggacccaaggcccuucuguccugguccaggacacugcugccccucacugauggcuggagggucaucacacugucagugucagggcaacccagccuggaagccauaggcagagaguaaaagcugcucagccccuggggaggucguucuagaaauucuggccaccgugcguuucccuccgaaggcccuaggguccagccccaccggccgccacccagggaguucaguguuggguuuucuccugucuaauaauucugggguccaagucaggcguuccuggggcagcuguccugugaaguuggugggacgugcuacccugggccagcuccaggugagcguggcuucggugguccccgugggcuccugaguggcgagggugaggccuggcacugggccucuaacuggccccguggcccugcagucuuuggugcuggugucccgcuugcccuuuguccggcuguuccaagcgcugcuaagccucaucgcccccgaguacuuugacaagcuggcgcccugccuggaagcaggugaguggccaucagucguggccaucguggucucaucaucccagcuguggccccuggugggcucggcagcagcuucuccuuggggaggguccugaugcgggcuacugcauccgcagugugcagugagaucgaccaguggccggcgccugcaccugggcagacccugaaccuaccugucaugggcguuguuguccaggugagagccagcuggcuggggaguaggcucugcagguguguggggaugcccuacucccucuggcagcugcucccuccuucucccaggugcgcaucccauccaggguggacaaguccgaguccaguccuccgaagcaguuugaccaagaggugggagcugaggcggagguggagcugaaacagcugggcuucacccgauugaguccugcuccugggccggguggucccacaccugcuuccuugguucacccugcgggguugucaaacccaggcaaagccacaggcuguguguugguguagggcugggugcucuccaccuuccccugugcugugaggcaggggcugcuuggggcccaaggggugccagccuccccuuggcccugaccuucacucuccuccucucagaaccugcugccagccccagugguucuugcuagcguccacgagcuggaccuguucaggugagcccccuaggguucugcacacugcuuuugaggagcucacugugugugcacgugcauguacgugcaugugugcaucugugugugaguaugugugugcgugugugucugcgugagugcacgugugcacguguguguguguauggccagcgccauguggggacugcccaagggaggcagcgcucauccugaguaccccuugggacaguucuggaaggaaggagggagaauugucuagaagaggaagcaggugcccacaugucugcagccaguggaaauaggcacagugggcaggagguucugaaagacaggugucaaggagaggcugucaggagagauucacugccugaggccgccuucucugccucuggacaagucugcaagggagccugggcuuugagaccauccugcucugugcugggcccggcaggagccagggcugcacuugggaugggcacagggugacgggaggggucugggcggguaccccccagcccaggucagcagacccugccccggcuuuggggccacuucgggauggcuggucccucacagguggguccagguugagucccccauucccagggccaggcccagcacagguggauugucacagcuuggggucgucaugauuacccgagacacaucuucagauagaucugucuucacccuggagcagcgugcuguguucaccagugccugggccagccugggugaacggugggagagcggggccagagccaggagucucagccccugccugaccuccccgaccuuccugcccggccccaggugcuuccggccugugcugacucauaugcagacacugugggagcucaugcuccucggggagccccugcuaguccuggcacccucgcccgacguguccucggagauggugcuggccuugaccagguaucgccuuggcccggucccggcuggggaagcuggaccaucgcggcugugccugggcugccccugccucaccugcucccugcugccucugcccacagcugccugcagccccucagguucugcugcgacuuccgucccuacuucaccauccaugacagcgaguucaaggaguucaccacacgcacgcaggccccguaagugccgccucugccccgccucuugcccuugcuccgcccugccucucgcccuuccugcaccucccuggaccucugucucugccucuucucucucucugucugucuagaccaaacgugguccugggagucacaaacccuuucuuuaucaaaacacuccagcacuggccccacauccuccgagucggggagcccaagaugucaggucaggcucccggugaggugcagggggugcugcucagaagccucguugaguguggggccgccucagagcccguggggauggccagagcugcgggcacugaggccuggccaccgggcgugucucguaggagaccugccuaagcaagucaagcugaaaaagccuucaagguugaagacccuggacaccaagccaggucugugcuccccucgaccuggagccccuccaccguggagaggccugucuuguaccuggcgggucucucggguggggcagccaggcccccagaccccugauccucuuccaggacucagcagcagagcucagaacccuuggggaggggucgcucucuucucuucagugggucucggugucuggggggugggugggugagauuuucaggugcagccaagggcauggggcugcaggcagaugagacccccacccuggcuccucuguggggcugcaggagugugggagggaggcccuugaaggguggggcgccagcugugcccucccgccaggccucuacaccgcuuacacggcccaccuccaccgcgacaaggcgcugcucaaacggcugcucaagguauaugguuuguggggcaggggcuggggacgcagggagccugguguggugugaagcgcagcaagggccuggcccucucuccccugcagggcgugcagaagaagcggccgucagaugugcagagcgcccugcugcggcggcaccuccuggagcucacccagagcuucaucaucccccuggugaggcccggggcugggggacaugggacuggggggcacggggcuggggggaugggguugggggggacggggcugcgggggauggggcuggggggcauggguccccgggcucacuccccucccuuccccacccaggagcacuacauggccagccucaugccccugcagaagagcaucacgcccuggaagguggggguccuguggggguuuugugggguccauggagggcggguucccuuccucacccggaggagggaaggucuggagcaggaggcuguggcugggcaggagccacaggccucaaggccaucauguuugugaaacugggggccacagggcagguggcuggcaggacccuuggaggggcucagggccugcucccugggaaaggcuguccugggaucugugccaggcagggugggggcugggggucuucagaaguggugaggagugugucugggaagcguaccgggugcaggccugugaggccgaguucccacgugcuggcucacccauccccucucagacucccccccagauccagcccuucagccaggaugacuuccugcguagccuggagcaugcugggccccagcucaccugcauccucaagggcgacuggcugggucucuacaggugcguggacugcaggugcaggcagcuugagcccuccuugguccacagggucagccccauggccccccgccugucaauccccagggucauccccauggccccccgccugucaauccccagggucagccccauggccccccgccugucaauccccagggucagccccauggccccccgccugucaauccccagggucagccccauggccccccgccugucaauccccagggucagccccauggccccccgccugucaauccccagggucagccccauggccccccgccugucaauccccagggucagccccauggcccccgccugucaauccccagggucagccccauggccccccgccuguuaauccccacaggcgguuuuucaaguccccccauuuugauggcugguaccggcagcggcacaaggagauggcccugaagcuggaggcccugcaccuggaggcuaucugugaggcggugagagaggcuggggguuggggagggccagaacauggugggggugggcacaggcccagggcagugaggggccuugcugacaguagaccccgucuugcccugcagaacaucgagaccuggaugaaagacaaguccgagguggaggucguggaccugguccugaaacuucgugagaagcugguaagaugccucccagccuugucccagcgccaccagccuggcacggagcugcgccugcccugaccauggcugccccuccaggugcgggcucagggccaccagcucccugugaaggaggcuacgcugcagcgggcacagcuguacaucgagacggucaucggcucccugcccaaagaccugcaggcugucuugugcccucccuagaacaaagccaagggccacggucccagggcccuaggucugccugagccucccacuccccagugguggcggcacugggccaagcacacgcuccccuuccuuggccccccgcccagacugcaggcuccccuuccugcaccaccauugucucagcaguaaaggcgacauuuggaaccacagcauggccuugaccauagggguuccucgcaggcagagccuugccuccuccugggucccaccuggccucugcagaccuuaggcugggacgggggcggggacaggcugggagcccuugcugaugugggugcgucuaccgucugccccucccggugcccaucuguuggcccccgaccccccugcgcugugugugaugcuucccucagcccaacaggcugcccaggacaggagggacccucuccugacacagcccccgucuugucuggggaugggaggcuauuuugcauauagucaucaacuugagaaagggagagaccacuuugcagugugaagagcucugcucaccaccccuggugcuccucuggacacccaccugcuuggggcugugguuuguugggagguagggguugggcagggggcugugugcagcccagcaccucugcuaggagagcuggcucagccuggcucucggagagccacagcaccuuccuggcucccaguccuggagcccccaccaggcaccagcuccgugcgucccuucugggagguggacagggcuccuguuguccaaguguguccguccaucccccacaugcagcccaaggggcucuggacuucggccugacccugccucuggcuggagccugcaugucucccuuuccuugguaaggggugaacgucccuaagagccaccucuggguuguaugcuccccccgugacaccugcaggcacugaggccggugagguacgguguugacccugcacagcacacagugacgguacugucagggcuccggacagccaagcccugcucagcaucacgcacugugugcccgggagcagguccccugaccacucagacccucagacuccucaucugagcgagccagccaugcagaugcccgacagggugcugggagggccacucauggagacugggcuuuguacccugugaggccgggcgggugcuggccaggggacacagggcugggggagggacuuuuucuuuuuuuuucuuuuugaaauggagucucgcucuguugcccaggcuggagugcaguggcaugaucucggcucacugcaagcucugccucccggguucacgccauucuccugccucagccucccgaguagcugggacuacaggcacccaccacugcgcuugguuaauuuuuuguauuuguaguagagacaggguuucaccauguuagccaggauggucucgaucuccugaccucguaauccgcccgccucggccucccaacgugcuaggauuacaggcaugagccaccgcgcccggccgggacuuuucuuuuucuucugaggcccccauucaguccgaggaauguagccuucauucagcgcaacguacuguuuguguucucauuggugcucucagaccuccagccaggugguggagagcgagcacugccagccacuucagugcaggaugugacugagccacaaggacagcggggucagguguccgggcgccagguaguucucagaacuugguacaugucaacuuguccagcccaacugcagcccaggacagccugucccuguucccauucuacagacaagacgcggaggcagccgggagggugaccaaggggagcuguuaagccccagaugucuggugcaggguccaaggaugugaccacaugaaacagaacacauagaggccgagguggcaaaccuguucuguggcagggacaagccggggacccgagggugagaaagguccuggccccaaaugcagcuugggccuccugacuguagcacagggggaccagccuccccacugagggcuuggucucuagagggucugcagagaugcuggcaccucuugugugggcagcuugaaugcugaccuccauaagauggggccuggggggccaguacaggcccugccaucagcugcccuccaccagggcccucugcaaaagccuuaugcuggugaccagcccccugaggaccaccacuucaaggugucggggcagcuugggaagacaacccaccucucucacaacugugaccccacuuuggggagcgcaccccaaggaccguggcagcaugugcuuccccacagcacagucucgccucacuuggcuuucugagggcugccgcacagcacagagggcugcagacccacauggcugcaggggaggggcuucaggcuggucucugaggagcccccagggacccuggccacuguguauccagaaaugcacaagcagauuucccuggagggcucuggugaggccacauaguggcgugugaagggggaacuugaggggggaaccgggcuggguggccagcauugcccugggcagaagcuaaggcuaaggugggggguagugucccagccccucuuccucagggccuguccccaccugugcagaagaggccugggguggaauguggccugggguggaugggugggggcugggcguggagaccugccagcuccaucuguccggaugccucuuguggcccccccagugucagggccgcucugaguuggcugagccucuguccagggcuaggccauggcccuccccgccccacgcacuccaggccaggggcagucagugaagaggcaggaagguccagacagcucuaccccuggccagagugccagcccccgcaggcaagagggcuugcugggcagaacuuaguuggcgagggugaggacugcuguggucacaggccucccgaaggacagggaccacagaaccuagagggugggaagggcugggagcaggucuggaguggggcucggggcugagggugcacacagggggccugcucagggacaggaaggacagcugcucacccucaagcuuccugcuggcuauuuaaagacucccuuuuagucuagaacaguggccuucccacaguuuugguauuaaaauguccuuuugugacuggaccuugucuuuuccuuuuuugauaaaaaguuggcaaccuugucagaaccugguaauuuugggguccucugcagugaaggguaggguugccgugauguggauugugguucaaggcccaagggaagauuuuggacaggaacaaggccuggcugcuugagggugggagaaggcagagacugaaagaacuaagucaggcugggggaguuugucaggauguggcggggcggaucccgggugggggaagcagaggaggaggggaugccuggcuggggacaggaggaagcugaccagcugcaaggacggggcaggucuggguggaaggcgggccccagggaggggugacccagggugggggcaagagcuuggggaaugcuucugucuccugcucagcacauccaguuccgggagggcaguggaggcgugcuccaaggucuggcccugcagacgguucaccaccucuucucaagcccaggggacacuaggagcacugaggccaggacuugggaccugggaugccagaaguggggccagcucugucccagaaaccagaacccccagaaagaggucucggcccgcccaccuccuggcccugaaggaccagguggggucccgggugcagcaucccaaggugcugcuggaggccagggaugugcugggaggccaucuccaggucccaguuuacccugggagguugagggccugagaccccugggaaagggccaaagcccagcagcccccaccccugaaggccgcaggggagcgacugguaugcuuccagucugggagugagagucuggugcccacacaucucaagacuggcagggacccucacguuccucuggccaggcgagagugcacucauaaugcccuccccugguaccaagccauggccuccccucagaccugcgggguuccugugggggugcucaggccauggggccucugugggcgcucgugcuuccuggacggcggcauggugggcagggugcugcccuggcugaaccugggucugaacuggggugccugaaccuaccagacaaugcuguggccgcugggcaggggagaaguggggggcgcggggagcgcaggcccagccccuccccucccguccccuccccuccucuccgguucucuucugcccucuccuccccgcuccugcucccccuccccucccccucccccucuucccccucccccucucccccucccccucuucccccucccccucuccccccucccccucuccccccucccccucccccuccuucucccccuccgcuuucccucucccucuccccccuucuccuguucuccccgcccuccccuccucucccucgucgggggcggggccggcagcucccgcgcgcuccggccccuccucggccacacaaaggccccgucuccauggcagcagcgcgggccagagcgcagcgccgagcgcggcccgggcgccaucgagccuuggcggcggacgugcagguaccgagcucgggggacugggcugcgggggacgucucgcugggcguggggggggcuucgccgucagcgccgcuccgcccgggccugccgcgcuggggcccggggaccugcggcggcugcggcuccgcggagggcucccggggccugggccccguccgucgguccauccggcgaggcccgggccgcugccgccccacucccuucccgguguugacucgggggacgggcccggcggcgggggcugcgcgucccuccggagccgcgucggaucccuccuccgcgccugccucucacucuucagccgccgagcuccgugcgccgagcggagauggucucgcggugcgggcgcuccgggccggccccaggcucagcggcacaggagccuggauuugcccgagcucccgggggccguccccgcacccccuggggccugcuuggcgcggggggaccagggcggagagcacccgcaccuggcgagaccccacugccugggccuccucgcgguucccagaguggcgucuggguggacaccccgagacacagaaagucucagaagcgggggcgcgagcccugccuguccccugcugacccugccccuccgcacccugcuccugcaggaagccccugcccugccagcgccccuggucgggcuauucggcagaucuggggagcccgccucccccugucaucugggggucucagagcccggacgcccuggggcuuccugccaggcccuugauuucucuucccgaagcucccugggaaaggaagaaagggguccgucugcccacugugggcuguggcagagucaggacagggggugagggugagggugagggugagggugagggugagggugagggugagggugggccccaaacccggcagaucccggcggccuggagggcucccugugccccaccuucccuggacccccccgcccuccccacuuaaugucugacuucggcccuugcuuggagguucggcgcagccugugaggcuuuaaaguugagcuuccucaggagcccuuugcgggugggagagcgaggcugccgggaagugggggcucucagccugccccaugcccagaugacccuggcacggaacagcugaacagcuggugggaggagcccucccuuuccuguccagaggugagggucucccggagggcagggccagcaggcauagguuuguggcgagucagcuuuuugcauguugcauagaaauccccagagccgacugagaagcaagcaggugggccuggcacaucugaguccucccacgguaccuauggggggcccaccucugucccggggggucugggaggccugaggucuggccagggguuccuugccccaguagaggagggaaguuacugagaaaaacaaggguuuggaaugugagucccccucccccaccggcugccugccaagaaagaauuauuuuggaucauccagccguguccagucacccgaagcgggaggcugcagcgugggagaaggauccacuuccgggacguggguugagggccccaggaggaggacgggcaaguccgggcagcucugccacuuucuacugcagcugcccagacugggcggggagaagaugcgucaccuuuggguuggagaaagccccaagguuggccccagcaggcccugcugagccugcagugggcccaagccccucugggggagaccauggaacaggaggagcucugggcccacccagggacccccucgccccacccagggacccccucgccccgagaagucucaaugguggucugaagagccucugagguacccuccaggcccaaguucagggacacacccugugccagugaccugugcgugccagggaggagcaggcaggagcgaggcuaggcugcuagggagggcacugggguuucccucagggggcccuccugccccaacggacucccuauucagcuccugacuaacggaccagccucccuccaagccccuccgacagccaguccuugccuacgacccccucuggauauggcgccugugagcccauccugcagguggggagacugaggccagagauaggucuaugugaggagucaucugcgaugcuguguggccagggcuguggcuaccuggcgcucuggguccaugcugugugugcgcccggggugugugcccggcggccugcauggggaccacaucggggaggaggagccggcagcuggccccaagugcagaaagcccagagccuuggacccggcccagggaaguggagcagaagagauuggauuggaaggugguggggagggcccauauggcacaguccuccucccaucccaggacgucguccgugcucaccguguccugcccccugccucacccugugccagccacagcugauggucccccugggacgcgggcgugggcaggggugcacuggcugggagaggcugugucuuccggccccucauauugugccuucucugagcuaggcaggcacuuggaugccaggccucugccacgagggcugccuuccccugagcugggaguucucacucagcucaugccuccgucccucuggcugcagccuggccgcccuccuuggaaguuggcggggaaccucuugugcccagagccugccuuggacacgguuuggggaugagguggugagcugcucagaauucacccaguggccagcaaguggccccccagccuugaccucccuucucugaggcagauccagguucucugggggugggagauucaguagggcugggacuggccacagccccucccucccucagggguaguggcuguuuguguuugggguggggcugugggugggguggggcugggucucugacuaauuacacgauggggagggugggucagagccuuggcugguggggggugcucaggcucuggggccccggggaggcagcugcccuagcuucccucuuucuggucgagguuccuccaccuucuuccuuuccgugguuucacaucccuugacacagggccugcuucuucccauaccccuggauuguaaggaccccugccuuucucugccuaccagggaaggacccugcacuguucugggcucccccagccacagguguggccucaagccaggcccugacacaguggcccuccuggcucagaagccuucucucugaagaccaagcgugugaagggauuggcugggccccucccgucuggcccugaacacuggcaccccgcacccccccaguggauccacccugcccugugagauucaugaaccugugacagugacuggccccaggcccaguggugccggggauggugggacaggcugccccuggugguacugcagguuugccccacccccggggaugucugucuggggaggagccuggggcuggccuggcuguggagcuggggguucuguuucgcacagucccgccucugcagcccagauccuggagcccuucacacccagaggccagcccacaccguggcccgcuaugguugguggccuucccuggggguagccccuaaggccacaccugagcugccucaugucccaggcuaggugagggaggagacugcccugggcugggaucagggcgccugggggcagguccagcucucuuccucagcccccuaaggucuccuggcuucugaaagccaauaguuccucauuccagugccagcugagucccggcccaggccuggggcaggagagggaggugcugccccaguucagccaccagcucugccagcagggucccagcagcagcagcaucagaggcagggacugggcuccuggggguagggccccggccccucuggcacagcuggucagcagcuuccauggggggcccuguguggagacacaguguccagcaccgauuucugggccugaugcugccccagcugagucccgcagcaagcgcaagagagagaagugcuugguguccaccucugagaaggccuccugugugaacacggcccccugaggggccaggcaagggcgucugcuccuguggcugggacgguuccugcccacgagccuuguguagggcugcggcucucuucccaggugaccuucuguuguggucuggggcccccgagccagcaugccaccugcucagagacagauugggcccccugucagauuggcgucugggggcacugucugcuccuuccaggcagcuuugaggacuucucagaggaggaaccccccugcccugcugguccaaaguggggugcugaaggccgaggcaguuuccagggggcuaugccucaggcugcguggguggcugugguaggagcgugcucugugauugucacugcauuugccugggguccaugcucuguccucagcuggggucuggcuuugaaccuaggugaguucuggggcucugaggacaggccagaagcaggagugugggggggucucuccugggggaagcaagggaggccugggccugugugacucagacgugguaggguggcaugggagccacagcuuggggggauggcggggggcuugaggguaauccaaguauuucagggacccagccauggagagugggguuugaggaccagcaggaggugaggacucuguggaucccagcccugucagguguguuuucagagcuggggccugcuuuggaggagauggagggcacagaacacugcugagcccaggcccugugcccagccuugcuccagccuuaccggcuugacaccagggccucccucccaccagcgagggggagaagcuauuuuaaguggagccagcaguugacaggggcaaggggcagguggugggagggaggugcuccagcauggcccccccgacucccucucagccucagagauuggccaggggagcugaggggcuuggccuccccacuccuauguuggcaccgagccugaucuggugaccacccugagggacuucaggagaaaaggauguuagggaggagggcgugaagguggggcgccccaggcaggccgcccaggcccagcaaagcucgcuggagggucccccaguuccacaucuagaccuggggcccaguggcucucgaccaggcccugugggguuugaaguccucagcuccaccaugagcagagcaagccuccgcguggagcaaggggcuggaccuggccuccaggggcacccaccuccccacacagcuccagccacgggcaucaccucccacucacuguccugcccccacucugagaugggcauuuccucacugggaaaucccugucccucuggccucccaaagcccugaguguuugccccuguggggcccagcccacacccugggcugccucacccuuggccuggacccagguccugcccaacacccugugccucaccagcccccagcucauccugggcagacgcagccccucuccccugcugagacggcccugcccccaccccacuuccccaugccacacauggccccucccucggggcuccaggcagcgcuggguucugagagccccacugccccucuuagcccaagugccccggccugaggcuucucucccaggcucuuuguacuggggacgaguucuggguguuggggugagacccuguuggcagggcuuuuccggcagcacccagccaugugugucugcacauguguggucaugugugcaaguggugucuggcacacaggcuuggcgcggugccccaagcuaauugugggguucagcggugaugggcgaggcggggcuggggugaccgcugaggcgcugacaggcugacggggagauuacaggccuugcuuacugcucacuggcuggggccucacccguccaccccccaacgcccaccccgggggugagaagggggcugugggcgggggcuggucuugagccagcugcauccaggcaggaccuggucucugagcagccggcugcugcgggguugagcuggaaagggggagaugcgugggggccacucagaggagagccugcagguggggcugggcaccggcgggccgggaggccuccuuucaggagagacuccaagugacugagccccagaaucccacgagagucccuccguggccgccugcugucugaccgcauguccuguccugaugaguuggugguuccugcuguagccaucggccucgugugccccgagcgccuggcggugcccaccccucccacaggagguccucaggaagcacggagacaucgguagguucauugcgcugcccagcuuucugacccgaaggaccacgguguagcaagagggggcugcagcugugcccagguuggacaggauggggucugggaccccgaaaggggugguugaggagagaggugguucugcaggccuggugcguguggggacagggcgccguagccaacuggaucccaccuucugucugagggcuggggaggaccauccuccagaugcgccagugggccguggccagagaggaggcugaggagggccucacaacuguguguaggaugggagggcagccuggggccccagucuagggacgcaccauauacaggggcugcacuuggugcagaggcggagagggggcuggggcaggccccuugggcauggccaggugagcucagggggugccugagggccagggcuagauacagaggcccuggguaccagguggccugggugugucaggagguguggaccagugggggcugugacuaacucggcuggagcaagugacaggaggagcuggggcuucauggggcacccccaggauccugggcuggugaccccaucacugccaccagccagggugacuuuuccugcugggacccagagcccagacugcaggggaggcuggcccuaaguaggaaccccacccugaaaccaggcuggcggggaaggggugcgacggccuccaccugggagggguccucagccgagaguccagcggggaccgcuguagacgcugaagcgaggcucaggccuccacaucagucugucccuggagccccgccccgccccgccccgccccagcuccuaggucggguugugccgggagcguucggccuuugccucgggugagucuggccuugacccuggguccggaguccugcgggaggcugcuccgggcagggucgugcaugauuggcagcugggccgggaggggccgagcccugagaccgaccgggggcacgggcggagccaccaucggcggggcggagcugcuccccgcgccccuuccacggcucggaggacuuagguaauggccggcugugcgauccgaugugcccgacgccaggugagcgccccgcggggacgacgucuccugcgcucgugugacugucgccgccgccgucauuguuacucgggucagacucccacccgcccgcgcguccugggcccccggccuggugagguuugucccagaggcggccacgugcucccuccaggugcgcgaggccgaggggcggacggggcgccggaguccccgggagggcgcgggcgguggccguggagcuugggcucgcggggggcagugggcggcgccgaggaggcgcgggccuagucccugcgcuuccuggccccgggcgcgcuuugccccuggcucccgggcaaccguucugcgcccuccggggagucuggcggugccggcgccgggggaggggcugugccaccugggucggccugcgaggaauaguccagggcgcuccacacaggccgggugcccgccuuuggcucuggccggguaccgggcucgcagacccacccaggagacaccgccccccgccucccgggcugaacucugacccgggucaccgguggguggggcuggguggcggggccgccggucucgcccucgccgggucucccgcgcgcucuccacccagucccuccccgcgccuacccacgggcgcggcgcugcgggaaggggcggccgggguccuugccgaccccccagccccacgccccgcggcaccccccucgcgcuuguuuugaaaacagcggaggcugggauucgccggcgcgucuguuuuguuuccucugauguguuuagcgcucugggauaauugcagauuugcgugugucgcuagcuuuggcccggcccccuggcugcuggcugcggggccuccggggccuccguggcuuuucugugacgccugucgccccguuccgggacagccacucucagacgcgccuuggccugugcuuggggcagccuaucgcucacuugguccgaggcugcuucccccgcccccgcaccgggccccccccccaccccacgcagggccuguguccaccccaauccuuugagcccuggagggccgcacagcccuaggaccucugccuucuccaccgcccauguccuaggugcucaugccacccccuccugcccucccaggccuaggcccgagcucuccucguucuucauggcggcugcugccuggauccccaucuuggccccugccgggccgcugcccaugcaccuccucuggccccugcccucucugguucccgugccagagcccacagccuggccuggccaagagcagcccccaagcugggccugcccucccacugggccugacugcuuugugcugguuugauuuuagcauuaagaauggucagucuggcugggugugguggcucacgccuguaauuccagcacuuugggaggccaaggcggguggauugccugagcucaggaguucgaaaccggucugggcaacacggugaagccccaucucuacugaaauacagaaaauuagcugggcauaguggcgugcaccuguagucccagcuacuggagaggcugaggcaggauaauugcuucaaccugggaggcagggguugcagugagccaagaucaugccccuacacuccagccugggugacagagugagaccugucucagaaaaaagaaaagaauggcccagucuguuugcuugaaaauacugaaaggcagagaacucccaauuuuaguccccacuggaaccaccccgcagugcagccaagacuuggggcggucucagaaccaaggcuggcaggaguuugggggccuggcagcccccacucuuggccucaucuggaguagggcucuguccuucccccuuacaugccucuuguuuaccuuuacccagugggaggggcgggggccagacucagcccgugcaaggggccugggggcugcuggucagaaaaaaaaaacaaaagggaccucaggagagggccacaggugcccagccagcaagcagcuccugcugccucccaggcugucuagguuguagaggggaggcccagcaucccugugcugcccuuggccuacaucggaguucugguugggggaggagacccuucugcucuguuggccugggggugaccugcggggacaggucuucugggcucgcgccccugcaugucaccaccccuucccggcucacugaguuuggaccggcaggugcccagugaccagauccaguguuuggacuuguuggggcagggcggcggggcagccggggccugucggggaagaccauagaccacagagcaaggccagucccucaggggcuggguuagggagggugucucggggucuaaaggaugggcaggggcuuuccagggagcacagugaacauggacgugggaaugucgugaggcagcguucucugagugggcacagcuguaaagauuuccacacccacucaaccucaaggcagcccucugaggugggcgccauaaugacccccagguuacauauggggaaacugaggcacagagcagcuuucugaauggcccacaugagccagcuagaacgugacagagcuggggugugaacucacuggucuggcucuggacuucaggccucgaggucccugggugcagcagcgucaggugugaccacagccaccuaaggaagaaacuccuuuuucugggguagcuaagcgggaaucuugugagcaggagauggagccuggcucaguguugagggcaagauggauggaggugggagaagccagaggccgggcagaggagguagacuugggccaggaagggccccagacugaggguggagggaucaugguguuauucucugggaggggaaauccauggccguucuccacggugagggccagggaagaggacggcagaaagccuccuccaggagaguggaguaugggucuugccucuggcuuccugaguggaucgaucacucaggggagguuguucgagggcgugcgggaugggcgggacagaagccagccuccccugaccuuggcugcccccgcccacgccuggggccugggcccguggaggcuggagccugggggugugcugcagggagugggcauggggcacacaggccgguguggcgucccuucaagauggcaggucuggggguaccgugccaccgccauggcugccaccuccgucgggagcugcagucuccaguccccgcgggucccagcuuucucaggagacccggugcugcccugugcuuuggcuccugaguuugccagaggagcagccuuuugcccuuuucacaaaggugcuguugagucucaggucgaaaggaugcccucugccccccgaaaccucauccucuccccagcccuuuggccggguuaacccuuaccugugcagcaggguagcacaguccaugcacagcuguggagcucaccucccuucccgccgccccccugcuggugucacugcauguccaaccccgggucccgcugcacagggcacaugaggaucccgguggggugggaggagaguggggccuggcccugcgggaggaggugcuuugcuggcacacaaccuggccaggcugcaguggacucuggggccugagcaggauucaguagcugaaccuugguuguagggguggcuauugagggccuggagagucacaucuugaggcagaguggagccuaccuucuuuucuuucuuucuuuucuuuuccuuuuuuuuuuuuuuuuuuuuuuugagacagagucuugcucuuuccccaggcuggagugcaauggugugaucucagcucucugcagccucaggugauccgcccgccucagccucccaaagugcugggauuacaggcgugagccaccgugccuggcucagcuucuuauuuagacaagcaauauguaaauauaaucuuaaacuuguguuuugcuuuaaucuuagagucagggucucgcucuguugcccacaaucauaguucacugcagccuagaccuccugggcucaagcuacucugccuuagccuccucaguacccgggacuucaggcuguaccaccacacgcggccaguucacggucuaguucaaguuccuugaacuuuuuuauuguguguguguguguguguguguguguguguguguguauuuuuugagacagucucacucuggccugggcuggacugccguggccuccuccuugcucccaaaguucaccacuauuuucuuuucuuuuuuugagacggagucucacucuguugcccaggcuggagugcaguggcgcgaucucggcucacugcaaccuccaccucccagguucaagcgauuaucuugccucggccuccugaguaguugggauuacaggcgcgcaccacuacgcccggcuaauuuuuguacuuuuaguagagaugggguuucaccauguuggucaggcuggucucgaacuccugaccucgugauccgcccacuucagccucccaaagugcugggauuacaggugugagccaccgcacccagccuuagccggccacuauuuugauuuugguuugacggcuucuggagccucucagagauggauggggccaaauacugcacccaggcuuccccaucagaaucagcacagacgcaccugcaucuaccauguagucuuccacaguauccucuggugggaugcuggguggcugccaaauuuucacuaaagccaaccaugcggagaagcacccugggucugugccucccuguggguauagucgguguuuauccagaacuagaagauacaauagcaagggaagauacaauagcaagcauugcugaaugcuacaguguaacacucugaggcuuuuugugaaugaauucauuuaguccuuguaaaccucuggggguagcucaccauucugucuccauuccacagauggagaaugaggcacagagaaguuaaguaacuugcccaacgucacacagcuaguaagugaaauuucagggucaugggugugcguauuuuucagaaagcaacuuuuuuuuuuuuuuuuuuuuugagacgaagucaggcuggaguguaguggugcgaucuccgcucacugcaaguuccaucggccggguucaugccauucuccugccucagccucccgaguagcugggacuacagcugcccgccaccaggcccaucuaauuuuuuuguauuuuuaguagagacgggguuucacuguguucaccaggauggucuugaucuccugaccucgugauccucccgccucggccucccaaagugcugggauuacaggcgggagccaccgcacccggccucagaaagcaacuuuuauuuuaagcaaaguaauagccauaccuaguuuaaacaggcagaaagccccugacagaggggagugccaggagcccuggaggugucugaggaaggggcugugcaggggccagagggaagccaaaggccagaugggguccugugggauguuucuucccccaagccccaccagcaugggacagagguggggggcuccacagcagaccgggcuccucuugugaccggcgucucuccuuugccuccuagagaaucucgaugcuggccuggagcagaaacugagcuggaccacuggagccucggugaggggucuguaccccaccugggaaaggcaguggguggcuggggcuauguggacagggaggccggagguaucuagaacugccauguggugucugcaaggcucuguccagccagguuucaaccguaccugucacucugccacccuucccauggccuggccuggauggaaguggggagcuucccugcccauggagccgcugugaggcucccaugguucucugaggccaagcuguugcucaggccaagcuuuugcucagguggaguggucugcagugagacuguggcaccggguucugggacaucagggcugggaauuggagcguuggggguguggugggggggugccugugcagacgcuuugugggcagcagcagcuggaguugcuguggccuggucuggauggaaguggggagcuucccugcccagcagcagccggaguugcuguggccucuugaaagugccccuccgagcuucagccaggaggaaggcaccagagggcccgaggaaauccccgccagccccguaagugggggucccaggagggcuucaaaacaggaagugccugcugcccgcccucccuccuguuccaggaacacaggcagcaggaagcguagcuggcugugccuggcgccuccugcgccgccggagcuuugcugcugguccgguggguugcccuuugcuccugggccugggcaggcaggucaccugaggccuuguuuguccaggaaccagaaggcagcugccaccuguagggugucaccccagccgcgccugccacccugaaaagccugggccuguaggacccugggagucaggcuuucccugguggcacacggugguguuuauugagcacuuagggugugccagcccccggcagggacaggagagccuucuuccuguaccggggccccuacagcccuggcgggugggugagugucuucccuggguggaagcugggggacggcugagggguggcuugugggggcccagagccauugcuuuuccuggggcuaggggcgccgcaggguuccccaggcugccccaccacgguccgggccagauccgaggggaccgugggccccgcccccgcgcugcccccgcauuccccucccagcugcgggcgcauuccauucauucccgggagcugcgccuggcugaggcugccucugccacugccaccgagcugggccgggugagcgagcugggccgggugagcggggcugggaggggagggcagcaggccugggcgcagggccgaggggccuggacguugccugcccccgcuggcgccacugggugcacuuagaaggcgggggccugcgggaccugcccccggguggcuguggguaggggaggggcgcggcggggguuggggagccuucgggcaggcgcugcuccucccugguagggccaugggcuguggcuguagccuacgggccucuccuggaggccugggacuccugugcccuccucuccucuccccuggacaggccacugagccacagcgggggacccuggcugagcugggcauagaacccccuccaccaggaucaugcccagagguucccgugggcuuguagaaucuuccugucucucacuaaagccagcaucuuuuccuggcugaucaccccuauccuggugaagccuggggucccauggcccuacccagccucucugccaccagucggccaggaacucccuagccuguggguggucaccucucccagcggcugcugugcucgugggcaccuggggggcuccagggguugggcagcagcugagcacugaacccccagugcagggagggaguucugugccgggcaggagcugccugucuaaugggugcacucccagggagcaggaaggccagugcagcgcugucucacucaugcgggcccugggguggcucagauguugucggucgguugcgucuugguuacaccucaagagauuucaggaagcgugcgggcaaucagaacgggggguugccacgggcagguggagggcggcugugccaguaaaugcagcuucacccaaagccgaggcucgggagaaacacuuccccuggcuacggagcagcagagcgggcuccccugcccuccugggaggacagaggccaggggguuugggggguugucaaaaggguggagaaacacaguggucagaggccaagcugcucccacugcaugucagaaucccagccccacccaugcccgcgguguggccuuggguaaauucugcuccgugccucaguuucuucaccugagaaaugggucacaggcugucguggucagccuggccgucagagacacagggauguggaaacauuugcauuuuguggcuuguucuuuguacacuuaaaacuuuuuuuuuuuuuuuuuuuuuuugagacagagucucgcucugucacccaggcuggagugcaguggugcaaucuuggcucgcugcaaccuccgccucccagguucacgcgauucuccugccucagccucuggaguagcugagacuacaggcgggugccagcacgcuuggcuaauuuuuuuguguuuuuaguagagacgggguuucaccauguuggccaggcuggucucaaacuccugaccucgugauccgcccgccucggccucccaaggugcugggauuacaggcgugagccaccgggccuggcaaaacuuucaaauauguggugagaaagcggauugcguuucgaggggaugagacauaugcagggaggugacacuugugguggccugagaggauguggcagucccucuggaggcacggggugggccugcacagggaggugggggaggccagggccuccaucccucguaacccucugccaucgagucuggacccccuuggcaccugccauggcagggcugcccuggacaccugggagccccccguacuggugcacucagggaagaugauggugggcccaggagugggggugguugugagcaugaggagggggcacuggcaggggaggcugauguagggaucacuggccaggauggagcagggucccuagcgugagagggacggaccacccugaggaagagcucagaggcagaagggcccugucucugccacuugugucugagcccccaagaugcaguugagucugguagggagggaaagagagaggaccacgcauguccuggguccaccuguggggccuuggaucuuccuccuauugggagacccucagcucagccugguccucagcagcucacccaucacaccacacaucccccucauccacccggacccaggcacagaccccacaccgagacgugcucaguuacacacacgcauguggacacagccuguccaggcugcagaugugggggccucugccucugagaccugguggauuuggaguugcucauggcuccccagguccccuuguugccuccgcugugcgcacaucagaggcugugcccugggcgugacaugggccgagcgaggagcugugggugauugcuggcuuccacuguuucaccagggcagggggccuggagguggucagggaggcucaggccgccugggggcucuggcgggcaguuguaaacagcaugugcacuugcugggcuaugcacagggcaccccucgcucucaccugagccucugguuucccguguccuucaccucugccccaugggugagccaccuguuccaacguccaggggucugucugucagccugagccugugcgcuggggccggugcgucccgaccaccuggagcuccuuggggucacaggucagggggcaugaaugugagcacuugagagccuuucugggggcgucaacuccuugccucggggauaggccugccgguguuuucagcaccuccgggagggauccuguagcaggcgauggcagugccuuggccccaguggucagucaggguggacuugaggagggcugagaaguggucuccggcgagaccucgaggauggcgggggugugaagcaggaaggggcggagcuccagguuccucaguucguggaguggcgugacccucucucccauguucugacguuuggggcagggacuggagagggauuugaucggggguccucugggucggggcuccccugacccuucucucuucccacagggugcggggggcaauggcacugcagcucugggcccugacccugcugggccugcugggcgcaggugccagccugaggccccgcaagcuggacuucuuccgcagcgagaaagagcugaaccaccuggcuguggaugaggccucaggcgugguguaccugggggcggugaaugcccucuaccagcuggaugcgaagcugcagcuggagcagcagguggccacgggcccggcccuggacaacaagaagugcacgccgcccaucgaggccagccagugccaugaggcugagaugacugacaaugucaaccagcugcugcugcucgacccucccaggaagcgccugguggagugcggcagccucuucaagggcaucugcgcucugcgcgcccugagcaacaucucccuccgccuguucuacgaggacggcagcggggagaagucuuucguggccagcaaugaugagggcguggccacaguggggcuggugagcuccacggguccugguggugaccgcgugcuguuugugggcaaaggcaaugggccacacgacaacggcaucaucgugagcacucggcuguuggaccggacugacagcagggaggccuuugaagccuacacggaccacgccaccuacaaggccggcuaccuguccaccaacacacagcaguucguggcggccuucgaggacggccccuacgucuucuuugucuucaaccagcaggacaagcacccggcccggaaccgcacgcugcuggcacgcaugugcagagaagaccccaacuacuacuccuaccuggagauggaccugcagugccgggaccccgacauccacgccgcugccuuuggcaccugccuggccgccuccguggcugcgccuggcucuggcagggugcuauaugcugucuucagcagagacagccggagcaguggggggcccggugcgggccucugccuguucccgcuggacaaggugcacgccaagauggaggccaaccgcaacgccuguuacacaggcacccgggaggcccgugacaucuucuacaagcccuuccacggcgauauccagugcggcggccacgcgccgguaugggccucaguguguucucgcagggcccggacugcaggcguccguucguggguuugcgugucccagccugcuggggagggugcacgugagcaguguggccguggcucucgccagccugggcgcuugcgugggugggugccgcaucucucaaugccauucacgcuggcgccagucccaggccugugucgggcacuggggaacacaacagugagcacgguggggcucccugccauguggguucuguucucggggacguguguaggacgugugccggagggaagggaagggccugucccgagucuuggagcgcgaguggagagggcccuucaggacagggggucugccugccauugacacgcugugguccgcagggcuccagcaagagcuucccauguggcucggagcaccugcccuacccgcugggcagccgcgacgggcucagaggcacagccgugcugcagcguggaggccugaaccucacggccgugacggucgccgccgagaacaaccacacuguugcuuuucugggcaccucugauggccggauccucaagguuuggcccaggcuggggcggggaggcucuggagggcccgucugugcacaaggcccguacccucaccggccugcccucgcgcacacagguguaccucaccccagauggcaccuccucagaguacgacucuauccuuguggagauaaacaagagagucaagcgcgaccugguacugucuggagaccugggcagccuguacgccaugacccaggacaaggugagccagacgcagccccggagagcacucuaggccaagugugcccggucauugcaucccaggcccuuaggacaggccugggggccagaggaggauggggugcugcagagcugggcccuucuccuuggucuggaugagggguggcugggugggucccgggcagugccuccauccugugucucucuagcacugccccgucucugccgcuccuucuguuuguccuuuguggucucaaccaugucucucccucuggccccgccucugcccuguccugauggaagggaccuggguuggugucugaggcguguugcugaggguggaugggaagacggggucccugcacagcccaugugagcucagucaguggagaacaugggccugggccccaagcuugugggggguuagugccagagacccucaggccagcccuaggagcaccccucggagggagccaguguagaggacaggagcugccccgggagacaccauagccaagaccuccaggcuucccugggcucccaucgggauccugggccaggcauggccacccagagccagaacuguuuaauaucaagccugaggugucugaggcucccgaggccccgggacagagcugggucaagcuggcggucuggggacaucuggggucugcggaaggcccgugcggccucugcuguggucccacucacggccccgcugcccuagguguuccggcugccggugcaggagugccugagcuacccgaccugcacccagugccgcgacucccaggaccccuacugcggcuggugcgucgucgagggacggugagugccugggguggcucggggacacggccugccucugggaucccggaaggucguggccugggucggggggcacaucgcacuguccugucccgggagaacaagacuccacccugggcugaggccgcccccugcgccugcagaugcacccggaaggccgaguguccgcgggccgaggaggccagccacuggcuguggagccgaagcaaguccugcguggccgucaccagcgcccagccacagaacaugagccggcgggcccagggggaggugcguggugggucugggguggggguccugggccccaggccgggccaggugggggcucccccaugcugggagcuguugggacaggcaggggagggcuccacaucucccccgccugggcucugggcaccgagccuuagggauggagcccgcccuccauugguccccuggaccccuaugaccugggcgggcagggguggggcuuguccauauccaggguggacucaggcccugucccaggaguugcuggggugaccacagagaggccuguauuggaagacguggagucggguucuggaggcuccacugggacgugcgcccacacacgcagggaggucgggucaccggcaggugggcugacaggacucgggguucccagugugagcggcacggccccucccucaggugcagcugaccgucagcccccucccugcccugagcgaggaggacgaguugcugugccuuuuuggggagucgccgccacaccccgcccgcguggagggcgaggccgucaucugcaacuccccaagcagcauccccgucacaccgccaggccagggugaggccccuucccgagcccccggguggcccuucucggucgcacggggcccugugcacacgggcucucgccucugcuggccccugggugcaggcucugcacaggcacacuccgcggcugcuccgggggcccagccugaaugaagccuguggugggguugcugugccuguuggggagguucuggcuucuugggcuguccgcagccacgccccccaggccuguagcaaaggugacuugucuucagccugcucccucaucacguccggagcggcaugugggugccaggcgccaggccccgucgucucggcagacgccccucaccccuuccugccauguccagcuucagagagcagggccguucccagaggcugcagggccucgcaugugggccagggcaggcgucgcgcccauguccccugaguuuugggggcaguggggccacgcagugacgugggcagggaccuggcaggucccacucagacuccaaggagccgcugcccucagugccugcgggaacagaggguaugaaagcaaccuggacccgggggagaaaggcaagcccggugcugcgcccgacacccgaaccaagaucugauagcagguggcagguccagcccagcgugaacgggcguccuggcagccccacccgagaucugauagcagguggcaggccccgcccaacaugaaugcggggcguccuggcagggcccccugaagaccaggggucuccaccuuggccccaggagucagccccaggggaggcccagccuggcccucggcccugcggccgccaccuugacaccucccccucugcugucugcagaccacguggccgugaccauccagcuccuccuuagacgaggcaacaucuuccucacguccuaccaguaccccuucuacgacugccgccaggccaugagccuggaggagaaccugccgugagugucuugugcccaucgaccccacccugcccguccaccccagcccugcucacgauccccucuggaugcaggugcaucuccugcgugagcaaccgcuggaccugccagugggaccugcgcuaccacgagugccgggaggcuucgcccaacccugaggacggcaucguccgugcccacauggugaggggccucggggccucaggggacuguucagggcauggcugcuccgcugugcccaggcagcaccugaccagccuuacucucccaggaggacagcuguccccaguuccugggacccagcccccuggugauccccaugaaccacgagacagaugugaacuuccagggcaagaaccuggacaccgugaaggugcggagggaggggugccggcuggugacaggcaggcucaggugcggagggaggggugccggccggugacaggcaggcucagguacggagggaggggugccggccggugacaggcaggcucaggugcggagggaggggugccggcugugacaggcaggcucaggugcggagggaggggugccggccggugacaggcaggcucaggugcggagggaggggugccggcugugacaggcaggcucaggugcggagggaggggugccggccggugacaggcaggcucaggugcggagggaggggugccggccggugacaggcaggcucagguacggagggagggggugccgguuggugacaggcaggcucaggugcggagggagggggugccggccggugacaggcaggcucaggugcggagggaggggugccggccggugacaggcaggcucaggugcggagggaggggugccggccggugacaggcaggcucaggugcggagggagggggugccgguuggugacaggcaggcucaggugcggagggaggggugccggccggugacaggcaggcucaggugcggagggagggggugccgguuggugacaggcaggcuaagguacggagggaggggugccggccagugcugaugggugugugggaagccugagcuccacccgugccccccgacucggggcccccacaugagguagagggcacaggauuuaucggggacagaggccaggaggcagcacucgggggccuuuggaugggccugaagagaggcaguggaggaggcaggcguguggagauugaggggccagugccaccuccugaggagggagcugugggggccacgaugucaggugggccgggcgauguucucagguguggaugagugguggagguggccgugggaaacccacagaggacguucagaggcuucugcagacacagguguuugggcucaggaguggccgaggggucagcuggcaugguaaucugaggggcgggcauguguggggugaggagagggcucccacacuguaggcacagaggaggggcugcagggguucugggaggagggccagggugccacagccgccuguccaggguccugacggcauggucugcaggguuccucccugcacgugggcagugacuugcucaaguucauggagccggugaccaugcaggaaucugggaccuucgccuuucggaccccaaagguacggcuccagggcaggccggcucggcugcuggaccccagggccccgggugggguggggggucaccuucaggacugugaggggaggggcagcagggagaccccagggaccagagcccagccaggggcucgccaugcccugugcugcuggggaagcccccucugcccucugccucccuggggacagaguggcacagagcagcguccaugggguucccgaacuuccgacaccugaaggccuccccugcugcccuuggcugggaagggacccgguggccacagggaggcugcccuugugacccccgccccacgccccucugugggggcaggaagugcagugugccccugcgugucccccagcugucccacgaugccaacgagacgcugccccugcaccucuacgucaagucuuacggcaagaauaucgacagcaagcuccauggugggggccacgggcgcaguggggggcgggcaggggacgggugggcacaaggcgguggguggggggacaggugggcgcaguggggagcaggucgggggcgggcaggcacggggugaccacugacggcagcucuccccgcagugacccucuacaacugcuccuuuggccgcagcgacugcagccugugccgggccgcuaaccccgacuacaggugugcguggugcgggggccagagcaggugcguguaugaggcccugugcaacaccaccuccgagugcccgccgcccgucaucaccagggugagccccucgaagccuggccuacaccuucccucgucccuggcaugagccccucccugcucacccggcucugugguuucagauccagccugagacgggcccccugggugggggcauccgcaucaccauccugggguccaauuugggcguccaagcaggggacauccagaggaucucuguggccggccggaacugcuccuuucagccggaacguuacuccguguccacccggugaguggacggcccuggucugggcccugucagcugggucaguacccacgcugggguuccgggugacuggguggguggggaggcugagggggugagggugucaggguguggggugggucggggagugccugggccacacugccugucgcccgccaggaucgugugugugaucgaggcugcggagacgccuuucacggggggugucgagguggacgucuucgggaaacugggccguucgccucccaauguccaguucaccuuccaaguaagcacccggccucggggaccugccgaacccgggaggaccgggaggaggggcucugcccgccgccuccccacgacaguuaccauccagcccaggaccgagggcguccugugccccguccucacccgagugccccugcggcucuuucagcagcccaagccucucaguguggagccgcagcagggaccgcaggcgggcggcaccacacugaccauccacggcacccaccuggacacgggcucccaggaggacgugcgggugacccucaacggcgucccguguaaagugugggugucaccgccagcugcugagucugguuggcccuggcccuggguauggaggggggcacuuacugagaccugaguggcccugaggggauggcggggccagccuggucgggcuggggcuggucccgggggagggguugaugcagaccagcacccucccucccccaggacgaaguuuggggcgcagcuccagugugucacuggcccccaggcgacacggggccagaugcuucuggaggucuccuacggggggucccccgugcccaaccccggcaucuucuucaccuaccgcgaaaaccccguacugcgagccuucgagccgcuacgaagcuuugccaggugaggcugguguccccccgccccccucugcuccccacacccagcugccuccucagugcccuuggcugacugugcugaaaggaaugugguggggcuggucugugcagcgggaggcggccuccggaaaaccccacugcacuccagauccacuuccuccuagaaacccagaugggcacaccagaggcuccacgcucaccaggccccgugugccccccgcccacuugcggcacagucucgugcucagcacgucccaccgcguugccccuuugcccaccgagacccacacaugcaccuggaagccccguguggucagggccagggugggcggggacgggagggcggaggcugcagggaccaccccugccagccgagcccacgaaggcacugcccuccgcagugguggccgcagcaucaacgucacgggucagggcuucagccugauccagagguuugccaugguggucaucgcggagccccugcaguccuggcagccgccgcgggaggcugaaucccugcagcccaugacggucaguccuggcgugggcucagcucuggcaccggcccaugggaucgugcccaggaagggcggggucugcgcccgggggcugacagcugggacuugccugcaggugguggguacagacuacguguuccacaaugacaccaaggucgucuuccuguccccggcugugccugaggagccagaggccuacaaccucacggugcugaucgagauggacgggcaccgugcccugcucagaacagaggccggggccuucgaguacgugccugaccccaccuuugagaacuucacagguggcgucaagaagcaggucaacaagcucauccacgcccgggugaggacggugcagccccgggugucuggguccugcucgggucugggcugagagcugguccaccugucccugguucccuccuccucaccccgaccacugccgccuccccagggcaccaaucugaacaaggcgaugacgcugcaggaggccgaggccuucgugggugccgagcgcugcaccaugaagacgcugacggagaccgaccuguacugugagcccccggaggugcagcccccgcccaagcggcggcagaaacgagacaccacacacaaccugcccgaguucauugugcgugagcggggacuggcggggggugcccccacgggaccgcgcugaacccggccccccacacaggugaaguucggcucucgcgagugggugcugggccgcguggaguacgacacacgggugagcgacgugccgcucagccucaucuugccgcuggucaucgugcccaugguggucgucaucgcggugucugucuacugcuacuggugagcccgccccccggcugugccaacacccugagcccucggcccucccgccucggccccucuggccucauccgccgcccugcacaggcaggcguguagauccaccuccucauccgggcagcugagcggccagccccggcagaaccuaggaggcccgcugugccuugcaggaggaagagccagcaggccgaacgagaguaugagaagaucaagucccagcuggagggccuggaggagagcgugcgggaccgcugcaagaaggaauucacagguagggaccgcuugggggcuggugcuggggcgccuccuggggcggggaugcuguguguagcgugggggucagggccccacguggccagggacgucucacgccagccuccccccagaccugaugaucgagauggaggaccagaccaacgacgugcacgaggccggcauccccgugcuggacuacaagaccuacaccgaccgcgucuucuuccugcccuccaaggacggcgacaaggacgugaugaucaccggcaagcuggacaucccugagccgcggcggccggugguggagcaggcccucuaccaguucuccaaccugcugaacagcaagucuuuccucaucaaugugagccaggcgucgggcgggcgggagggcacacagguggcgccgggcaggcuuugaccgccggccccuacaguucauccacacccuggagaaccagcgggaguucucggcccgcgccaaggucuacuucgcgucccugcugacgguggcgcugcacgggaaacuggaguacuacacggacaucaugcacacgcucuuccuggagcuccuggagcaguacgugguggccaagaaccccaagcugaugcugcgcaggugcacaugggcggggccacgagcggggccacgggcggggcggccgcaggggcucuggggcugguggcggguggcacagcggccuguugggcccccaggagccggcaggugccagccagcgcuggugguggggggcggucuaggggugguguccccggccacaaacucaaagccggacucuagcccuuccuguccagcgguuucagcuggucacagugucagcccucugcagaacagaaggaagguggcacacuucccacaagggcuggagcugccaccagguaguccucgcugcaggccacacccaggcuggacaggggcgaggcuggcgcaaggguggccgggugcuuggaggagucaguugggccucaggaauacuacggggucacucgguacaaggccucccugcacccccaggucugagacugugguggagaggaugcuguccaacuggauguccaucugccuguaccaguaccucaagguggguuccaccccagccuggcuggggcuugagggaugaggcagacugcugccauccccuccugcguuccccuaucuguacggcaccuugaggugggcccugccuggacagguuugcuuccugccccugacauggucagccccguccaugccucuggccagggcuccgggggccccuuccaggccccaaguccccugaccucccagccuccccuccguguuacuccaggacagugccggggagccccuguacaagcucuucaaggccaucaaacaucagguggaaaagggcccgguggaugcgguacagaagaaggccaaguacacucucaacgacacggggcugcugggggaugauguggaguacgcaccccuggugagcuucuggggugggggccgccaugggcgccucggaucugggcuaaggagcuugggcauccccuggccacagaugggacccacaggccagaggccguccaccuccucuguggauucgaguuacagccugcucuaacucggccucagggaggggccugggugcugguggcugugggcucuggaggcucuaagugugcgggccccgcaucagcucuucccgggcgcccccaccuccuggaggccauacaagggccuggcacaccagguguguccaggguucugugcauacaugaccaguggguguggcaggagccugugcaugugugagacguguguauucugugucuguacaugugcuuccaugagcuugcgugacagccugagugagcgguucugagccguccccgucuuucuguccugcugagccggagcaggcaggggaagggcagaguguggucaucugggaagccucgggggcucggagccgggcuggcgggggccugcugcccaagggugccgcuguggugggcaaagcuggcggggcagggaguggcuccugcauggugcagguaagagcagggccucccacugggcuucaucccggaugucucggcagacggugagcgugaucgugcaggacgagggaguggacgccaucccggugaagguccucaacugugacaccaucucccaggucaaggagaagaucauugaccagguguaccgugggcagcccugcuccugcuggcccaggccagacagcgugguccugggugagugccggccccugcccgucugcacacaggcgcccaugugccuggccuguguccuggggcgguauccugccuggccagcuuucucauaugggaguggugggcagugggaggaaccuggguggcuggggcccaagcugggcugucucuucccacagaguggcguccgggcuccacagcgcagauccugucggaccuggaccugacgucacagcgggagggccgguggaagcgcgucaacacccuuaugcacuacaaugugagcguguaggccggggcgggcgagaacugggcacccugggggcacagcccacccucaccgccguguuccccagguccgggauggagccacccucauccuguccaaggugggggucucccagcagccggaggacagccagcaggaccugccuggggagcgugagucccucccuguugcccguuuccuuccagccccugguggucagcguggaccaugucugcccuggacacaugcaccccugcccacccugccaccacugcucccugugggacccaggcccccagaccuggguaggggucccucagugcccgcuccccacaggccaugcccuccuggaggaggagaaccggguguggcaccuggugcggccgaccgacgagguggacgagggcaaguccaagagaggcagcgugaaagagaaggagcggacgaaggccaucaccgagaucuaccugacgcggcugcucucagucaaggugggcccccaugggugugugggcggcaccaggccgccacgcugagacccucccccccaggagccgcgcccacggcgucacgcugagacccucccccccacagggcacacugcagcaguuuguggacaacuucuuccagagcgugcuggcgccugggcacgcggugccaccugcagucaaguacuucuucgacuuccuggacgagcaggcagagaagcacaacauccaggaugaagacaccauccacaucuggaagacgaacaggugaggcuccacacccaccccgcggcccagccccggcuccgccucucacuugggaggcuccacacccaccccgcggcccagccccggcucucauucccugcugcucugccucagcuuaccgcuccgguucugggugaacauccucaagaacccccacuucaucuuugacgugcauguccacgaggugguggacgccucgcugucagucaucgcgcagaccuucauggaugccugcacgcgcacggagcauaagcugagccgcgugaguggggugggggcaggucuggggcagggaggccugggucuguccccaggaggcaucuugugaguugggaccuugucugggguguggauuugaauaucuugggcuggagcccuugauguaggaggugacggguggcggaggcugggggcacaggggcccggcagagccugggagaucccgagagcccuugcccucucuccuccugagaccucucaccacagcacacgagcagagaaacugaguuuuacuacagaucacaaaauaaguaguuuucuuuuuuuuuuuuugagauggagucucucucugucgcccaggcuggagugcaguggcgcgaucucugcucacugcaaccuccgccuucuagguucaagcgauuuucccgccgcugccuccugaguagcugggacuacaggcaugugccacaacgcacggcuaguauuuuuaguagagacgggguuucaccauguugggcaggcuggucucgaaccccugaccucaggugaucugccugccucagccucccaaagugcuaggauuacaggccugagccacugcgcccggcccauaguuuucuugaugaaagugucaggaguucggggcaggggaagcuacccagggguacucugagcagccccagccuggcccccuuggccaggcaucacuggguuuuguccccaacaggauucucccagcaacaagcugcuguacgccaaggagaucuccaccuacaagaagaugguggaggaguaagucugccugcccuccaggccaggcccccaugcccacccucgacccccugcggggagguucaggccuugguuucccccaccacccccuuuguggucccugccgcccacacuguaugaugcucccaccccugcaguuacuacaaggggauccggcagauggugcaggucagcgaccaggacaugaacacacaccuggcagagauuucccggguaaggagaccaccagggacgcacccacagcccuccccgcucccacuaccccaugcugagccuggcccugagcugcagggcagggguaauguggugcugagggggagagaggguggggcgggaccucgaggugggcucggccaugugaagugagccacagcugcguguggggaguaugagcugcuccugcuuggagccaggcccugcccacagcgcccccucccugcggcugcacccacggccgugcccacagcgcccccucccugcggcugcacccucggccgugcccacagcgcccccucccugcggcuccauccacggccguguccacagcgcccccucccugcggcugcacccacggccgugcccacagcgcccccucccugcggcuccacccacagcccugcucacagcacccgucccuguggguccauccacagccgugcgucacacagggagacacugagaugguuggaugugcacaacucugccugcgugggugucugucugaggcugugccacauggggggccccaagugccagcugugcccaaggccccagcugcuuccccggggaggccucguccugggcgucccguacuacuccugccagcccuggggcucccacagccccuuuuccacccugacugucccgucaccccccaggcgcacacggacuccuugaacacccucguggcacuccaccagcucuaccaauacacgcagaaguacuaugacgagguagggucaggcccccgggggcgggggcagguggggugcugggcggucccccggugugcucugaugcgacccucccucagaucaucaaugccuuggaggaggauccugccgcccagaagaugcagcuggccuuccgccugcagcagauugccgcugcacuggagaacaaggucacugaccucugaccuacaaucuccagugcugccuugggacauagguaccugagguaccugagagccccucaggggaggaggccgaguggcuguggcugaggcccccacccuccccuggaacgcgccccaagccggagugggugcagccggaacccgcccagcgucuagacuguagcaucuuccucugagcaauaccgccgggcaccgcaccagcaccagccccagccccagcucccuccggccgcagaaccagcaucggguguucacugucgagucuccagugauuugaaaaugugccuuacgcugccacgcugggggcagcuggccuccgccuccgcccacgcaccagcagccgccuccaugcccuagguugggccccugggggaucugagggccuguggcccccagggcaaguucccagauccuaugucugucuguccaccacgagaugggaggaggagaaaaagcgguacgaugccuuccugaccucaccggccuccccaagggugccggcacucuggguggacucacggcugcugggccccacgucaaaggucaagugagacguaggucaaguccuacgucggggcccagacauccugggguccuggucugucagacaggcugcccuagagccccacccaguccggggggacugggagcaguuccaagaccaccccaccccuuuuuguaaaucuuguucauuguaaaucaaauacagcgucuuuuucacucugcgggu

SEQ ID NO: 17905 - RNA, 589 nt, Homo sapiens
agcccaggggacacuaggagcacugaggccaggacuugggaccugggaugccagaaguggggccagcucugucccagaaaccagaacccccagaaagaggucucggcccgcccaccuccuggcccugaaggaccagguggggucccgggugcagcaucccaaggugcugcuggaggccagggaugugcugggaggccaucuccaggucccaguuuacccugggagguugagggccugagaccccugggaaagggccaaagcccagcagcccccaccccugaaggccgcaggggagcgacugguaugcuuccagucugggagugagagucuggugcccacacaucucaagacuggcagggacccucacguuccucuggccaggcgagagugcacucauaaugcccuccccugguaccaagccauggccuccccucagaccugcgggguuccugugggggugcucaggccauggggccucugugggcgcucgugcuuccuggacggcggcauggugggcagggugcugcccuggcugaaccugggucugaacuggggugccugaaccuaccagacaaugcuguggccgcug

SEQ ID NO: 17906 - RNA, 28572 nt, Homo sapiens
uugacgacagcgcgcaggcgcacggcgcgcccgggcgggccggcuggcugggaagauggcggcgggaaccugggccgccgccgccgccgccgccgccgccgcggagcgaaccagggguguccggggugcgcgguccagggccggggccgggccaugagcgcgccguccucgaguccccgagccgcggagcccgcccgcgccccucgggccgccccgcgucccucgccauggcgcggcucgcggacuacuucgugcugguggcguucgggccgcacccgcgcggugagugccgaggccaagcgcugagggccgggggccgagggucgagugcugagggccaggggcugggucugagggucgagggccgggggcugggggccgagggcugggggcugggucgggaggccgaggacugagggccgggcgcugagggccgaggaccgggggcugggcgcugagggccggggucgggggagccgaggacugagggccggggccgggggccgggcggggacugaaggccagggccgaccggacagcccguggggagaaugggcguccgcugggggcggcguggccgcgcgggccugguggcggcagggagagaaggcugggcccggccugcccggccuccuuggggugggacgggcucucuccuuggccagcugcgggcggcuguggcucuaguggcuccaggggcgcggacccgcggcucgccagcccgccucugaccuuggugcuccgucugaagcccccggcggucuuggcggggugcaaagaggggguggaguucggguuuggugcauggagaagcgguguuugauuugaaacugggaggauuugaggaggaagcgucgagaguagagagaagagcauuccuggcgacucgccugacgguccaggcccugcacgccaagcccugggugggguaucagcguggcggucggugcccaugcccaggaggucuguguguggggucagcgcccgugucugagagcucuucagcccaggagguaggagaaaacggagccugacgaugacaucagcaacagccuggagacagcagcguuggcgagcgugcuuggugugccaggccccgcacagcccuuuguguacaugaucucaccucuuccucccagcagcccaccgggguugcccugguguugcccccaucuguagagaaguuaggcgcggauaagcugacugccuggccugagccggcucagagaggcugggacuggcacucaggcugucagaucccagcugcagacuggcaguguguggggauggcuguguggucaggcaggggcuggaucuugagccuggaggugggauugagcuugccuucccaguuacccuguuuuuugucaguccaguugucacuguccccaccaaggaccuggaguucucucuuuuuuguguuucuucugcuggacaccccccuacacuuccugaagccucuuuagcaucuucuucgucuccagccccuccucagugcccucuuacucagcacacacuccucucugcucaugucuauccaagugugugucuuauggcaccgucagucaugagcaucugucuuuuucuuuagagagggaguucucgcuugcuaggaccacauaguccucauccccacugugcagguuggcugucaauguugucuugacccacagagggagcugucugcaccgaggcaccuaugaggggcauggaggaggccuuaccaccuggggcagagggugccugaggauccagggaagcaaggcuggcugagggcugucuuggcgugaggggccuugggcugagggcuggggcgggggcuacaggaacagcugauaaugacccugaugauccugagggcaguguggagaggguuuggguugguagagacugcaggcaaaggccaggugggaggcgugguggccguggggugaggaguugaagguaggcagagagaagaggcagagugggcuccacaacaagcuggcugugacgugugugcucacugcuggagccacacguagugcaggcaccuguuuguguguguccuuugcgcaggacaggguagaaggcuggagcccaaggugcccccccuuccccuaagugaccggaaggagugauaagugguccacugcaguaggguuggaggaccguggagcccuguacccacuaccuucugggguugagcuggucagcugcuugcuggccuugcagccccaggcaccccuuagaaggacuuguucauucuugaggggaacaaggcuauagacugggacccuggucaugggcugagggcagagccagguaccagggccggugggagcugggggaagaagcagaggaguguggcgugggggucacuugucucugcuuugccccuugauagccuugugacuucgagccaguuguuuggcucucugugccucaguuuccucaucuggggauggagugagucaugcuaaccucccaggcugccgugaggaugcagcgaaugcacaggugugaagcaguagcacacaggaggcccuggaaaugaugaguuucuuucauuagugacugagcagcaggugugugaacucucuaggcacagacacaacaggcacuucugaguggguagaggauccucucuguucugucaggcuaggacuucagggcgggaugcagggucucuuggguuggggauuaggauuggcggauagcuugucuuggccuggaucuggacauccugucuggagcugcugggugcagcaccagggugcugagggugcaugaguccugccugaggcagcaucccaguugcuagugguuaccagcuggaaaccucucaggaaagguggggaggggcccugagaagguaaaugccugugcuggccgugacccuuucaccucagagagugaugguggccagcgcuggcccaucugcaggccccucaccuggugagucagggaucaccuucugugcucuggggcaggcaucaggacuagacagacugccucugcccggcucuuggccugaucacagcguggccagugcugaggugucuuugagaacaggagacacauuugaucuggcccugaccuggccaucggccuuccaucuccagcagcugagugugcaucugccugggaggaggggcuggaccccuuggaucugagaaaaagaccuuucacccuauggccucgccucuccuccugacugugaugugcuggcugcauucuugagccccaucuacuguccccacccacguuccugcccucccucuggagcggguuggggcuguuugggauggccucaacugccucccagccuccacccugggagccggaagggguccaaggccuugggucagaacugcucaggucugaugggcaggggagguugggggggauggcuguggaagcugcaggggcccugcgcauggccugcugcugcggccgagggagccaugugcacguugggguuggguggguggcguagcaggaaggugcuguccuuccuucuuuucucuuuuccuauagcuggguuccccacaagcagcagagccggccagggcuggucuucgugcacuguggggagugugguggggaaacaggagaggcugccauccuucuuugccuccccacagcacacgcuggccugggccagcccuccaggcgucagagccuggcacugaugauggggugcugccagcagaugacagaacgcgaggucuguguucgccugcccgcccgcccgccuuucaggccugccgucugcguggggcuggccgcagggacauuggugcaggagggagugcucuuugaggggcuuucaggacagaagccccaguguuguccuuagguggcccccucagccccauguucagagguggagguggcaaggaaaccuuggugcccagugccacccagcacaccguuuggauucguccuguugccaaggggaggaguggggagggcacccucccuccuguguauucugagguaaaggcagcacucugaugggcaaggagcucagcugcuggaggucacuccuauggcaauagagcuucagugggugggggacccugggaagauguggcaaaaccccccacaucccccuggaggccaagauguggccuggccccggacagcacagagcugaggugcaggcugggaccucagaagggugaggaggagagcugcucacagcugagggcugcagggcccuccauggccugccuuuccaggggccagcuguguucugucauucccuggggcuccggaaggugcccuguacuuccgacugaggaaccuguuugcuuguuggguguggggaggaugguuguguagccgacuguacguguucuacaagcccuaauuagccugugguccgucccagccaagccaacaggugcacuagcagucacuggggugugguggagggaggucgguccuagggucccuguaggccccaggcuggggcagaguuucccaggggagggggugcucugugggcugagaccugaagggccagucuggggcugucauggcacagaggagcucagggagaggugccugcuuggccuggcccacuugggccauugggccagcccaaggagaguggagcucagggcuggcucuuuggaggguagagcccugcagaggacuuaaggcugagugagaguugaugcuucacaagacuagcgggggguggagagggucaagguagauggugaccugccacucugcccauccuccuggggaaggcugccuucccuuccuggccuuggggaggcugcagugcagagacugcugucccuguucauaaaccccucuuccuuccuccaccugcugccucguggcaagaacugggugagcccugggugccagccagggcugggcccagauggugguuuggggccaaacacaaggaggccuuugggggagugggcggggugggggaggagccgcagcucagggccugcgccugagugagcuguccuuggggguguggagguagguguggcacccgcagacaccugggcccccacccgucugccgccuguccucugcagggugucggugggagggggaggggagcaggaagcugagguuuugugagucagaaucggccccucaccgccccaccaucucccacuuagcagcagccugcccacugccgacuuccuuggcucugccccuguaacccuggagggcagauggucuccccgccuguaggggacccguggagugugugccauugggcugccagaguugcucaucuguucccaggaggaccaggcaugcuggauguggggcugcagcuucuugggggccggggugggggguccaugaggggcucuguguugagcaugacccccgccuugcccaucuggcucugcugcuuccgccagguggguggcgguguagaggcccguccagacagaggaugggcccuggggaccugcgguuuguguggaggagaaggcaggcaggcuuucgucuuuccugcugcaccugcuccauccuccacaagcccugggaggccugcggagccguccugcugcgggagccacacccugagugucccacugugguccccaccgggcuuccugguuuggcucuccaggggugagccacaggcagggaccuuuaccccaccgguguggacugggccuggaaacagggcccuggaugugguaguucuggggccccacggagaggaggggucugguggggagacauaggccucuuggcucucccugcccugaaagcccuccuccuggcccaggggagcuuaggcugugcucagcacccauccuauggccuuuguacagggagauuuggagacagggagcaggccugggugugaccaccgucccacucuccucugagagcugcugggguccaggugcucaggaagccaucugggcauccuucgguggucguccuggaccaagucuccauccuucccgucuagcugcugccccucuagguccugcuggcuguggggcugguguucuaacagggagcugccaaaccccaucuucugggaccuguacuggggacuugucugucucugaagcagcugggauagggaagaguuuggggcugugggcgcaggggguguccucuagccuuguggggcugaggcuucuugaaccccacacagacagcagguuugaguccuccacacccccggcuggguccagggcuggugggugacagggagcucugggggaugcccacuguuggggggccgagagccuaagugggggccuggcggugguggcagaugcugugggggccuguggaacagucccgaaguguugaccuucgauggagggcugcugugcugugugaagcugggcuggucaggcugaaggaggucucuggggugggaucggagaaugggguguagcggcaggggcuucucuacccucagguggcccuggggucugcagcugucaagcagacucuccauacggagcuauuuuuagggagcuguggcugaucuggugccagaugagggcccagugggugggaauguuuccacccugggauccucaagccuccugguggguggggggcggguugggugcucugacccccuguucuuguccucagggaguggggaaggccagggccagauucugcagcgcuucccagagaaggacugggaggacaacccauucccccagggcaucgagcuggugaguugggggcgugcugagacggugcuggcagguggggagggcaggugggcacagcccugcccuugucccugacugaggggccuccacagugcccggccccccgcugggcuagggacaagacagcagagccucugucgggggguuugaccggcuuggccggcggccugugcggugcucaugucacugugucauguugucacucacucaugaugguggggacuguucucccaucuccugguccuugccccagguggggaggucagaggcuguuacucccuucacccggagagacugaggcccaggaggccacguguccccagggucuccaagcaaggagcugccuguguguguuggagccuccaggccugguggugcagaugcuggggcgggugggcugguuccugccacagguguagggggaggagcugacugcugagccuucccugcaguuuugccagcccagcggguggcagcugugucccgagaggaauccaccgaccuucuuuguugcuguccucaccgacaucaacuccgagcgccacuacugcgccugcuugaccuucugggagccagcggagccuucacaggucagcuuggggccucuggguacagcaugaaugaagcugcauccuugggccguggccaacucccccugcccccgucucccccugacccccagcaggaaacgacgcgcguggaggaugccacagagagggaggaagagggggaugagggaggccagacccaccugucucccacagcaccugccccaucugcccagcuguuugcaccgaagacgcugguacuggugucgcgacucgaccacacggagguguucagggugaggccggcagccggggcggcgaggcacgacgagggugcuuccaucggcugucccaccacuccccgcucuggucauugcagaacagccuuggccucaucuaugccauccacguggagggccugaaugugugccuggagaacgugauugggaaccugcugacgugcacugugccccuggcugggggcucgcaggugaguuuuggaggcagcugguaucugcacagccacaggcccuccugcuggggcccugguagguauuuggagcccagccagagccacacacagcuggaggccuuggaugcucccucuugcguccucgugccaccauugcccccaacaguccuggccugcuuaccuggcccucgcaccugugcucugggccugugucguucagccucucuguccacuccuuugauggugugugccugucucuggauguugaugucagcuuguuugucugcucccugcccugugccuggguguguuggagugucuaaccgugucuuucugcccgucuguccugugcagcuggacucuguugaggaaggagcgguauggauucuuuguuucuuccgcccaccuaggccccaucccuacccccaagucaaaagcagccacuccuguccugaguuuucucugcagcugcuugggacaacagaggcagggcauggcguuucccucuugccauguugcccaucccagccagucccaccucgggucugucaguacaccagggucugccuggggacacagagcucugggcugacucugggcuggcucuggccaaacuacugagccccgauccuuuuuuugcugcagaggacgaucucuuugggggcuggugaccggcaggucauccagacuccacuggccgacucgcugcccgucagccgcugcagcguggcccugcucuuccgccagcuaggugagccugucugucccacccccgcauggcuuccccucggggacugguaguuagggauguggguucucacucugccugggugggggcccaggguccucuccaagcuucucuucuuccuuuaggcaucaccaacgugcugucuuuguucugugccgcccucacggagcacaagguucucuuccugucccggagcuaccagcggcucgccgaugccuguaggggccuccuggcacugcuguuuccucucagauacaggugaccccugcccggcccucccagccccuucuccuggccccuuugcccagccgcguccccuggcucacugcauccucuggggccugcacagcuucaccuaugugcccauccugccggcucagcugcuggagguccucagcacacccacgcccuucaucauuggggucaacgcggccuuccaggcagagacccaggagcugguaagggcugugcuuuguguccaccucacggcccaggccugcaggucccugacugccggcucccuugguccgcagcucgaugugauuguugcugaucuggauggagggacggucaccauuccugagugugugcacauuccacccuugccagagccacugcagagucagacgcacagugugcugagcauggugaggggcaccaugggcaagcgggagccuugggggccuuugggauguggcuaccuggcagcacggggagccuagagccggggccagcgugcagcugccugcuccauucugugcuggcagguccuggacccggagcuggaguuggcugaccucgccuucccuccgcccacgacauccaccuccucccugaagaugcaggugggggucguugcugcuccugcauggggaccccaggcacuuaggcugcccccacucaggucugcugccacugacacacagggccccacccccaggcuggccccggcuccaguagcagaagcaggagccugggagcaaagcagcugccagcaguuaggagugguggucgugaguggugcaggcgaggcggcaggggcccagcaaggggcuggaacuuggcgucugaucacaggagcccuugagggugcugagccaggagugccuuguccagacaguuucagaggagcugguggcccugagugcagaauggugggaggggcagaaggaugggagcggggcagcuugggguggguugggguguggagaagcuccugggcagccugggguggggauuggcaggacuggcucucaccugcacucagcucuucucccaggacaaggagcugcgcgcggucuuccugcggcuguucgcucagcugcugcagggcuaucgcuggugccugcacgucgugcgcauccacccggagccugucauccgcuuccauaagguggggugccugguggcugggcgugggguaggagauaagcgcaugguggagaccccugagggaccgaccuccuucugucauccaggcagccuuccugggccagcgugggcugguagaggacgauuuccugaugaaggugcuggagggcauggccuuugcuggcuuugugucagagcguggggucccauaccgcccuacggaccuguucgaugaggugcaccuccacccugcccucccagcccccugcccuggcuccgccugaccauggcuuaccuaaccuccugcuuaccccgcuagcugguggcccacgagguggcaaggaugcgggcggaugagaaccacccccagcguguccugcgucacguccaggaacuggcagagcagcucuacaagaacguacgaggguagcaggacgggagggcgucguaccgccuugaucccugggccccugccccacaccugccgucuccccacaggagaacccguacccagccguggcgaugcacaagguacagaggcccggugagagcagccaccugcgacgggugccccgacccuucccccggcuggaugagggcaccgugcaguggaucguggaccaggcugcagccaagaugcagggugcacccccagcugugaaggccgagaggaggaccaccgugcccucagggccccccaugagugcguaaugagggaggggaaggcaggccccgagcguggcccaggaugggcguggggucagggguccgaguguguguauucuguccccgcagcugccauacuggagcggugcagugggcugcaugucaacagcgcccggcggcuggagguugugcgcaacugcaucuccuacguguuugaggggaaaaugcuugaggccaagaaggugagggcugugcaggcuccagccgggccagggcagcggguuucagaggagacccaggcugcacuucacccuugugagugcugacgcugccccagggccuccucugccuaacagacagcuagagguggcugggcuggccggaggguaggugggcuccaggucuccucucuugaccucagugaggggugggucgggccugcgcgggagacccagccagggagauguacuuccauuuuuagaaaucagaagguuucacuauuauguuucgucuguguccuuccccuuaaauuggguaggcccauacacgaccuguucuuuguacuugauggaaaacagagcuugcucccuccauacgugaccuguuccuugcaucuuauggaaacagagcuuuuugcuccugcuguuuugcucucuguggugcucacuuaacgccucuggggucuuucaucauggccaguuggagacucuuguuuuucauuggcuguauggugucccuuuggggcggccaguuuugugaugaacguuguagcaauagaacgcaaacuccaaggcuuucuguggccgggccugugccaggcgagucacugagccagccaggcagcugugagccugugagcaagggggcccggcccgcaaggccucccuccggagcgcaccucccugccagcucacaggugcagcaucugcguccuugugucuggccuggugaacuuguacuuguggaguugucgggcccacuggagguuuuagucuuuauuggucggcaaagccccagagucuggcacaccccaccugaaaggcauuugggucuccuggacaccugcugcccucccugccagggccccgagugggucuucucugugcccucagcccgugucuccuuuccccacccccagcugcucccagccguguugagggcccugaaggggcgagcugcccgccgcugccucgcccaggagcugcaccugcaugugcagcagaaccgugcgguccuggaccaccagcaguuugacuuugucguccguaugaugaacugcugccugcaggugaggccucuuauccugcuagugacauggcucauggcgcaugagcgggaacaggcgggcagacccuggucugugagugagaguggagagacggugcaagagacuccugugccagugggcagggguccucggucugcagggaacaggguggagagaaccauuguugggggcaggugcuggggccuggggucuccugauauugagccucugaggcagccuuggggagcuggagccaagggugucaggugcuggucuguggugguuaugggguggugggggcauggugggaggugagugcugccugggaggggagagguccugacggucucucgcucuaccugcaggacugcacuucucuggacgagcauggcauugcggcggcucugcugccucuggucacagccuucugccgggugagugcuggcauggcugaggucuccuucccagcccccccuuccugguggcugaggucuccuucccagccccccuuccugguggccgaggucuccuucccagccgcccuuccuggcugcauccagcugaccuucuccccuggcuccugcagaagcugagcccgggggugacgcaguuugcauacagcugugugcaggagcacgugguguggagcacgccacaguucugggaggccauguucuauggggaugugcagacucacauccgggcccucuaccuggagcccacggaggaccuggcccccgcccaggugcgcagggacucccugggcugggggcugggggcuaggggcuggggcagcguggccccggcucaugcguguggugccguggcaggagguuggggaggcaccuucccaggaggacgagcgcucugcccuagacguggcuucugagcagcggcgcuuguggccaacucugagucgugagaagcagcaggagcuggugcagaaggaggagagcacgguguucagccaggccauccacuaugccaaccgcaugagcuaccuccuccugccccuggacagcagcaagagccgccuacuucgggagcgugccgggcugggcgaccuggagagcgccagcaacagccuggucaccaacaggugaggcagggacuggggguugggcccaguggaggcggggccguggugggcagggcccaugcccacaguuucuucucuggcccagcauggcuggcaguguggccgagagcuaugacacggagagcggcuucgaggaugcagagaccugcgacguagcuggggcugugguccgcuucaucaaccgcuuuguggacaaggucugcacggagaguggggucaccagcgaccaccucaaggggcugcaugucauggugccagguacggggguuugggcuggugauucccccuuggauggguggggcugggcacaaagugugagaacugucuucccccagacauuguccagaugcacaucgagacccuggaggccgugcagcgggagagccggaggcugccgcccauccagaagguuugcgggggccguuggggcugcgggggcccaaggcccgggcugcauccugagcuccugcucuuguuuucgagcagcccaagcugcugcggccgcgccugcugccgggugaggagugugugcuggacggccugcgcgucuaccugcugccggaugggcgugaggagggcgcggggggcagugcugggggaccagcauugcucccagcugagggcgccgucuuccucaccacguaccgggucaucuucacggggaugcccacggacccccugggugagccugcagacucucuggcccugucgcccccucucccccaggucuuugggauggaugggcuuucccugccucccucucccuuuucucggggguucugggugcccgugggaaacgggccuuugucugcuccuuccccacccacuugggauuccccauaacugugguacccugagauucugggacccccccccccuuaccuuccuugcuucugacucugccuggccuguccuaaguuggggagcagguggugguccgcuccuucccgguggcugcgcugaccaaggagaagcgcaucagcguccagaccccuguggaccagcuccugcaggacgggcuccagcugcgcuccugcacauuccagguggggcgcggugcgcggguggggcucucaucccccgcccuggucuuucuccugcaaaccggucuuucuuguaugaaccauuuuuaggccagucuccagcaguggcccuguuguuacgcuugcaugucuggggcccucacuguggcucuugaguugauguccacuguuugaugugcggucuuuggguccuuguccuuuccuuggggcgccggcccucaaguccgugucuugggugugccuugcaaacccaggccucagcucacagccacugagauuucgaguuuacacaagcgcuugccuucgugugacacagauacaggccuuugccuggggccugcuucucucucugucauggcugcgaggggaaggggagccuggcagugucagaguugggggaggggcuggggggccacccacaccccuaagggcugcuuuuacugacacagcugcugaaaauggccuuugacgaggagguggggucugacagcgccgagcucuuccguaagcagcugcauaagcugcgguacccgccggacaucagggccaccuuugcguucaccuugggcucugcccacacaccuggccggccaccgcgagucaccaaggacaaggguccuucccucagguauggaucugggucccaggcagggcagcugggccucagccguguucccgcuccaacccuccuaggccccugugcucaucuuugucccuccuccucucaccuuugcugacucucgugggccucagaacccugucccggaaccuggucaagaacgccaagaagaccaucgggcggcagcaugucacucgcaagaaguacaacccccccagcugggagcaccggggccagccgcccccugaggaccaggaggacgagaucucagguggagggguggggguggaguccuggguggucucuggaugcugacauuggccagggaggaucagggcaggcggaguggccccgugaugaccacgugugcccggccugugcagugucggaggagcuggagcccagcacgcugaccccguccucagcccugaagcccuccgaccgcaugaccaugagcagccugguggaaagggcuugcugucgcgacuaccagcgccucggucugggcacccugagcagcagccugagccgggccaagucugagcccuuccgcauuucuccggucaaccgcauguaugccaucugccgcaggugagggccggccagggcuggcccgggugguggacacgugacugggugucuucccugcccgcugugggccugggccacggcuucuggucauguaaggaauguggagggggagacuccgggcagagggacgggccacagggcugggggguggcuggggggccccguggcugagcuggaagcgccuccugcugggagccaugggcuggcuccucuugcccugcuuggggcgugagccuggaggcggguggggucgccagccaccuucacgccucugccuccucucagcuacccagggcugcugaucgugccccagaguguccaggacaacgcccugcagcgcgugucccgcugcuaccgccagaaccgcuuccccguggucugcuggcgcagcgggcgguccaaggcggugcugcugcgcucuggaggccugcauggcaaaggugucgucggccucuucaaggcccagaacgcaccuucuccagguaccuccugcguccugcccugugccugcccugcccuaucucacccuccccucccucagcuccguguccucccccaggccagucccaggcggacucgaguagccuggagcaggagaaguaccugcaggcuguggucagcuccaugccccgcuacgccgacgcgucgggacgcaacacgcuuagcggcuucuccucagcccacaugggcagucacggugagggugcuugugggcagacgguggggcaggggcacuuuggggggccgugguggcauuuaugguuuggcaggcaggccagggaggagcagaaacggcgcuggucauggauguuugggugugggaugaggagcaugcccuccgggugccguggggcaggggcgggaagccuguccagaccaagugugugcccagaccaggugugugcccugaccuccugcccgcccugacguccugcccgcucuccaccucugcgucugcugcagcuuccuguaggguccuccgggugcugccucuacgcggcucugucuuaccauuucccacagccuggaaacaucccagaugcuccucuguccuguucccucccagugucacuguuuuuccucaucccccacacuccacccucccugcaucccccaauccagacugucuuuggagccucuggccuggcucugccugcagcuuggccucuguccucguguguccugguuccuugggccuugcccgagcuggccuugcugucucuguccccaccgccacgcacacuucacaggcgcccugcacacacugagcuagacuggccccaggacgggguggcagauaggccccacacucacuccuguguccggaccaccuguucucuaguucagaagugguuuuguuuuuccagauaccacauuauauacuuacauuuuacaaucgcccugucuugcugccuucccaccccugccagaaacccugaguggcauuugcagguggggccgccccugcaccccccaugccugugcuucccacagagucccuuuugcgucuccgaccauccccagugccaguggcugcugccuccccgugucccccucagugcccagcaaugcucaggggcucaagcuucacucagcuguagucguggcuucuagucccagcccugaccuuuuuuuuuuuuuuuuuuugagucggagucuuucucugucacccacgcuggagugcgguggugcgaucucggcucacugcaagcuccaccucccagguucacgccauucuccugccucagccucccgaguagcugggacuacaggugcccgccaccgcgcccggcugauuuuuuuguauuguauuuuuaguagagacaggguuuuaccguguuagccaggaugaucucgaucuccugaccuggugauccgcccgccucggccucccaaagugcugggauuacaggcgugagccacugcgccuggccagcucugaccuuuuuacaaggauacacugggcccugguuggcguccaaagcaggcuggugcugcguccucacugugagcugggcgccugcaguguggcagccgucagaggacacagggcguguugggcuggcauugugcuuggccuguagugaccacuugguggacgaggggacauugccucucucagucccacccucgggccuugcagaagcaggugagccugggcagggccaggcgcccagagacccucuguggaccccaggcaucucccagcccuuugggcugccaguccucccugugccuucaggccacgucgucuggaccguaaaccucagccugggacucagaucugccuguguccuggacugagcugcucuccguccuuuuggacugggcucaggcucugagcccacccucuccccucuucgggaagccuccaggucgccucuucuccaggccacaccucuugggcaccuccuguugcugugcccuggacagaggcgucuacaugcucauguguggagcguucugagcugugcccaucacaagcccuggcccccugaguggaggacaaagggccaggauguggagggagggacucagagacagacuugcucuaagcugguuugagugggaagaaaggaaguguuagaggagagcccgggauccccaccgcauagcccuucugcugccacggagugcucugcggccugcccugcccuggcagagaggcccacaccaggauggcucuucccacuuuccugcgaucagggacuuggggcugaccccugcugucuccaggcucccugggggcuugguggaacccucugaccuguaggcacccccaagcugggcacgcccaggccuggggcuaggccugagccuucucucugcugugcccucaguucccagccccagagccagggucaccacgcuguccaaccccauggcggccucggccuccagacggaccgcaccccgagguaccguaccgagccugcgcaggcccgccuccccuuacuuggugcuggcggccucuagugugcacugaguuauugcgggcacuaaugucucccuccacaccugacacuaacgacccgucucccgagccccaguccuuaccucccugacccgugaguccugcccuagaaacuaacacuggcugccaccccacgucucagaaucuguguguuccagcccuccucucgcacggcccugcugggguccugccaaccaccccugcccugggagcucagcccccucccuggaggccgggcccagccagccccagguaaguggugcccuggcccccuuugggugcuuaccuggcaucuccuucacagguaaguggggcaguguccggaccaguggacgcagcaguggccuuggcaccgaugugggcucccggcuagcuggcagagacgcgcuggccccaccccaggccaacgggggcccucccgacccgggcuuccugcguccgcagcgagcagcccucuauauccuuggggacaaagcccagcucaaggugacuggggugcgggggguggggggugagggugggggcucggcagggggcuuggggccucaugugucucacgggacuuguccggauucuuuucagggugugcggucagacccccugcagcagugggagcuggugcccauugagguauucgaggcacggcaggugaaggcuagcuucaagaagcugcugaaagcaugugucccaggcugccccgcugcugagcccagcccagccuccuuccugcgcucacuggaggacucagaguggcugauccaggucucugcacugccccgucccucugcccgccuuggugcugggcccuccccuuggguagagccaaguggacgggucuagguuugcuugucugacaguguggagcgcuggaaggaggaggugacagccacuucccacccaggcucuggugccuagaaggcagcugggaggcugggccuggcuggggccagcugacagugagaguggccagggcuugggcauggguaugucggagcagccugcugggcccacgugggcugaugaccacacgggggaugcaguuuaugguucugggccccugcugcauucucucggggguggguacugacaggaugcuggcuugguaaacacuggagggcuugaagguagggccaccggcaucuugagggacagggacgucccucaguccuagagggcuuggaagggggugggcugugaccagcaggcuggaggcgguggucggcacacccagagcgagcuguguuuguccagugcucugcccgcauacagggcuuggggggcuguggacagggccugccuccccgcugccuguggacaugcgggucucuggccuggugaguggccaggcgggagggcgguggguccccgaggugcugaggccgccugucccugcagauccacaagcugcugcaggugucugugcuggugguggagcuccuggauucaggcuccuccgugcuggugggccuggaggauggcugggacaucaccacccagguguguggcgcguggggcuggggugggccaggcucccgggcuccucgcugaccuccuggcggugcuggcaggugguauccuuggugcagcugcucucagaccccuucuaccgcacgcuggagggcuuucgccugcugguggagaaggaguggcuguccuucggccaucgcuucagccaccguggagcucacacccuggccgggcagagcagcggcuucacacccgucuuccugcaguuccuggacugcguacaccaggugggcaggccgcugugugggugggccgggacugugcacccugaccgcugagcccuggccccugacccacauggcgugcagguccaccugcaguuccccauggaguuugaguucagccaguucuaccucaaguuccucggcuaccaccaugugucccgccguuuccggaccuuccugcucgacucugacuaugagcgcauugagcuggguauguggggagucggggcuggggcagccacgggucaggaggggcccaggcucagugcugcuucugugcagggcugcuguaugaggagaagggggaacgcaggggccaggugccgugcaggucugugugggaguauguggaccggcugagcaagaggacgccuguguuccacaauuacauguaugcgcccgaggacgcagagguaagcuggggccugggucggguaggcggcuccugcccgacccagguccucaaccacaggcccacccucagguccugcggcccuacagcaacguguccaaccugaaggugugggacuucuacacugaggagacgcuggccgagggcccucccuaugacugggaacuggcccaggggcccccugaacccccagaggaagaacggucugauggaggcgcuccccagagcaggcgccgcgugguguggcccuguuacgacagcugcccgcgggcccagccugacgccaucucacgccugcuggaggugcgugugaucccagagcagggucuggccuggcaccccccuccucucgcucagacaccagggucgugcguguguguguacacucguacaugcacguaaguccgguuaccccuggggguugguguggcccugccgucuccccaccaugugaacugccuacuggccugggguggcuguggcuccccagggccccgcaccacucagugggugcuuccagacagugacaggagggccgucaucagagacccucaggucucaguacacagccuccacucugagcacguguguuuucccugaccuggcuuugagcagcucaggcaccuguugaggagucagcccuuagagacgacaguguuuuacucccucugccagaccgccugccccaccuaacgugagcagcucuggguucuugcccugagagcuugggguugacauugaggccucucuuaccccucacugugccaucccuggugggccuggacugaacaaggcagagaugccugggagggagaaaggagacugcgauugggugguggcuggguugguguguaaggccugaggcaguguccugcgcguggugcuaccuuuuggggccaucccggagucucugugggacugagcaggcagaggaguguggaccuuggaccuaggccacggggggaccugcacucagcuccccacuguuggcuguguggccuuagagguuaucuuuuuuuuuuuauuuugagauggagucucgcucugucgcccaggcuggaguguaguggcgcgaucuccgcucacugcaagcuccgucucccggguucacaccauucuccugccucagccucucgaguagcugggacuacaggugcccaccaccacgcccagcuaauuuuuuguauuuuuaguggagacgggguuuuaccguguuagccaggauggucucgaucuccugaccucgugauccaccugccucggccucccaaagugcugggauuacaggcgugagccaccgugccuggccuaguuaucuaagcaucuuagagcuucugguuccuugugcagaaaguggaaaugcugauuccugccuuacagggaaguugugaggcuuaaaugagucauuuauuucagugacuuagcauggggcacaggguuugggggaguacgggagucaugguuugugauggaggugacccacaaagcacagacagcagucccuuuuucucucuagcgaugcucauugucuuaaaguugacgcggucucauuggugcuaacagagucacucagcuuugucaugaccagugucagcuugcucuguuguuuucuuguauuuuuuacuggucuguguguuuauguuuaaggugaguuucuuguacacagaauguagauguaguugggucuucuuguuauccagucuaauggguuuuuuuaauuggaauuuuuagcccauuuuaauuuacuguuacuauugauguggcuggguuuaagucugucaucuugcucuuuguuuucucuuugucccuuugauuuuuuuuccuuucuuucuuuucuuuuuuuaaaaaacaaguguuuuuaguauucugucuacugugaguugagcuguacaucucuguguuguguuucagggguugcugggggcuauaaucaucugacuugaaauuacaucacccuguugacaccagaagagccuuacggcaguguguguccauucaugccuuuccuguccuguuacugucacacauuuuauuuuuacguaugacauaaacacccaguaugguuuuuuuuuuuuuuuuuuuuuuuuuuuugagagauggagucucccucagucacccaggcuggagagcgguggugcgaucucgguucacugcaaccucugccucugaguucaggugauucuccugucucagccucccaaguagcugggauuagaggcacccaccaucaugcccggcuaaauuuuuuuuguauuuuuaguagagacgggguuucacuguguuggccaggcuagucucaaacuccugaccucaggugauccgcccgccuuggccuugcaaagugcugggauuacaggcgugagccaccgugcccggcccuguuuuuguuuuaaauagucaacuuuguuuuaaggaaauuaagaaagaaggaaaaagucuucuauuuuugccauuuauaacauucuucauucuuucaguauaaucuggucugguuauuauuucucuucagccugaagaauuuuuaauauuucuuguaaugcagagcugccagucacaaauccccucagcuuuuguuuaucugaaaacaucuuggugccuuuauuuugcaaagggcauuuucucuggauaugcauuucuagguugacagcugcuucuuuuuuuuuuuuuuuuuuuuaauucagcaguuaaacugaugucacuuuaaaagaucucauuacuaggcugggcgcagcggcucacgccugucaucccagcacuuugggaggcugaggcagguggauaaccugaggucaggaguucgagaccagccuggcaaauauggugaaaccccgucucuacuaaaauauaaaaaugagcugagcaugguggcgggugccuguaaucccagcuacucaggaggcugaggcaggagaaucgcuucaacccgggagguggaggcugcacugagcugagaucgcgccacugcacugcagccugggcgacaugagugagacucugccucaaaaaaaaaaaaaaaaaagauauuacuuuguuuucuggccuguauuguuucugcuuagaaguugguguugauucuuauccuuauaaacuguguauaauggcacccuuugauucucugccuuaagauuuugcauuuaauuuuggcuucagcaauuugaccauugugguuuuugcuuucguccugcuuggggcucuuuaaacuucugggucugugggaugaucauuuuugucaaauuuaauacauuucaagccauugcuucuauaaauuacuuuuucugcaugaucucucccuuuccuucuggaacuuuauugucccauacguugcugaagcucuguuuguuuuuucucagucuuuaucuuugcaauucauuuuggaugauuucuguuggcuugucuucaaguucacuacucuuuucuuucuuguuuuuaauauacugaagcccaucaaaugaauuuuuuuuuaauuucuugagacagggucuugcucuguugcccaggcuggagugcaguggcacagucauggcucacugcagcccgaaccucccaggcucaaacaaucauccugcuucauucagccucuugaguugccaagacuacuggcgugggccacgugccggcuacuuuuuuuuuuuuuuuuuuuuuuuuuuuguagagauggggucucccuaugucacccaggcaggucucaaacuccugggcucaagcaguccucucaccuuggccuccuaaagugcugggauuacaggcaugagccaccacacccggccccaucuaaugaauuuaacgcuuuuuauuguagagauuccccaucugauaaaccauuauguccaucuuuucuuuuaaaucuugaaacauaacuuaaaaauauauauaaagauggggucuugccauguugcccaagcuguucucacacuccuugggucaagcgauucucccuccucggccucccgaagugcugggcuuacaggcgggagccacugugcccugccuguguugucuuucuuuaagcuuagagucuuggguuuuauucucgcagguagguaaugagcuugugcgucagcuuggucuguuugaagcuuguuucuaagcuuuguuugggcagcucuccagcaccucuagagaagcuccagggauagagcagcccaaggcguguggccucuccagggcuucaguuggaguuuugugucuuugugucuucgguaaggucuugccacacuggcuuuuuggaaguccaguaucuuuuagcauuccucuagaauuuggguucagcucauaguuuuguuuuuuuuuuuuugaggcagagucucacuuugucucccaggcuggagugcaguggcgcacucucggcucacugcagccuccacuucccauguucaagcaauucuccugccucagccucccgaguagcugggauuacaggugcccgccaccaugcccagcuaauuuuuguauuuuuaguagagacaggguuuugccauguuuaccaggcuggucuugaacuccugaccucagguuauccacccgcauuggccucccaaagugcugggauuacaggugugagccacugcugccggcgucaggucauagcuucuuaguagcuguucucugccaggccuugugacaucuugcuuugcacauggcagccuaauuuggccaacgacucaaggagggcucugucuagauuucuagagccccuuugcuguggugcucccuccccucugugggcugcccugcagacccagcugcacuagcgccccuggacgucccgucucugccuccucggcucagcaagcucccguguguugcucuggcccugccucccugcacuguggcugggcagaaaacaggugacuguggggcccaucuuauguggucccaugucuuaggcuccugucucucaagcugcacugcuugucugacaucuggaaacaacggcuuccccuucuuguccaguuucaucauuugcauauggagggagggcuguucagacuaauuaucugucauggcuggaaguugacaguuggccucguguuucucuuuugaagucagccgucaguuuuauuguugcucuuucaaagagagcaugucuuuuuuucuucuggcagguuuugggacuuuucucuuuguuuuucagcaguuuuucugucccauuuugggguguguguguguguguguguguguguguguguuuguguguuuugagacagaaucucacuuugccgcccaggcuggagggcaguggugugaucucggcucacugcaacuuccgcccccugaguuuaagugauucuccugccucagcuuccugaguaguugggauuacuggugccugccacugcguccggcuaauuuuuguauuuuuaguagaguugggguuucaccaucuuggccaggcuggucuugaacuccugaccucgugauccacccgccucggccacccaaagugcugggauuacaggcgugagccaccgcgccuggcccuaaaaucacucucuugaauuuacuguauguucuaacuccuguuucauuucagggucuauuuuaauguuuuucuccauuuuucugcuguucuuuuauuguaagcuggacauuguggacccugcaguguugaagaucaguauuguguggucuuuuuuuuuuuugagaagcaguuuugcucuuguugcccaugcuggugugcaguggcgcguucucggcucaccgcaaccuccgccucccagguucaagcgauucuccuacaggcgugcgccaccaugcugggcuaacuuuuuguauuuuuaguagagaugcgguuucuccauguuugucaggcuggucucaaacuccugaccucaggugaucggccucccaaagugcugggauuacaggcgugagccaccacgccuggccgggguguguguuuuuaacuuacccuguuggggucuguagugcuucuugauuauguuguuugaugccucugguuaguuugggaaauuuuucaacuguugucuccgaauauucauuuugcauauuccuucccucccucuugccaccucccccuguggccagucacacacgcguuaggccuuuccguugugucucuuuccuguguuuuccuuuugucuuuucgugcucuagucuggauauuuccuuuugaauaaacuugccauuaauucuucccccaggagcugcagaggcuggagacagaguugggccaacccgcugagcgcuggaaggacaccugggaccgggugaaggcugcacagcgccucgagggccggccagacggccgugugagugagggccagugugagcguccacggugggcguguugcugggagaaaguggagucuguccagcccugacccaagucccaaccuccuguucccagggcaccccuagcucccuccuuguguccaccgcaccccaccaccgucgcucgcuggguguguaccugcaggaggggcccgugggcuccacccugagccucagccuggacagcgaccagaguaguggcucaaccacauccggcucccgucaggcugcccgccgcagcaccagcacccuguacagccaguuccagacagcagagagugagaacagguaugagggcaccucccacugccacauggacaccucugagcugguguucuggggucccaggcaguccucuggugggagauugcgggugcuuuugaggagcuugcuuaaguauacaccaccacugggagggguuuggggugucgaacuggugaccacagcugaccacagccugcaguggcugagggaggaguagagagagggcagugguggggcccccgugagucuggagucuggcaggauccaucccaggcagcugcugccguggcugcuucuacagaucuaccugccuggccaucccucuccucguaagggcgccugcccuguguagggggcugcuuucccaagacccugaggcucugguguggggaugcucccuggagucuggagggugugaggcgcccuucacugucuccuuucugggcgucgucuucuugggccugcagccccccaucaaaggcuucuuuguggcccccuggccagugcucugggcuuaggucaguucuggggacagggugccuggucuuaccuccugggcugggacagcaagggggggacgacugcuggggccugggcuuggcugggccaugacggucagccuggcccugguucugcuggaaaugcagguccuacgagggcacucuguacaagaagggggccuucaugaagccuuggaaggcccgcugguucgugcuggacaagaccaagcaccaggugagugaucagguggugggggggacucacgggggagggggcuccgcugacucuguggccuccuccagcugcgcuacuacgaccaccguguggacacagagugcaagggugucaucgacuuggcggagguggaggcuguggcaccuggcacgcccacuaugggugccccuaagacuguggacgagaaggccuucuuugacgugagccuuggccggggcuugggagaggggaggggcucugcggugugggggcugcggagucaguaacccgcccuuccccaggugaagacaacgcgucgcguuuacaacuucugugcccaggacgugcccucggcccagcaguggguggaccggauccagagcugccugucggacgccugagccucccagcccugcccggcugcucugcuuccggucguuaccgaccacuaggggugggcagggccgccccggccauguuuacagccccggcccucgacaguauugaggccccgagcccccagcacuuguguguacagcccccguccccgccccgccccgcccggccggcccuaacuuauuuuggcgucacagcugagcaccgugccgggagguggccaagguacagcccgcaaugggccuguaaauaguccggccccgucagcgugugcugguccagccagcggcugcaggcgaguuucuagaaccagagucuauauaaagagagaacuaacgccacgcuccugugccugccuuccccacuccccggcugccugcucucggccuacccagagggucccaucugccccuauccaggcccaccuggcgggagguuggcaucuuucucgugagccucuccuggugccuggguccacccagcucggccugcaugucccugggagugacuuugcucugggggcggaucgagcaggaggcuucacuggggacuugcuugauucccuccacgccucagggcuggucuaggggccggcacggcuggagaggaagcccccaucccuacccaggggaugcagaagcugaccucaca

SEQ ID NO: 17907 - RNA, 1987 nt, Homo sapiens
caggaacagcccaggcacaaggccgggcuucagucugacuggaccagcagcggaggggccacuucuggccaguucagccucucuccccugcucguccagacauggccccguguguucagggcccagcuucugcuccacaucucugggcagacaccuccucucugaagcgcuuagcaucuggugcugccgccagcugugucuggcagcugucccccagggggucacaauuucaggguguuuaggcuccuugacguaccagcacugcguguagaccagccuagguuuacgugugcaaagccgugcagguauuguugcugcaggaccugcugucugcagcuccgagggacugggcuucagauggggcucagcugcagcucuggacgggggcacagcacccuggcugggaugggcagggguguggcccggccccaccucagccauagcugugggggcugcugggguccacaggagcugaguccugccggccggccggucccaugaguugccacaggcgguggcugagauucugcaccuggcaggugcccagcacacagcccacucgcaggagcugggcuuggguccugcgggggcccgagugucuucgggggcccgaguguuggcggccaccaucccggagaggcugacccauaacaggggccaggccggcaccccucugugccuggagggcccggugaagcuuccagaccacaggucggggugcggggugccugggcugcaggcugcuggaagggcuccgggcugggggcucccugcagaggcagauggagaaugucaaccagauggcucagccuuuuggagaacucacaccugcccacuuuugccucuacacaggccugggucacugccaggggaagcccacagcccccauccacacacagccuggagcacggccaggggaagcccgcguccccucugggcuugggccugggaccaucucaguggcccgggucacgugucccgggaaccggcaccuccuuggccaaagggcaccccggcggcccagccucugcgggucaccacucucagggcucagggugacucggcuucugcccucccuuuaggguggucacaggccggccagggauaccgccagccuccccucccccagcagacacccccagaagaggggcugcugugcccauguguguggggaggagcaacugcccuguguagggaggcagagaaagaggggccucuggcccugcucaggcgcuccugagccugggguaggggccuuuguuugggaggggaguccuagcagcagguggaggcguggagggagggcggccccgcggcccccggcacucugcuucccugcgggggccagagggguuggcuggcccaagaccuggacucaccuggguuugacgggucgcggguccccgcccaggcugcgggacagcgagccagggagcugcaggcagaggaggcugaugcaacccagggcggccgucgggauccgggccauggcgggcggggcugcaggggagggggcggugagccgggcacgucgggggcagccugagccgcgagccacccccuccgccggcaccucggggaguccuccgcggucggggcgccgggcgugggcguggcaagcugggcacgggcguccgucggggcgcaggccucgggcgcgaagcgggcagcgggucuggggucggccgcggguccggggcgcaaggcggagcgggcugggcggguuggggguccugccuggagcggagucgcggcccgggauggcaccuccagggcugaauacguagccuuuccagcaaggggcggagccggaugcacggacggggcggggcgccccuccuccgggcccagccacccucggggcggggagggggcugcggcgaagggagcgguggaggggccuguccccgcugggagcgcucggcgaccggcccgggaccgcgggaccgccagccucacuccaagcgccuucugguggggacgcagc

SEQ ID NO: 17908 - RNA, 3280 nt, Homo sapiens
cacgcccugcugcaguaacacccaguggggcuucagaagcacaacauccuuccaggucuuuauugacgccaggcacaaguugccgugagggguggcgacccuaagggggugaguggggucccccaccgaggugaacccugauggcggcuguuugcccagggccaggccucuccaggcaggcggagggccaggccuagguccagcagcagcuuggguggcaggagggucaccagcucaggaugccagggcaguacuugucaaugagccccugguaguagggccgcagcuuguccacguccggcagguccgggcacuugguguagaggucgaacuugcugcagcagggaggggcggugagccccgugaagaacccccaggccccccacccaacccccucuuucacucccacaacaccccucggcggguagcggggcguacuugaacucccgcacccagggcagcauggccagguccugcuggcugcacagcugcugguagucgcggcccgugugccagggguagaaggaguggaaccggaucauguagaaagccugcgggcaaggccacccagcggcucacuuggggcugcaggaccgggccugguggacgggcugcguugccccuccccccaccuaccucagggggcagugagaacuuguuaaacuucaucaccugguacauguacucuguggggagagggugucaccagcaggcacugccucugccccaccgccccccaccgucccccaccgccccccaccgccccacugcccgccucuggccucaccaucauggccccaggacaugaggacccugucgagcccacaguggggcugauacaucccgagcucugugcugcagugagauaccagggugaggagggcucagcagccgcccagggaagggggcccagcccucagcagcagggagcaccuguaucgaggauccuggaggucaggguuguccuggaagguggagucgcagaaaaccacggaggccugcggacggcauccgacggggaaggugucgccgacgacagcccacugcagagggacaggagggacgggaggccauggggggagugggggaaggugucgccgaugaccacccacugcagaaggacaggagggacgggcggccauggggggagugggggaaggugucaccgaugacugcccacugcagagggacaggagggacgggcggccauggggggagugggggaagauguugccgaugacugcccacugcagagggacaggagggaugggagggacgggagggacaggagggacgggagggaugggagggacaggagggacaggagggacaggcagccauggggggccgugggggaagugggggaaggugucgccgacgaccgcccacugcagagugacaggagggacaggcggccauggggggccguggggggaguggugcggggaggccguggggggugcacuggccugucccccagguaguaucccaggccaagcaccgaggccaccagagggacaggcagccguggggggggccguggggggugcacuggccugucccccagguaguaucccaggccaagcaccgaggccaccagagggacaggcagccgucggggggccguggggggugcacuggccugucccccagguaguaucccaggccaagcaccaaggccacuccacccccaccuugccucaacaugcagccuccucacccuccacuuccaacucuuaccuggggcuccccgaacagggccaggaccuuccccaggucgugcaggagcccgacgagguggaaccagucugggagggggauggacagggcagguuggggacugcaggggccaaggcagaggaugagcagguuugcggggcugagagccaggaaggguccagggccugcuccccaacccaggcagggcugcuggaggaggccugggcccacuacuguccccucccacccuacaggcugcugcauucugccccuuggaggcagcaccugccccccugcagcacagccagggcucacccuugucugggugggccuuccggaugcccuccgcugucuggaaggcauggaaggaguuggggaaaucuacguccggguccgacucauccaccagcccauccagcagguccacggccuccaugacugucauuuucuuguaggagaagcccccaaacugggcaugcuggcggggaaggagaaggcaguguggcccagggucagcaggcccaccacacaggccucuccauccccucggcgccuggugggcucauggggcugagggcaagggucccuccgcguuugcacggggcggcaggaaacgccuaccuugcuccugacgaaguccacugucuggugcgugugcaugagcuuguagguggugaagacacgguccaggaggggaccugacugcaggccggagggucaguggcgccacccccacccugcacacgaggccccaugccuccccucucccaggcagccccacagggugugaugggggugggaguucccacagggcacccccuggaacugugugaagggcaagugcugcuccccaggguguggaugggggagaaggggggcaggacggcaagguacucaccguguaguuccggaagcuggccuugucuuuggccaccucuggguccacaucaggucgguagaccagggaagggucugggcccuggguagguggaggauugaaccuauuucaccaucaugucagcuccacgaggaagcacagacauucccaggguggcugcagacuccaagccugccucugcucgagggcuggugggugacacgcgaggacacagccucucccacgccaucaucccagccccugcccuggccucagcgagucccaggagcucucacucccagguccucaucugcaaagcgaaagucagcagacgucugcuuccgggguacaggggacaccacgccugagcggcacccauggccacccuugagggguggaaguggcuuugggaggagacugaguccacagggagccugggggucggcagccgcuggcucuugcccagcuggacggaggaggagggcuggccagugccagcuagaagagggcgggaguggcuggccaccaggagagcagucagcagagccucucugcauggggucuggguacucaccaccgucaccuucauccugagagggagcggcgcucagguggcaaagcacaggcuggcgaguguguccucagccaggcuccuauauacaccccagguuacauaaguguccg

SEQ ID NO: 17909 - RNA, 2836 nt, Homo sapiens
gggccgcugagcgcggggccgucccggugcacgcggagccagggggucccugcagagcgaggggcuguuagaggccgcgcggccggagcugggcgggggugcggggccagcagggcgggggcggcgcucaccacggcgcagccucugacccacgucgaccagcagcucugcgcccacccccaggcggagcggcuccccagcgcggcugcgcccggccccgagcucgugcagcaccagcgccagcggcagcgcccggaccagcuccacggugccugcggggagaggggcugagaggcgcgggcucgggaaggggcggggccucgggaagggaaggggauggcggaggcggaaggacggggacucccccgacgcucaccaucugcgggcgccagcagcuccuccugcucccgggcgcgaggcagcagcugccggcguucugcgggacuucccgagcacagggcucgggccagaccgggauccacgcccugcgccgccagcauccgcucgaagcggccaagggccgagccgucguccagcgccgcggccacccgggcagcgcccugggccugaguccccgcguguccgcugagccagagcagggcgcccccugcgggcggggacgggucuuaggcgcggccgggucggggcggccccagcgggaagcaccccccgccgccuccgcuccccuacaccccgucccccucaccgagcguggugaccaggucccuuaagucuggcgggccugcgccguccaugcagagcagcgccuccuccaccuccagggcguggcccacgcagcgacccaggggcuuguccauggcggucagcgcugccgcgacccgaagcccuaggcuggcucccacgccaaccugcggagaggaggcucagcguggaccccccauggcggggccuucugcagccgguucuuggucgaacuccagccccugcugcacccuggguugccagccccccagcaugaagucagggaaggauugggguggggaagagacacgagugaagugcgacaccucgccauggggccaggaggaacuuguacuuggucuggggcaggaacgccacagagggcuuccccagguccaggccgggccagccuugaccucuaaagucacagcagguuaggaagccgugaaggagggagggacuucgggcagaagagggugggacugggguuaggcaggacugcugaguggagggaggcaguggggacgggaggggugaaggguaggcugggcccgcaucaagacgcuugcccagggaaaggccacaccgcucaccagcgucuuugccagcucccgggccugcuccugguuggggaagacggcggccccuccgaacuuaacguccaccaccagagcggacagccccuccacgaguuucuuacugagaauggaggcuuugggggaggcagaggagguuggagacaauggagaaccuggagcuucuugggagaguucggggaugccgacuuuggggucaggggcccugagcauugagggucaagucccuuauuauggggguggcagcaccugguggguugaguaucaggccaccccacauggugguggucaggcaucuugugauggggguaggggggcacacggucaggugacggguaacuccuaacgagaggcccuugacuugaguuuggaggucaggagccugugaacaugcagaagcaggccauggagucaggucaccugugaugaguggcaggcuguccacgguggcugucacaucucuggcugcauauaggauuccguccgcaggaaccagcugcucacucugacccacgauacagcagcccgccugguccagcagcacuugcaucuggucagacauccccuguucucagugacuuaugguaaaugacuuagcagcuuuuuuuuuuuuuuuuuuuuuuucugugaagagucuuccucuguugcccaggcuggagugcaguuggcacaauuucggcucauugugaccucugccuccugggcuuaagugauccucccaccucagcuucccaguagcugggacuacaggugcgcaccaccacacgcggcuuuuuuuuuucuucuuuuuuuuguagagaucaaguuucacuauauuacccaggcugaucuccaacugggcuccucugccucccagagugcugggacagggucucacucuguugcccaggcuggagugcaguggcaucgucccggcucacugcagccuagaccucccaggcucaagugauccuccugccucagccuccugaguagcuggaaccacaugcgugcaccaccacacgcagcgaacuauuuuguagagaugggguuuugccguguuauccaggcugguuuugaacuccuggguucaagggaucugcccucuucggccuccccaagugcuaggacuacaggugugagccaccgugccccgccagccaucugugauuuugaccaacuucccauuuuaugauccuaaucaaaguuccacugaugauuucggcccaggcccagugacucaugaguaaccuugaccaguguucucauuagugacccuaaugauccaccagugaucuuuuagugauucuggccagggucuccaucaucaaccuggauuaaugacugauccguggcgccccguaccugcucugggcucuggaugacauugaauccaggaauagacuccagcuuauccaaggugccuccugugugccccagaccacguccgcugaucauuggcaccugguggucagggaugcugaguacccugcacaguaccccucccccaccucugugcaucccuucaccuucccuggcuaggagugcagcuggauuug

SEQ ID NO: 17910 - RNA, 983 nt, Homo sapiens
ugaaacuauguugcucuuaucaucacaaaagaauaggagagaaggugggguuaugcagcucacaaugaaggcccugacaugagccacaagauuaaauugguguuagaggaagucuccuaucuuuuuacucagacgggaaauugagagagugacaugacacuaagucaaaaagucaaagguugagaauccaaauaaacugacaaaaaugucaacucacaauccuagaccauuaacauagucauuugggaucucaccuguauuuuuggaauacccauauuuguauuuaauccacacuuguauuauuuaugucaaauaaagucacaguaucauuuuccacaccuacauagaagcagcugguuuuuuuuuugcuuuuuguuuuuuguuuuuuguuuuugauggagucucacucugucgcccaagcuggggagaggcaguuguuuuuauaccuugcaugggaauacucugaauaacuugacaaagcaacauaauacuuggaaauuucacacaugguuucagcuagauaaacaccaccuagacacuagcagaaaggaucagggacagauuagaauguuuuugugaauagccagaucaaaucuagugugugcuuucuuuaaauuauuaaaccagaaguaagaaauugaccccaauuugagcaauauaaaaaagaagcugcaaauagccagcuaaaauucagcccacaauagaaaugaaacagauuaucaagucacagaagaaacuccaaacacucuuuaguuuucaaaugauagaucuauuagcagaccucccuccuaggcaacuucuccggacuauauauuauacucugaaucacauauuuuucucuugacauuuuagugucauaagaggggguaaauuaaaacuugaacuaccugcauaauggauuuuuguucugguaauuaagauagcagcuggaguuuugacuucuauugacauguuuaggaagagaaagaaaaaugauccuugac

SEQ ID NO: 17911 - RNA, 517 nt, Homo sapiens
caaacaaugcauucaaaccuggcugggaagaucacgggaaugcugcuggagaucgacaacucugagcugcugcacguguuagagucccccgagucucuccgcuccaagguggaugaagcuguagcaguucuacaggcucaucaugccaagaaagaagcugcccagaaggugggcgcuguugcugcugcuaccacucagacaaggaaaaaccgauucaaaagccaaauaaccccucauggaauucagcucaaggcuugaagucuuccuagcuuguccuauggaccucaacaccaagaacuacaaauugcaaauuuaauaggucauuuuguaucaaaaggucaauugugaagcgccuagaauuuuucaaugauacgaauauguucucuggguucugcuguggcccagacaguguuaacuuuuuuuuuucuauuguggguuuugauuuuuuccccccagaaauugguuucauuugauuacccaagucuuacguuucucaauaaagaaaaaaaaucuccau

SEQ ID NO: 17912 - RNA, 510 nt, Homo sapiens
ccuaugucuuuuuuuuuuugaaggcaauuuuauaacuuuauuugauguauuugacgaucagcgauuaguucucauccacauugacuguagauuuucaaaaguggcaacagguacauagguaaccaaaguauagagcuuauuuggugaaucuucauccucauuacguuuucgggacagccgcacacggauucgguaugggacauucuuauuccuuuggcccagacagcuuuguugagccugauaucaaugcgcgcaucuggaguucccaucuccuucaugccaaauuuccgaagcucuuugagugcccgaggggcacacuucuugaagcccacuccauggaugugcuugugaauguugaugguguauucucgggucaccaccucguugauggcagaacggcccuuuuauucuugccacccuucuuugcgggagccauucugccggguccaaguuggaaaggaagagcgcgagggauugagggagaaggaaagccgagaaucuaugucauuu

SEQ ID NO: 17913 - RNA, 814 nt, Homo sapiens
gccuugagccauagaucucacaaguuccauaugcacccauugcaagacccaaaggaaugcacaauucacccugagaaaagaguuaguacaggaagcccauccgcaguggaaaaugaucaaggugaacugaauauauaaauacugagaugacacagaauauauuuucaaagucucuuuaugagucaggaaagauaaaauaccaccaaaauuuaugaaauaaugaaacuuuaagaaaggauagaaaaauaaaugaaaaaagaaauguucaacgaauggaagacauaggaagaaaaaacgucaguauaauuaugcccaggauagguacugaucaauaauucuaaagaaauuuccaguuuccuugugaaauccucccuaagggugaaucagauuuucuuuuuuaucuucuucacaaugcaccgaaauguguaagucagugauugagagguagcuaauuaaaaugcacugggaaaaaucaaaaagcugugcagcuugccacuggaguuuucaguaggaguaaagaugcccagauuugaaacaaaucauuuuagagaaaagaaggguuauuuucugcaauaaauccccaucaggauggauuuucacucguuccagccacggugauggauggugcucucugggcuggcuguguggauuggauuuggaugggccaccaaaagugcagaugcuuaucugaaacuuaucugaacaagccaaaucucagaggucugcaaaauuaugcuggcauuccuucaagauuagucucucuugugagauggcuggccuuggggacuuggcucuauguccagugaggauggau

SEQ ID NO: 17914 - RNA, 814 nt, Homo sapiens
auccauccucacuggacauagagccaaguccccaaggccagccaucucacaagagagacuaaucuugaaggaaugccagcauaauuuugcagaccucugagauuuggcuuguucagauaaguuucagauaagcaucugcacuuuugguggcccauccaaauccaauccacacagccagcccagagagcaccauccaucaccguggcuggaacgagugaaaauccauccugauggggauuuauugcagaaaauaacccuucuuuucucuaaaaugauuuguuucaaaucugggcaucuuuacuccuacugaaaacuccaguggcaagcugcacagcuuuuugauuuuucccagugcauuuuaauuagcuaccucucaaucacugacuuacacauuucggugcauugugaagaagauaaaaaagaaaaucugauucacccuuagggaggauuucacaaggaaacuggaaauuucuuuagaauuauugaucaguaccuauccugggcauaauuauacugacguuuuuucuuccuaugucuuccauucguugaacauuucuuuuuucauuuauuuuucuauccuuucuuaaaguuucauuauuucauaaauuuuggugguauuuuaucuuuccugacucauaaagagacuuugaaaauauauucugugucaucucaguauuuauauauucaguucaccuugaucauuuuccacugcggaugggcuuccuguacuaacucuuuucucagggugaauugugcauuccuuugggucuugcaaugggugcauauggaacuugugagaucuauggcucaaggc

SEQ ID NO: 17915 - RNA, 12653 nt, Homo sapiens
auacacaacuuaaagagaaaaaauuuuuauugugauauaaaaugcacuuauaaaauguccaccagaaggcauguaauucuucacugcuauauaaauuuacugggaauauguuauucaccaucuagguaugauacugccaacuaaaacauacuguaaacgaugaguuauacucuauaacaaaugcaucacugauuuucagcaaucauugguuuaauaauaauuaguuuaagacuauaaucacaucuauauucuggaauguccauuuacuuuaauguaguguaguggaauuuagaguauaauugcacauagaugguacagaaaaacauucacuucuaaauuauuuuauaccuucaugacagguagucuuccugacugaaaauaacagcuucagcuauggucugcuccaggauucuuaaugcaauaauuuggguguaugugugucugucuacguguacacccauggaacaacuuauaucuuuaguaaacaagugcaacauuauugucaguuauuuugcauguuuaaauauuauagucugauuauuuguaaacaaacaaaaccccaaauacucuaaauucuauuuuaaaaaucugucaacccacaauuauucuaauaugcuuuacuuacucgaacacaaauuucugaaaggugcauauauuaccuuagauaauaagguuuagaaaugagugcuucacacuaugaaaugugcauuuccgauaagugauuuaugcagcauaaaguuuagaucaagaaauuacaaauccuggauccccacaguucauuuagaaaaugccucaaaguuauggcucuugcagcagguuuaacagauuaaacauuaaguguucuagcucccucuauuucaaguaucaaagaaauaugaggcucaaaaucucucuagguuguaacugauaaugcaaagcauuagaaaacaguuaaauguguuuugaaauacaguauuaacugagauuauuaagguguuuaucuacguuagccuguuaaguaccaggacuuuaaaguaauuuuaaaucugaguauuugcucggaagugauaaagaacacaauuugcccauaaauguaugguuuuggagaaaaaagucaauccugauuuuuaaaacucaacauuuuuuguuuccuuuugaaugauauuaauuuaaauuucaaucugaacauaaauguuuggccucacagagcauuagaaagauaauuuacuaaggcuguuuaaagucuuucaaugucaucagaaauccugcaguauagaaaauaucugguacccuuaaaguuucagagugagcugaucugcaauuuuaaugcuauuaaaaaaaagucaaauauaaaagacugcugcaauauaaagcacuauuucuaaaaguugcagacaugauccuacagucugacagagcuagcacagcuacucggaguaagcaacuugcggccuuuuccaaggcacacuaaguuuccagcuuagaaaauacucuagccugguccuuaacauauucauuaaguaauaugaauauuuuaaggucuuucugucccacaagaaaguaguaaguuuacccuuugagacaucagacuuucuagaacuggcccaacuguauaaaauuuuaagaaguauuugaaguguggaaucaacgcuaugaaaacagugugacaaaauuaaacauuauguugaacccuuuucuagcuuuaacucaaaaauagaaaucaugagucuucuauaacauuaauuuuaaaaacacacagaagugaaaagugcuauuuuccaaaaaguacaauuuuuuucccuacuuuauaucaacauggaaugauuucaguucuccuguacuaaaagcuggacuuuuaaaaaacuaguauuacaauguuuaaugugaugacuuuaaucaguaguagcuucaguuuccgcugggccccuaauuagucuucgaauuccucuuuuuccugcaggaccuuuugguuuugcaaaacuuugcuugugugcaugcugcuugggauguacuucuucauaaaggaagucugcagucaacucauccccauugucuaucucgaucuguaaaagauaaaauuagaagcacaacauucaaaaccuaauacaagcaacaagcugguuuucagguauaugaaugcucacaaauaauacccuuuccaguaaggcagaaucaaggaccauauguaaacaguuucacuuucuucuuuugggggaaggggcuaaaugaguuacuugaauauauaaucagcuacauucacuuccuucuugguucuuucuuagugcuccaguuuaaauaauguuuaaaaguagaagccaccacuacauucucaaguugcuaugauacacuauuuauucaaggaacauuuacucaugacccuuucaucacuugggucacuugaaagcccucuacaagagagguaaacaaaccauggcccgaaggccaaaucuugcccaagguaagauuguuuuacauuuuuuaaggguuguuaaacaacaauaagaauauaugacagagauuauauguggcuuggcaaagccuuuacuuacuauuugguccucuguagaaagucagcugaucccugcuauagaaggugcuacccaugauaaagugauugauucuuaggaacuuaaaaagcaugaaggguucagaaccuaaaaacacugguaguuuuuaaggaccuguauuuuuaugaguuuaagggcucaagaauauauaucuuuccccaugccuuaucuguacuuaagaaaauuuaagaaaauugguagcuuaguucccaaaauucaaauguuuaugcuuauuccuuccuucccccaaacuggaaagacucccaaccaucccauaauucagucauaauggagacuguaauuccuuauuaauaugcaguagaaauaaucacaaguaugcagcucuggcagcgcuguccaauaggacuuuuugcacugauggaaauguccuauaaauucugcacuaaccaauacgguagccaguagccacauuuagcuaaugagaauuugacauaaggcuaguggaauuaagaaacagaacuuuaaaucuuauuuaaaguuaaauagccacauguggcuuacuaggaaguacagauauauauagagauggggaucaugacagguaguucccaggcacuuagaggagauccuaaggauuuaggaugauaacaagaaaaauaaauauuuucauuuauaaaucacaguacaucauaaacuacauagaaaugaaaagaaaaauuuagcaaaaacugaagauuuuaaaauaggugggcuaccuuucuaauuacauccauuuguaguugucuuucuacaauuucuagcagacggcucuugcagcuagaauacagcauccgcucucuuauacugcauguguauccaggcauugaauaaauaaaaacuguaaguucaaauaauaacaaauauaauuagcauaucaauacauaaacuucauaaaacuacauauauaaacuucauaaaaacaaguacagaaacuucauaaaacuacagcuaagcccucugggcaagaaauaaguaagaauauagggcugauacaccaauaaacaaacugaaaguaauguguuaaaaacaauguaucauauaccuauggacucuaaauagucuccuucaugggaauguuuauacagaaagaaaugguaacgagcugaauccuugggaauccucuuuggcaaaucuuucaguucuguauuuguuguguuggccaaaauuauaauuucauuuuuuauaucuauuuccugccaauaagaaacaaaauauguucauuaaaaccagauauaaggaaauuaaguuaaaacauauaauaaaaagaccaagagauaaaggaggaacuuaguucuggaugguuugacuuuuucacaaugaacauuuacaaaaugaauuuuagaaaucagaaagcuauuuaaaauguaaaauccauuaauaauaaacccuauaugagucauaaacuaccaaaaagagcagccacuuaauaaucauuauacaucucuuaccaacugcacauaguugagcugucuauuauucaauuuuuccaaagccugaaaggcuucucgagaaaugggaaaugcuacuccuuguaguguuugaugcuuaguguccacacccacgucagucuguaccuaaguaugacagauuuaauuuacaaguuuagcaguuagcaguauccuauggcaaacauaagaaaacccaaccucuauaaaauaguaucauucaacccuagcccaaccuauaauuaaaauuauuuuucacauuuguuuacgguccugcuagcauuuugucaacaugcagagugcaugacacaucuuuacgacaauguuggaagugaacauuugaaugaguguacaguuagugggguuuggguggguuuguuuuuauguuugguuuggcacaauuucuuuagagugucaucagauuacaccacugauuguaaaauuuuacuugauagaauuuauaaacaacaaucuacauacaauauguauagaacuuuacuuuguucuguuggacagaaaaugcaacacaaacaucaugcacugaauugaaaggaguacaaacaguguacaaagacaacacagcucaacaaguuauacuacugcagaaguuccagacuuaagagauuucuuuacuaagaacauggugugcauguacuggaagaggagaaagauaagaaagcauucaaugcacauguuuaagauuuuuauacuugauaaaugauagcuaguagagagucucauucgcaguguugcaacagaaaguccaauagaaauuuuacuuuuaaaaaaaugaauggagauucuacagcauaaaugauauugguuaaugaaaacaucauagaacauaugcgaaugcauaccccaauaugauccucugggcucugauugcaagaaauaaaacaaacuaucaaacucguaaaaaaaaaaaaaaaucacauaaaaagcccuacucaaauaauaugaauuaaaauaauaugauagauccuugcuaccaguuuaauauuaaaugauauucaaccauucuccagacugauuccuacugucugugacucaggcuaaugaacagugguuucagcuaaugaauagugguuucagccacuuguucuuuucuguaaagucccaguagaaauacaguaguuauuccaguauguuagaauggcuguagaaaacacauuaaaaauaaugauaaacuacaaaauaauauggcugaaauuuauugacucuaauaugcucaacagguacucaaauaauaaucuuccauauauaucucuauucaaguagaguucauagaaguuaauuuguagacucucuagaaagccaacaaaacaauaaucugcuucaggcaaccuuauuagauacauucuuugcacuaaauggguaacacacacuuuuucucuauauaauauucaaaguacaaaguucacaacaguuguacuucaaaaggaagauuuacuauucugacaugaagauuauaggaaaagcuauuuauaaaaugcauauaaaguuuaauauucauuuuaacuuuuuuuuucugaaaaggcauuaagcacauagccuuaucucuaaacuaaacggaauaaaccuaagcuaccuaacuucuuuaaucucuaguuauccucccacaucuauuaauuaaaaauacaguauuuucaaacacuuaaaaucuugcaaagacuuuguaguuguaacuuaccucauugauuuuaaucugucguaguucuuccucagcugcagucaguggggcaggggaagauugugacagcaaguauuuuuuauauccauguaaugauacaucuuccuguaaguacagaauagacuauaaucaguaauucucuagaaguaaaaugacagugaaguuacuuuaggaaaaacaaaaucauuaacagaaaagauuuuaaaugaaaauaaauagcauuaugaauuuuaauaucuuuuuacuuuucuuuaauccucaauuuuaaguuucaaaacuuuuuaaggggaguacccacuguucauuuuauaugaagcuuuauaauuacuaaauauuuuguaugaguuucauacuggcaaagugaaauacugaaccuggucauccuguaagucuauaggacaacuguaauuaaccuucuggagaaaacugcccaaugauuauccaauaaucaacauauucagauucugaauacuauguuauaaugcuuaauauaauuucuuuguaauuauucauggaaaauuauuauaguuuucaugucaaaagaaaaaaauacuacaaagaggucuaccuaucaucaaaauuuugugguuuagaagacugagacucaugaaauuaagaaaccagcccacuucacaauuaauggugaagaagcaauauauucccaucuagucuugugcucuauccacuagauuauaugacuuucugaaucagaaaagcucuaaacaaacaaaaaaguucaaaaauauauuucaguguuucaauuuguguauauauguguaaauacauauauuuaccauauacuuuagaagaaucaguauguuucaauaucacuugucaaugucaaauagauacaaaugaauaaacucaaaguuacauauucauuacagcuaacuuuaauauuauaugaaauacaguauuucucuuauucucauguuuucagauuauccaucugaauucguaucaauuacccauuaccuaggaguuccucuuuaaucauuuuaauugcaacauauagaauccacauacaaacauaauaccuuuacuguuccaaauacuucaucuuuaauguggccaccuccaaauuccuucuucagaguugcucuuguugcugcauacaacauuuuuugacgaaccuauucaguugugaaaguuuacuuaguuuauagaugaaaacauaacauuacaaaagcaagcacauucugaauauauuaauauccugaaucacauuaaaaacaaaacugagcugaaguccacccacuauaauaugcuaaaauacguguguacaaauaaccgucauuaacaugggcaucuaaacuaucaaugguuaguaagauggacuucaauuuacaaugucacuuuuuuuguuuuuugagacgcagauuugcucuuguugcccaggcuggaguggaauggcaugaucucagcucacugcaaccucugccucccagguucaagugguucuccugccucagccucccgaguagcugggauuauaggugugcgccaccacacuuggcuaauuuuuucuauuuuuaguacagacgggcuuucaccauguuggucaagcuggucucaaacuccugaccucuggugauccacucgccucggcuucccaaaguuuagggauuacaggcaugagccaccgugccuggccacauuuuaaagcugaaaaaaauauaaauuguuuaaauucuucauuuuucaaacucauaaguucaagaauaaaaaauuaaaauaugaggaaaacugaaaugaaguaacuuugauagugacauucuucucaaagcuguaucaaagauuacgaauuaaguuguuaagaaucaaaauucacggcuuaccgauggcacauaccauucuaggagggacacaaagauggaaaaaaaaauucaagagucaacuaguaucuauggaaagcuacuaaagauaacuaccaauuaacaaauaauuucauaauccugcauggucaaacccaguauuucuuucagauagaacauggggaauuaaagaggaaugggaugaucuuuugagaaaauaucuagauaacuuuaaaaauaauuauuuuuuaauaagaaaaauucaaauuaauuuuuuaaauauugggccauauucauauauuaauucugucuauuguucuauacagucaaucuacuaccagcuuuccuaaaauacuuguuuguaugcaggcccaucacuugaaugguagcgauuaauaaauguaugauaauacuaacaaaauuuaauauuauguucaauuaguucucagauuuauuacaauuauuacucucagggccaggcaguuuccuucauuuuucagaggcccauggagucauuuuaaaauuaccacaaauuagguuggacacaguggcucauaccuguaaucccagcacuuugggaggccgagguggguggaucacuuaaggccacgaguuugagaccagccugggcaacacagugaaaccccgucucuacuaaaaauauaaaaauuagcugggcgugguggcacaugccuguaaucccagcuacucaagaggcugaggugggaaaaucacuugagccugggaggcagagguugcagugagccgaaacugcaccacagcaagcuggucugggugacagagugagauucugccuuaaaaaagaaagaaaaaauugccauugccacaaauuuuuaaaucuuaaaucaguaauaauuauuuugauuucaagggcaaaacucccgaaucuaagcacauuauuccugauucuccguuaucaauccaaggauuuuccucaugaucauucccuucuaugggaaauaauuauuguuuuuuaaccuuuauuugaccuagaaauuucaaaaacauuuuucuagcauuuaauguuaaacaaacuauaaaaaaguuacuuacaugagaaugaucuggagaccaugcaaugaauauccauucauaucccugggcauucugagaaucuaaccugaauaauauauagcaugguuguuuguccuccaacagggguaaaacaaaggaaucauaauccuuaucccaggaaucugaaggcugacuauaugauccaaucacaaguugcucuaugaaaaauuauuuuuagaaagauagguaaaugguuugagauaucaagugguagugugaugaagacuagaaaaauaaauauauagucauuucccaguuacuauuauucacaucaaaaaguugaaaagaaaaaugugguaacauagaaaguaauuaugacauagaguauuauaaaaacuguuaacuuuuuaugaacaugguuaaaauguuuaaaauauacacagccuaagaaagaaacauauaaaaaugaucauaacaguugaacugaauggucaaauaauguaaugaccuauaacagucauuacauuucuauuuuccaaaaugucugagcuuaaguuaucaacaaaauauauuuaaacuaccauucaaaaguauaauuucugacauuaacaaugaauuguacaguaagaaauauuaaauaaaaccauguuuaacuccuuuuuauuuggccauaaugcuacagauuuaaacauuugccuagauguauacacugguauagccacuuugaaaugguauucagcagaaucaaguaaaacuguuaaucuacuaugcauacagaaucucuuauacauaaauacaaagguguucacugcagcacuauacaguaacagugaaguuauagccucaauguucaucaauaagacaaugcaaaaauaauguguggcauagucauauaacauucuguucagauuuaaaaugaauuauugagcuaucaaaacuaauugcaaauggaacauuuucagaaaaaggaaagauacagaguaagaugguaucaugcaguuuauguaaacucaaagagcacuauaugcuauuuagggauacauguaaaaacagacugcacaaguaucagaacucccaauuguaguugccccaggguaaggaggucagaagcaaaauuguuuaaaggggaugcucuuauaccagaaaaacacugaauuuucuaaaaugcuugaaguaaauaagauaaaauguuagcaguuauuaauaaaggggagauauagguauuuaugauacaauuuuagucuuuggaauuuuccuuauuuaaaaauuuucacaaaacaaaaaaguaaaaccagaaaauaauaacuuaggaaguagugccauuuuccuuccguagagaugcuaguuagauuaacuuuuccauuuuaguuccuuaacuagucacuuaggaagugauggcauuaaaaauuuuagcucaguauuuuuaaaauaugcuguuuuacaauauacauauauuccuauugaauguuguauguaaacaaaugcauauuuuacaaacuauucugguauuuuuuauauaagcagaaaauagaaaacaaauuagauuuacuuccaguuugugaaagaacaaguuacuuuuccaaagcaaaauauuuucagauauuuaagaaauuaggccacuggaauauuuuaauauauucauuuaugacugaguaccuauaacaauaauuguucaaauucaaaucugccugauuuaaaagauucucccacucaaccagauucccuguuuacagaauuauuuuuaaagaaucaauuuguaguuuguuauauucucagaacuuucccaaaacaagaaagggaaaugaucauuucuguggcaaagguugcaaucaaauggagaaaaugggaguuugauauccuuuguuuauauuuaaaaacaaacuuaauugaauaauucacaaguaacuauuuuuuuuuuuugauaaucaccuguuuagugauuuccauuccagagauggaagcacugacauuagaaauggacuguggugcagaaacugagacacaaaaaguaaaagaggaagaagucacaucaaaaaacaucuuucuguuucccugauagucacauaauucagaaugaaauuaggggcccauagggaccugcacaaaauaugaggaauccaaguuaccguaagauuugaacuugcuucauauuaauuaauaguucaaaucacugacaacacacaguaaguuuaaaaauacaacagccacuaauccaggaacagaaaauauuuuaaaauauuuaacuaaccauuuucaauagauauuuucagaagucuguacuuuccauuucuggcucuggcaaagaucucuuuaacaucuucacuugcuguggaaaaagauaaagaaaguaaacuuuuuauacuuacauauaaauacuuuccuaucuauauuggaaaaguuaauuagaauacaaagaaaaaaucuggagcauguagcauccuuauuaucaguauuauaaaacuuuaccgcauaaaauaacgaagacuguauacaauuaagaaauauaaauauuagcauuuuaaaaguauguuaauaauucuaaucuguuuuagcuacauaauucugugcagaaauaacacuggggugaauauacugaaguuacucaaacccaauaaugagcaaauuacaauuuugaaaaacuuuucuugcucuuuugaaaaauauugaaaaccugcuuucauucucuaauucaguuucaagcuuaugacagacacuccuucaucaauucacuuucuguauuuucccguuaaaaacaacaguauauaucaaauauccuaacuuguuuaaagaaaaagacaauaaaaugcauucagucuuaacucugguuauauuuuucuaacuugcauuucucaaaagcuagauuaaacucauugaauaaauauguauuuaauaacuaacccuuguguuccuauuaaagcuucaauuucguucuaauuucguuccuguguugucuauuagcagcaagaaccacuauguaaguagguagugcuugcuauaaggcucaagcaugagagucaauaacuacauauuuauauaucgaaauuaaugcggauaaauaaaacaaaguuuucagauuugagacuauuuugcuucugcgugcgugcagggggaugugugcgguggugucaaaaaucuuuacgaauaaaacauacaauuaaguguucaucugggagaaagacucgcuauuaacaguaagagcuugaguuuacacuagaacucguuaagugaucgcgaguaacccggggauauauuauuugacucuugaugaggugaguaccugcaggcugcccaauuucaaaccaggaaauaauggaggucagauauaacugcauauugaacugucugcacgcauuacaugcaaccauacagaucaguuucccuuggggaguaucuaggaaaaagaucaaaacacacgcuuacacucgagauuucucagaacauaacucucauuuuccuauuuggagagaaaaugcgggagaguuuugggaagcaccccuacugaugugagaaagauucuggcaugguucuuuuuguaaucaaaguccuguaauauucuccuuuggaccaugaaaaagaaaacucgccugguucucgacagcguacugaagccccagucgccuccacugucccagcucuucccuacgugaccaaaagggggaaaguugggcgacugucggggacgguggaaggcacgcccccuucaaccaggccgccucgaaagccaauuuccuucgcucccccgaauuucggaucaaucugcaacgugacggcagcagggaccgggcuggaggaggacgcaggccggcagcgcccgggaagcaggagcgcggagaggcgccgaggcccggcucgccccgcgagaccgacuuccggagcucccggcccgacuccagcccugccgguccugcagcccucccggcucucccggcucucccggaagccccuucccugcgagucgcgccgggcgcuguuaccuuggaugccggucuggugggacauggcggcggccgcuagcucccggcuccggcgcugagugcagccagcggccccggccggcggccccaggaaguggcugcuccuccgccggccccggcgcgucauccgcccgcgacccgcggcc

SEQ ID NO: 17916 - RNA, 730 nt, Homo sapiens
gaguggccaauggccugcagagcaacaugcccaaguuuuauugugacuacugcaauacauaccucacccaugacucuccuccugugagaaagacacacugcagugguaggaaacacaaagagaaugugaaagacuacuaucagaaauggaugaaagagcaggcucagagccugauugacaaaacaacggcugcauuucaacaaggaaagauaccuccugcuccauucucugcuccuccuccuguaggagcaaugauaccaccucccccuagucuuccagguccuccucacccugguaugaugccagcaccccauaugagggguccugccaugaugccaaugaugggcccuccuccuccugggaugaugccagggggaccugcuccuggaaugaggccgcuuaugggaggccacaggccaaugaugccuggguccccagugauaagaccuccugccugucccaugauggugcccacucggcccagaaagacuugaccagacagauaaggauaaaggagagggcucauuaugucgguuuuauauuaccuguucugcuucaccaggagaucaugcugcugugaugcuggguuuucuaaacagcauaaggaagucuugcuccccucuccuaucaaagagaauaguuuuggaggggagaagugggacaaaaaagaugcaguuuucauuuguauugggaaaugugaaaauaaaauugucaacucuuuuaguuaaaa

SEQ ID NO: 17917 - RNA, 6507 nt, Homo sapiens
aaaauaaaauaaaauaaauaaaauaacaaagcuagaacaaagaacaaauaacaucacagugccugacuucaaaccaaaggcuauaguaaccaaaagagcaugauguguacaaaaacagacauauagaccaauggaauaggauacagaaccccaaaaugaagccacauaucuacaaucaccugaucuuuaaaaagucaauaauaacaaacaaugaggaaaggacucccuauucaauaaauggugcugggauaacuggcuagucauaugcggaaaguugaaacuggaccauuucuuuucgccacauaaaaaaguuaacucaagacagauucaagacuuaaauguaagaccuagaacaauaaaaacccuggaagaaaaccuagaaaguaccauacuggacauuggucuugacaaaguauuuaugacuaagucccagaaaacaauggcaacaaaaacaaaaauugacaagugggaccuacuaaagagcuuuggcauggcaaaagaaacuaucgacagaguauauagacaauuuacagaaugggagaaauuauuuacaaacuaugcaucagacaaaggucuaauaucuagaaucuguaaggaacuuaauucaacagacaaaaaagaaacaaucccauuaaaacaugcaaaaggaaaucaacggacacuucucaaaagaagauauacacguggccaacaaauauaugaaaaaaaugcuuaucaucacuaaucauuagagaaaugcaaaucaaaacugcaaugagauaccaucucacaccagucagaauggacauuacugaaaagucaaaaacaacagaugcuguugagguuguagagaaaagguaaugcuuauacaccgcuggugggaauguaaauuaguucagccacuauggaaagcaguuuggagauuuuucaaagaacucaaaacuaccauucaacccagcaaucccacuacugguuaaacacccaaagaaaaauaaaucguccuacuaaaaagaugaacaugcacugguauguucacugcagcacuauucacaacagcaaagacauggaaucaaccaagacacucaucaaugauggacuagauaaagaaaaugugguauauauauauaccaugaaauaccaugcagccauagaaaagaaccaaaucauguccuuuacagcaacauggaugcagcuggaggccauuauccuaagcagauuaaugcagggacagaaaaaccaaauacugcacauuaccacuuguaaguaggaacuaaacauuuaauacacauggauacaaagauggagacaauagacacuggagacugcuuaagcggggagagugggagugggguggguuggaaagcuauuuauuggguacuacgcucaauaccugggugacaggaucauucauacaccaaaccucagcaacauacaauuuacccauaacaaaacugcacauguacccccagaaccuaaaauaaaaguagaagaagaaaagaaaagaauuucaggauggcaaccacagaaucuuuuuuaaaaaauuauuuuaaguucugggauacaugugcaggaugagcagguuuguuacauagguaaacgugugccgugguaguuugcugaaccuaccaacucaucaccuagguauuaagccccacaugcauuagcuauuuauccugaugcccucccuccccccaccccaccccccgacaguguguguuguuccccucccuguauccauguguucucuuuguucagcucccgcuuaugagugagaacaugugguguuugguuuucuguuccuguguuaguuugcugaggauaauggcuuccagcuucauccaugucccugcaaaggacaugaucucauuccuuuuuguggcugcauaguaugguguauauguaccacauuuucuuuaucuagucuaucauugaugggcauuaaccacagaacauuuaaaucccaaguguuaggcccauaagaguguagggcucugugugaauacacuguuugaaugcccaucaagcugacccugccuggauuagauaguaaaguuauaggacugaaugaguucuauagggaaagaugagaagaaaagagacccaagaccugaagcuagaaaagcaacaacuuuuacaggaugggcagagaaagaauauccugguggccaaaaguuguauuuaaucagaugaaugaaugagaaaauaauuguucugcgaucccugacuugaaaaagcuuugcaaauacaaauaaccuggcuguauauuaauauuuuauuucacaaauuauuauuguauggaugauaauucuucaggguuaaaugugugguucuuacauaggccuauuauccuauuucugaggcauauauugauugcucaacugaaaaaaaaugcagaagagaagugguaggaaauaaaauggauuagaggaaagaauggaauuuacuaauaauagaguucccuucuagcaacaguuaccuuuacauauaaggccaacaauguuucgcugcaacauuuaucaaagaagaaaaauguaaacucuuaaaaaucugugaagaauucuaaaugacuaauuaaaacuuguugcaaagucaacuucgauaauuuuuuaacuacaaaguaacuuugaccgaagucuuaguccauaaaaaugagaacaaggccgggcgcgguggcucacgccuguaaucccagcacuuugggaggcagaggcgggcggaucacgaggucgggagaucuagaccauccuggcuaacacggugaaaccccgucccuacuaaaaauacaaaaaauuagcugggcgugguggugggcgccuguagucccagcuacuccggaggcugaggcaggagaauggcgugacccugggagguggagcuugcagugagccgagaucuagccacugcacuacagccugggugacagagcgcgacucugucuuaaaaaaaaaaagagagaacauuugguuaaagaacuauggcagggaguugaugagacuuugaauuuugaauuggugggggaaaaagugaucugaaaaaaaaauggauugggacaugucucuggaggugguuuaugaagaggcuaugagcacugauucugaaacaagcuguugagguuucaauccuggcuccacuauuuauucccugugugauuuuggacaaguugcucaaguugccucacaccugaagaaaaaugauaacacuuucuaggguuguuaugaggguugaaugacuggaugcuuauaaaacauguaaaacuuuuccuagcacauaaaaaguacuacacaaaaauuuguuaaaagaaaauuguaaaaauugaucauguaaccaaaacacuuuugaaguuucuacuuuuagugaguuucacaagcucaggggagaguguucagugaaaggaaacaaucucuucucaucuuucuucucccaucauuuuuuucuccuaucuucagaguacuguauuguugucucuuuauacuaaaaacaauucuguuuauucaaaaaaaguaccucaagaagcaaguauaguguuucccagguauuuucuuaaaaguaauuucaucaugucuuuucauguauauauucaugucuauuuucccacuuaagauuggucccaauguuuucuuucuuucagagagaacauuaaaaauguuaggaaacugaggugcaaggauugcuggaggccaggaguucgaaaccagccugggcaacauagugagacacccaucucuacaaaaaaauuuaagaauaagccccacaugguggugugcuccgcuuguaguucuaguuacugaacucccaccucggcaacagagcgagaccgucuuaaaaaaaguauguggaagaaaaaacaugcacaguagauuuaguguuauugugauaacccuagcacuucaguggaaaaaauauaaacaauuucaaugaguagacaauaacacauauaaccaagauuucaaauauaccuucuagcccuuuugagaagucaaaauugaacaaccugaauguaccagcuuuuuugaaaaaaguuuuguagacacgcgauccccaaaaccugccguucaaacaacuccaagggucuuuaaaguacuaaaucccuuuguauuuguccuaucggucccuuugguuuccaggaaagcauuaaaaauaaaaauaaaaacucucugccuuaauuuuauuucacgacuuucuuuucucuuauuauagcuuuccacauugcuuuagaagaguuuacaucuaacucuaguggucuucggcuucuucucccucuuugacacagaggacuaguuucaauuguacaaauaggcuggacgcuucagcgauuaucuuccgaccacucccugugugcucgcgcgggcggaguagggggcgcuucuccacucuccgcgaccucaauguaugcggaaauccuccugccuuugugcacacguuuauuuagaaaauucucuccacccccacucccguccgucccgccccuucuucuuuugcuuauucucugaguuuugccucuccucccaccccgacuccaccguaaucuuaaccuacccguacagauuccacuuucccacuucggagcuagaguaauuuaagauccccccauuauuagcuccacgucgccuuuaaaagccauucaaacgaguucgccuuccaggguucugcaguugugcugcagcagcauuucccuccucuccaguaucagacguuaaaacaaagcaagccacaguguguguccacagacgaccuuggaacgaaaagcugcccuguuugggaucaaugcucagggaacccaguccacucccgcacucacguguucccgccuugcccuccagcuaguucccccgcgcgcaggaucgcacuacucccucugcagucucgccugccgacuuccuucugcgcgccucguaaaaccggggaaguucaaucauuccgcagcgagccgcggcggccgcacugggcaugcucagucuccgggcuccgcucggcaggcgagaggcguccuccggcucugggcuccggucggugggugccucggcucggcuuuccccggcgcuggcugggcucagcggccccugagcccaagcgacacacgccccgcgguccccgauccggccccugggagagccgcgccguucuggaacccgggagcccccaacuucgcgccaaguucggagccgccuucugagggagacaugaaaaagaugagcaggaauguuuugcuacaaauggaggaggaggaggacgacgacgauggggauaucggugagcgagggguccccgcguccccacccgagagcccgagccgacgcgggaagaaguucggggacugcgcgggggcgcugugcucuccgcgggggagguuggccgagacgcucggccgcuccgggcaggggaggaagcccgcuguccccggcugcuugcagacugaggccccggugcggccccugcggggcugaggcgcggggcgcgugguggccccgaggacaggcuccugacgggcgggggaugcugccccugaaaagccuggcagcugcggggacgccucugcgugcggaagucuccacucagaagcaacuuuggggucacuuccccgacucgcagagugcuaggguugcccaggagccucggcacuggggcgagcccccugggcgggguccggggagcaggcccgcauuuggaggacagggugugacccaucugaauccucguuaaaguaaaagccgaccgacggcucugggagguuugaggccuggcggggcggccccgggaagugauuuguggccgcuaggcgcgcgcuggaaacccuuucccaucugcggagcccaccggagcugugaucggaggaggaauucccccaggcagggaggaccgcagggccuuuuucacucguccugaggggcccuggggcuuggggagcaaaccuggggugacccauuucuaguuagaguuaaaaaugcauggaagugacaagacgaacggagggagagcuguuuuaagagcaaaaaaagaaaaaaagggcaaacaaaagggaugagaggaggugaggaaggggaaaggaaugagaggacuagagagaaaaucaggucccuaaagagaacacugucgggggaugaugauauaaugugucccuccagaagacucuaauuaaauuaccaagccagucuguuguggcgacucggcuuagucuccuggaugccaaaucaauuuuaaagcagaacauccugcugauguucuaaagcccuguuguuaucuaauaacuuuaaaaguaacuuaauuuuaggaguugggugugguuuuuauuucuguuacauuuugggcacggaauauuucgaucaaaaaaauuugguaacuucuugguuguccagggacaaaucgaauagaggagauuacacuccaugauuuaguuucacauuucauucauucauuuaagaacaauuuacuaguuauucaucuuuaaggagagagcaaauaguaguaguuuuuauaggagagaaaacugaagcgcacagguuggucugcccagcuucucacacuuucaaa
